United States Patent 9,290,773 (TRANSGENIC PLANTS WITH ENHANCED AGRONOMIC TRAITS) - sequence listing, part 3

SEQ ID NO: 9545 - protein, 362 aa, Arabidopsis thaliana
MARTIKYRLLIEFHRVNKQVERIYSKSSGSSNVNEGKRFAFDLNVEPVDETLDLNVEPVDEENRDALNPVDEENHDSMNHVAKQNHDSSNHVDQEIRDSQNLIDEENHDSPKDSDYLGDLDLCSICRGALVNENDVQRTLVTLKCVHKFHLDCIGSAYNAKGFMECPNCRNIEPGHWQFSDGTHFNPNGMIANNEEEEEDNDPGSFSQMIVKSEVCPFGCLGQRYPFDPLGRSDISMINAPMNLSCPSTSTVQLNPSDVWESTQPFLSSRHHLMVEDEIYRMIYGDRIEMGERSGNHRGRESNGNGDNGGSSTFGGNGNGNGINATVLCSSRTGSSNYFSTSQVKVTIQRLENVHGLIGISS

SEQ ID NO: 9546 - protein, 1143 aa, Arabidopsis thaliana
MTTSPIRVRIRTRIQISFIFLLTHLSQSSSSDQSSLKTDSLSLLSFKTMIQDDPNNILSNWSPRKSPCQFSGVTCLGGRVTEINLSGSGLSGIVSFNAFTSLDSLSVLKLSENFFVLNSTSLLLLPLTLTHLELSSSGLIGTLPENFFSKYSNLISITLSYNNFTGKLPNDLFLSSKKLQTLDLSYNNITGPISGLTIPLSSCVSMTYLDFSGNSISGYISDSLINCTNLKSLNLSYNNFDGQIPKSFGELKLLQSLDLSHNRLTGWIPPEIGDTCRSLQNLRLSYNNFTGVIPESLSSCSWLQSLDLSNNNISGPFPNTILRSFGSLQILLLSNNLISGDFPTSISACKSLRIADFSSNRFSGVIPPDLCPGAASLEELRLPDNLVTGEIPPAISQCSELRTIDLSLNYLNGTIPPEIGNLQKLEQFIAWYNNIAGEIPPEIGKLQNLKDLILNNNQLTGEIPPEFFNCSNIEWVSFTSNRLTGEVPKDFGILSRLAVLQLGNNNFTGEIPPELGKCTTLVWLDLNTNHLTGEIPPRLGRQPGSKALSGLLSGNTMAFVRNVGNSCKGVGGLVEFSGIRPERLLQIPSLKSCDFTRMYSGPILSLFTRYQTIEYLDLSYNQLRGKIPDEIGEMIALQVLELSHNQLSGEIPFTIGQLKNLGVFDASDNRLQGQIPESFSNLSFLVQIDLSNNELTGPIPQRGQLSTLPATQYANNPGLCGVPLPECKNGNNQLPAGTEEGKRAKHGTRAASWANSIVLGVLISAASVCILIVWAIAVRARRRDADDAKMLHSLQAVNSATTWKIEKEKEPLSINVATFQRQLRKLKFSQLIEATNGFSAASMIGHGGFGEVFKATLKDGSSVAIKKLIRLSCQGDREFMAEMETLGKIKHRNLVPLLGYCKIGEERLLVYEFMQYGSLEEVLHGPRTGEKRRILGWEERKKIAKGAAKGLCFLHHNCIPHIIHRDMKSSNVLLDQDMEARVSDFGMARLISALDTHLSVSTLAGTPGYVPPEYYQSFRCTAKGDVYSIGVVMLEILSGKRPTDKEEFGDTNLVGWSKMKAREGKHMEVIDEDLLKEGSSESLNEKEGFEGGVIVKEMLRYLEIALRCVDDFPSKRPNMLQVVASLRELRGSENNSHSHSNSL

SEQ ID NO: 9547 - protein, 309 aa, Arabidopsis thaliana
MEITLNSGFKMPIVGLGVWRMEKEGIRDLILNAIKIGYRHLDCAADYRNETEVGDALTEAFKTGLVKREDLFITTKLWNSDHGHVIEACKDSLKKLQLDYLDLFLVHFPVATKHTGVGTTDSALGDDGVLDIDTTISLETTWHDMEKLVSMGLVRSIGISNYDVFLTRDCLAYSKIKPAVNQIETHPYFQRDSLVKFCQKHGICVTAHTPLGGATANAEWFGTVSCLDDPVLKDVAEKYKKTVAQVVLRWGIQRKTVVIPKTSKPARLEENFQVFDFELSKEDMEVIKSMERKYRTNQPAKFWNIDLYA

SEQ ID NO: 9548 - protein, 309 aa, Arabidopsis thaliana
MEITLNSGFKMPIIGLGVWRMEKEELRDLIIDAIKIGYRHLDCAANYKNEAEVGEALTEAFTTGLVKREDLFITTKLWSSDHGHVIEACKDSLKKLQLDYLDLFLVHIPIATKHTGIGTTDSALGDDGVLDIDTTISLETTWHDMEKLVSMGLVRSIGISNYDVFLTRDCLAYSKIKPAVNQIETHPYFQRDSLVKFCQKHGICVTAHTPLGGATANAEWFGTVSCLDDPVLKDVAEKYKQTVAQIVLRWGIQRNTVVIPKTSKPERLEENFQVFDFQLSKEDMEVIKSMERNYRTHQTAKFWGIELYA

SEQ ID NO: 9549 - protein, 176 aa, Arabidopsis thaliana
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGGGGYRSGGGGGYSGGGGSYGGGGGRREGGGGYSGGGGGYSSRGGGGGSYGGGRREGGGGYGGGEGGGYGGSGGGGGW

SEQ ID NO: 9550 - protein, 435 aa, Arabidopsis thaliana
MKPSSPISLTSSSIARKARFSPYLFTLLAFILFVSVLYGEDFMCIFGQLEPNFVLPPSRTPEKNKKSEKLAFAIGKTEESCDVFSGKWVRDEVSRPLYEEWECPYIQPQLTCQEHGRPDKDYQFWRWQPNHCDLPSFNASLMLETLRGKRMMYVGDSLNRGMFVSMICLLHRLIPEDQKSIKTNGSLTVFTAKEYNATIEFYWAPFLLESNSDDAIVHRISDRVVRKGSINKHGRHWKGVDIIIFNTYLWWMTGLKMNILEVSDIGGIYRQGSFDDKEKNIVEVSTEDAYRMGMKSMLRWVKNNMDRKKTRVFFTSMSPTHAKGIDWGGEPGQNCYNQTTLIEDPSYWGSDCRKSIMKVIGEVFGRSKTPITLLNITQMSNYRKDAHTSIYKKQWSPLTAEQLENPTSYADCVHWCLPGLQDTWNELLFAKLFYT

SEQ ID NO: 9551 - protein, 580 aa, Arabidopsis thaliana
MDVTKSLLCFISFVAFLLFSSVAEANKAHHHEFIIQATKVKRLCETHNSITVNGMFPGPMLVVNNGDTLVVKVINRARYNITIHWHGVRQMRTGWADGPEFVTQCPIRPGSSYTYRFTIQGQEGTLWWHAHSSWLRATVYGSLLVFPPAGSSYPFTKPHRNVPLLLGEWWDANPVDVLRESIRTGGAPNNSDAYTINGQPGDLYKCSSQDTTVVPINVGETILLRVINSALNQPLFFTVANHKLTVVGADASYLKPFTTNVIVLGPGQTTDVLITGDQPPNRYYMAARAYQSAQNAPFGNTTTTAILQYKSAPCCGVGGGSGTKKGNSFKPIMPILPAYNDTNTVTRFSQSFRSLRRAEVPTEIDENLFVTIGLGLNNCPKNFRSRRCQGPNGTRFTASMNNVSFALPSNYSLLQAHHHGIPGVFTTDFPAKPPVKFDYTGNNISRSLYQPDRGTKLYKLKYGSRVQIVLQDTGIVTPENHPIHLHGYDFYIIAEGFGNFNPKKDTAKFNLEDPPLRNTVGVPVNGWAVIRFIADNPGVWIMHCHLDAHISWGLAMAFLVENGNGVLQTIEQPPHDLPVC

SEQ ID NO: 9552 - protein, 160 aa, Arabidopsis thaliana
MESEGKIVFTEEQEALVVKSWSVMKKNSAELGLKLFIKIFEIAPTTKKMFSFLRDSPIPAEQNPKLKPHAMSVFVMCCESAVQLRKTGKVTVRETTLKRLGASHSKYGVVDEHFEVAKYALLETIKEAVPEMWSPEMKVAWGQAYDHLVAAIKAEMNLSN

SEQ ID NO: 9553 - protein, 511 aa, Arabidopsis thaliana
MNSSGVEQGVVIAESEPPRGNRSRYAFACAILASMTSIILGYDIGVMSGASIFIKDDLKLSDVQLEILMGILNIYSLVGSGAAGRTSDWLGRRYTIVLAGAFFFCGALLMGFATNYPFIMVGRFVAGIGVGYAMMIAPVYTAEVAPASSRGFLTSFPEIFINIGILLGYVSNYFFSKLPEHLGWRFMLGVGAVPSVFLAIGVLAMPESPRWLVLQGRLGDAFKVLDKTSNTKEEAISRLDDIKRAVGIPDDMTDDVIVVPNKKSAGKGVWKDLLVRPTPSVRHILIACLGIHFAQQASGIDAVVLYSPTIFSKAGLKSKNDQLLATVAVGVVKTLFIVVGTCVVDRFGRRALLLTSMGGMFLSLTALGTSLTVINRNPGQTLKWAIGLAVTTVMTFVATFSIGAGPVTWVYCSEIFPVRLRAQGASLGVMLNRLMSGIIGMTFLSLSKGLTIGGAFLLFAGVAAAAWVFFFTFLPETRGIPLEEMETLFGSYTANKKNNSMSKDNEVVDGQ

SEQ ID NO: 9554 - protein, 583 aa, Arabidopsis thaliana
MEAAKVYTQDGTVDLQGRPVLASKTGRWRACSFLLGYEAFERMAFYGIASNLVNYLTKRLHEDTISSVRNVNNWSGAVWITPIAGAYIADSYIGRFWTFTASSLIYVLGMILLTMAVTVKSLRPTCENGVCNKASSLQVTFFYISLYTIAIGAGGTKPNISTFGADQFDSYSIEEKKQKVSFFNWWMFSSFLGALFATLGLVYIQENLGWGLGYGIPTVGLLVSLVVFYIGTPFYRHKVIKTDNLAKDLVQVPIAAFKNRKLQCPDDHLELYELDSHYYKSNGKHQVHHTPVFRFLDKAAIKTSSRVPCTVTKVEVAKRVLGLIFIWLVTLIPSTLWAQVNTLFVKQGTTLDRKIGSNFQIPAASLGSFVTLSMLLSVPMYDQSFVPFMRKKTGNPRGITLLQRLGVGFAIQIVAIAIASAVEVKRMRVIKEFHITSPTQVVPMSIFWLLPQYSLLGIGDVFNAIGLLEFFYDQSPEEMQSLGTTFFTSGIGLGNFLNSFLVTMIDKITSKGGGKSWIGNNLNDSRLDYYYGFLVVISIVNMGLFVWAASKYVYKSDDDTKEFSGGGCVQMEAKALDTSPLSI

SEQ ID NO: 9555 - protein, 511 aa, Arabidopsis thaliana
MSSSGEERGVVVAESEPPRGNRSRFAFACAILASMTSIILGYDIGVMSGAAIFIKDDLKLSDVQLEILMGILNIYSLIGSGAAGRTSDWIGRRYTIVLAGFFFFCGALLMGFATNYPFIMVGRFVAGIGVGYAMMIAPVYTTEVAPASSRGFLSSFPEIFINIGILLGYVSNYFFAKLPEHIGWRFMLGIGAVPSVFLAIGVLAMPESPRWLVMQGRLGDAFKVLDKTSNTKEEAISRLNDIKRAVGIPDDMTDDVIVVPNKKSAGKGVWKDLLVRPTPSVRHILIACLGIHFSQQASGIDAVVLYSPTIFSRAGLKSKNDQLLATVAVGVVKTLFIVVGTCLVDRFGRRALLLTSMGGMFFSLTALGTSLTVIDRNPGQTLKWAIGLAVTTVMTFVATFSLGAGPVTWVYASEIFPVRLRAQGASLGVMLNRLMSGIIGMTFLSLSKGLTIGGAFLLFAGVAVAAWVFFFTFLPETRGVPLEEIESLFGSYSANKKNNVMSKGKQVVDEQ

SEQ ID NO: 9556 - protein, 335 aa, Arabidopsis thaliana
MVIVLQPASFDSNLYVNPKCKPRPVLIPVIDLTDSDAKTQIVKACEEFGFFKVINHGVRPDLLTQLEQEAINFFALHHSLKDKAGPPDPFGYGTKRIGPNGDLGWLEYILLNANLCLESHKTTAIFRHTPAIFREAVEEYIKEMKRMSSKFLEMVEEELKIEPKEKLSRLVKVKESDSCLRMNHYPEKEETPVKEEIGFGEHTDPQLISLLRSNDTEGLQICVKDGTWVDVTPDHSSFFVLVGDTLQVMTNGRFKSVKHRVVTNTKRSRISMIYFAGPPLSEKIAPLSCLVPKQDDCLYNEFTWSQYKLSAYKTKLGDYRLGLFEKRPPFSLSNV

SEQ ID NO: 9557 - protein, 613 aa, Arabidopsis thaliana
MESCDCFETHVNQDDLLVKYQYISDALIALAYFSIPLELIYFVQKSAFFPYKWVLMQFGAFIILCGATHFINLWMFFMHSKAVAIVMTIAKVSCAVVSCATALMLVHIIPDLLSVKNRELFLKKKADELDREMGLILTQEETGRHVRMLTHGIRRTLDRHTILRTTLVELGKTLCLEECALWMPSQSGLYLQLSHTLSHKIQVGSSVPINLPIINELFNSAQAMHIPHSCPLAKIGPPVGRYSPPEVVSVRVPLLHLSNFQGSDWSDLSGKGYAIMVLILPTDGARKWRDHELELVENVADQVAVALSHAAILEESMHARDQLMEQNFALDKARQEAEMAVHARNDFLAVMNHEMRTPMHAIISLSSLLLETELSPEQRVMIETILKSSNLVATLISDVLDLSRLEDGSLLLENEPFSLQAIFEEVISLIKPIASVKKLSTNLILSADLPTYAIGDEKRLMQTILNIMGNAVKFTKEGYISIIASIMKPESLQELPSPEFFPVLSDSHFYLCVQVKDTGCGIHTQDIPLLFTKFVQPRTGTQRNHSGGGLGLALCKRFVGLMGGYMWIESEGLEKGCTASFIIRLGICNGPSSSSGSMALHLAAKSQTRPWNW

SEQ ID NO: 9558 - protein, 576 aa, Arabidopsis thaliana
MGICHGKPVEQQSKSLPVSGETNEAPTNSQPPAKSSGFPFYSPSPVPSLFKSSPSVSSSVSSTPLRIFKRPFPPPSPAKHIRAFLARRYGSVKPNEVSIPEGKECEIGLDKSFGFSKQFASHYEIDGEVGRGHFGYTCSAKGKKGSLKGQEVAVKVIPKSKMTTAIAIEDVSREVKMLRALTGHKNLVQFYDAFEDDENVYIVMELCKGGELLDKILQRGGKYSEDDAKKVMVQILSVVAYCHLQGVVHRDLKPENFLFSTKDETSPLKAIDFGLSDYVKPDERLNDIVGSAYYVAPEVLHRTYGTEADMWSIGVIAYILLCGSRPFWARTESGIFRAVLKAEPNFEEAPWPSLSPEAVDFVKRLLNKDYRKRLTAAQALCHPWLVGSHELKIPSDMIIYKLVKVYIMSTSLRKSALAALAKTLTVPQLAYLREQFTLLGPSKNGYISMQNYKTAILKSSTDAMKDSRVFDFVHMISCLQYKKLDFEEFCASALSVYQLEAMETWEQHARRAYELFEKDGNRPIMIEELASELGLGPSVPVHVVLQDWIRHSDGKLSFLGFVRLLHGVSSRTLQKA

SEQ ID NO: 9559 - protein, 500 aa, Arabidopsis thaliana
MVLSKTASKSDDSIHSTFASRYVRNSISRFEIPKNSIPKEAAYQIINDELKFDGNPRLNLASFVTTWMEPECDKLMMESINKNNVEMDQYPVTTDLQNRCVNMIARLFNAPLGDGEAAIGVGTVGSSEAVMLAGLAFKRQWQNKRKALGLPYDRPNIVTGANIQVCLEKFARYFEVELKEVKLREGYYVMDPDKAVEMVDENTICVVAILGSTLTGEFEDVKLLNDLLVEKNKKTGWDTPIHVDAASGGFIAPFLYPDLEWDFRLPLVKSINVSGHKYGLVYAGIGWVVWRTKTDLPDELIFHINYLGADQPTFTLNFSKGSSQVIAQYYQLIRLGFEGYRNVMDNCRENMMVLRQGLEKTGRFNIVSKENGVPLVAFSLKDSSRHNEFEVAEMLRRFGWIVPAYTMPADAQHVTVLRVVIREDFSRTLAERLVADFEKVLHELDTLPARVHAKMASGKVNGVKKTPEETQREVTAYWKKFVDTKTDKNGVPLVASITNQ

SEQ ID NO: 9560 - protein, 493 aa, Arabidopsis thaliana
MVLSKTVSESDVSIHSTFASRYVRNSLPRFEMPENSIPKEAAYQIINDELMLDGNPRLNLASFVTTWMEPECDKLMMESINKNYVDMDEYPVTTELQNRCVNMIARLFNAPLGDGEAAVGVGTVGSSEAIMLAGLAFKRQWQNKRKAQGLPYDKPNIVTGANVQVCWEKFARYFEVELKEVNLREDYYVMDPVKAVEMVDENTICVAAILGSTLTGEFEDVKLLNDLLVEKNKQTGWDTPIHVDAASGGFIAPFLYPELEWDFRLPLVKSINVSGHKYGLVYAGIGWVVWRTKTDLPDELIFHINYLGADQPTFTLNFSKGSSQVIAQYYQLIRLGFEGYRNVMDNCRENMMVLRQGLEKTGRFKIVSKENGVPLVAFSLKDSSRHNEFEVAHTLRRFGWIVPAYTMPADAQHVTVLRVVIREDFSRTLAERLVADFEKVLHELDTLPARVHAKMANGKVNGVKKTPEETQREVTAYWKKLLETKKTNKNTIC

SEQ ID NO: 9561 - protein, 585 aa, Arabidopsis thaliana; identical to SEQ ID NO: 1210

SEQ ID NO: 9562 - protein, 156 aa, Arabidopsis thaliana
MERGRSDMEMINNMANCLILLSKAHQNDTKSRVFACKTCNKEFPSFQALGGHRASHRRSAALEGHAPPSPKRVKPVKHECPICGAEFAVGQALGGHMRKHRGGSGGGGGRSLAPATAPVTMKKSGGGNGKRVLCLDLNLTPLENEDLKLELGRFIF

SEQ ID NO: 9563 - protein, 103 aa, Arabidopsis thaliana; identical to SEQ ID NO: 683

SEQ ID NO: 9564 - protein, 573 aa, Arabidopsis thaliana
MVTWVLNYLLVAFLFAISYNIDAASAGITRHYQFDIQLKNITRLCKTKTIVTVNGKFPGPRVTAREGDNLQIKVVNHVSNNISIHWHGIRQLRSGWADGPSYVTQCPIRMGQSYVYNFTVTGQRGTLWWHAHIQWMRATVYGPLIILPKLHQPYPFPKPYKQVPILFGEWFNADPQAVVQQALQTGAGPNASDAHTFNGLPGPLYNCSTKDTYKLMVKPGKTYLLRLINAALNDELFFTIANHTLTVVEADACYVKPFQTNIVLLGPGQTTNVLLKTKPIYPNATFYMLARPYFTGQGTIDNTTVAGILQYQHHTKSSKNLSIIKPSLPPINSTSYAANFTKMFRSLASSTFPANVPKVVDKQYFFAIGLGTNPCPKNQTCQGPTNTTKFAASINNVSFILPNKTSLLQSYFVGKSKNVFMTDFPTAPIIPFNYTGTPPNNTMVSRGTKVVVLKYKTTVELVLQGTSILGIEAHPIHLHGFNFYVVGQGFGNFNPARDPKHYNLVDPVERNTINIPSGGWVAIRFLADNPGVWLMHCHIEIHLSWGLTMAWVVLDGDLPNQKLLPPPSDFPKC

SEQ ID NO: 9565 - protein, 268 aa, Arabidopsis thaliana
MAKAGENSRDKSRWSLEGMTALVTGGSKGLGEAVVEELAMLGARVHTCARDETQLQERLREWQAKGFEVTTSVCDVSSREQREKLMETVSSVFQGKLNILVNNAGTGIIKPSTEYTAEDYSFLMATNLESAFHLSQIAHPLLKASGSGSIVFMSSVAGLVHTGASIYGASKGAMNQLGRSLACEWASDNIRVNSVCPWVITTPLTSFIFSDEKLRKAVEDKTPMGRVGEANEVSSLVAFLCFPAASYITGQTICVDGGASVNGFSFKP

SEQ ID NO: 9566 - protein, 268 aa, Arabidopsis thaliana
MAKAEENLRDKCRWSLGGMTALVTGGSKGLGEAVVEELAMLGARVHTCARNETQLQECVREWQAKGFEVTTSVCDVSSRDQREKLMENVASIFQGKLNILVNNAGTGITKPTTEYTAQDYSFLMATNLDSAFHLSQLAHPLLKASGSGSIVLMSSTAGVVHINVGSIYGATKGAMNQLAKNLACEWARDNIRVNSVCPWFIATPLYLNDEELKKEVERKTPMGRVGNANEVSSLVAFLCFPAASYITGQTICVDGGFTVNCFSFKPVL

SEQ ID NO: 9567 - protein, 322 aa, Arabidopsis thaliana
MVLDMASHLYTNPPQNLHFISSSSSLKPHLCLSFKRINPKHKSSSSSVFVPYASQSSIAITSKERWSLNGMSALVTGGTRGIGRAIVEELAGLGAEVHTCARNEYELENCLSDWNRSGFRVAGSVCDVSDRSQREALMETVSSVFEGKLHILVNNVGTNIRKPMVEFTAGEFSTLMSTNFESVFHLCQLAYPLLRESKAGSVVFISSVSGFVSLKNMSVQSSTKGAINQLTRSLACEWAKDNIRINAVAPWYIKTSMVEQVLSNKEYLEEVYSVTPLGRLGEPREVSSAVAFLCLPASSYITGQILCVDGGMSINGFFPRHD

SEQ ID NO: 9568 - protein, 262 aa, Arabidopsis thaliana
MDKRWSLQGMNALVTGGTKGIGEAVVEELSILGARVHTCARDETQLQERLREWQEKGFQVTTSICDVSLREQREKLMETVSSLFQGKLNILVNNVGTLMLKPTTEYTAEEFSFLMATNLDSAFHISQLAHPLLKASGSGSIVLMSSIAGVVHVGVGSIYGATKGAMNQLARNLACEWASDNIRTNAICPWLITTPLISDLLSVEEMKKEAEERTPMGRVGEANEVSPLVAFLCLPAASYITGQVICVDGGLTVNGFSYQPHA

SEQ ID NO: 9569 - protein, 263 aa, Arabidopsis thaliana
MDKRWSLQGMTALVTGAASGIGYAIVEELAGFGARIHVCDISETLLNQSLREWEKKGFQVSGSVCDVTSRPEREKLMQTVSSLFDGKLNILVNNVGVLRAKPTTEYVADDFTFHISTNLEAAYHFCQLSHPLLKTSGYGSIVFLSSVSGVVSITDCGSLYGLTKGALNQLARNLACEWAKDGIRANAVAPNVVKTAQSQFFLQDVSKKEGLFSRTPLGRSGEPNEVASLVVFLCLPAASYITGQTICIDGGLTVYGFSSQPQA

SEQ ID NO: 9570 - protein, 262 aa, Arabidopsis thaliana
MDKRWSLQGMTALVTGAASGIGYAIVEELASFGAIIHICDISETLLSQSLSEWEKKGFQVSGSICDVASRPDREKLMQTVSSLFDGKLNILVNNVGVIRGKPTTEYVAEDFSYHISTNLEPAFHFSQLSHLLLKASGFGSIVFMSSATGVVSVQCGSIYSLTKGALNQLTRNLACEWAKDGIRANAVAPNVVKTPLSQSYLEDVGFKEALFSRTPLGRAGEPNEVASLVVFLCLPAASYITGQTICIDGGFTVNAFSYKPQA

SEQ ID NO: 9571 - protein, 269 aa, Arabidopsis thaliana
MVTRKMDKRLWSLQGMTALVTGAASGIGYAIVEELAGFGAKIHICDISKTLLNQSLSEWENKGFQVSGSVCDVTSHPEREKLMQTVSSIFDGKLNILVNNVGVLRGKPTTEYVADDFTFHISTNLEAAYHFCQLSHPLLKASGYGSIVFLSSVAGVVSLIDCGSIYGLTKGALNQLARNLACEWAKDGIRANAVAPNVVKTAQSQSFLEDVSKKEGLLSRTPLGRVGEPNEVSSLVVFLCLPAASYITGQTICVDGGLTVNGFSYQPHA

SEQ ID NO: 9572 - protein, 260 aa, Arabidopsis thaliana
MDKRWSLQGLTALVTGGASGIGHAIVEELAGFGAKIHVCDISKTLLNQSLSEWEKKGFQVSGSVCDASNRLERETLMQTVTTIFDGKLNILVNNVGTIRTKPTIEYEAEDFSFLISTNLESAYHLSQLSHPLLKASGNGIITFISSAAGIVSFDAASIYGLTKGALNQLARNLACEWAKDGIRANAVAPNFITTALAKPFLEDAGFNEILSSRTPLGRAGEPREVASLVAFLCLPAASYITGQTICVDGGLTVNGFSYQP

SEQ ID NO: 9573 - protein, 269 aa, Arabidopsis thaliana
MAKEGGLGENSRWSLGGMTALVTGGSKGIGEAVVEELAMLGAKVHTCARDETQLQERLREWQAKGFQVTTSVCDVSSRDQRVKLMETVSSLYQGKLNILVNNVGTSIFKPTTEYTAEDFSFVMATNLESAFHLSQLAHPLLKASGSGSIVLISSAAGVVHVNVGSIYGATKGAMNQLARNLACEWASDNIRTNSVCPWYITTPLSNDFFDEEFKKEAVRTTPMGRVGEANEVSPLVAFLCLPSASYITGQTICVDGGATVNGFSFKTMP

SEQ ID NO: 9574 - protein, 271 aa, Arabidopsis thaliana
MAKTGESLRDKPRWSLVGMTALVTGGSKGIGEAVVEELATLGARIHTCARDETQLQESLRKWQAKGFQVTTSVCDVSSRDKREKLMETVSTIFEGKLNILVNNVGTCIVKPTLQHTAEDFSFTMATNLESAFHLSQLAHPLLKASGSGSIVLISSVSGVVHVNGASIYGVSKGAMNQLGRNLACEWASDNIRTNSVCPWFIETPLVTESLSNEEFRKEVESRPPMGRVGEVNEVSSLVAFLCLPAASYITGQTICVDGGFTVNGFSFKPLP

SEQ ID NO: 9575 - protein, 361 aa, Arabidopsis thaliana
MAENLACGETSESWIIDNDDDDINYGGGFTNEIDYNHQLFAKDDNFGGNGSIPMMGSSSSSLSEDRIKEMLVREIEFCPGTDYVKRLLSGDLDLSVRNQALDWILKVCAHYHFGHLCICLSMNYLDRFLTSYELPKDKDWAAQLLAVSCLSLASKMEETDVPHIVDLQVEDPKFVFEAKTIKRMELLVVTTLNWRLQALTPFSFIDYFVDKISGHVSENLIYRSSRFILNTTKAIEFLDFRPSEIAAAAAVSVSISGETECIDEEKALSSLIYVKQERVKRCLNLMRSLTGEENVRGTSLSQEQARVAVRAVPASPVGVLEATCLSYRSEERTVESCTNSSQSSPDNNNNNNNSNKRRRKQ

SEQ ID NO: 9576 - protein, 321 aa, Arabidopsis thaliana
MSYRLLSVDKDELVTSPCLKERNYLGLSDCSSVDSSTIPNVVGKSNLNFKATELRLGLPESQSPERETDFGLLSPRTPDEKLLFPLLPSKDNGSATTGHKNVVSGNKRGFADTWDEFSGVKGSVRPGGGINMMLSPKVKDVSKSIQEERSHAKGGLNNAPAAKAQVVGWPPIRSYRKNTMASSTSKNTDEVDGKPGLGVLFVKVSMDGAPYLRKVDLRTYTSYQQLSSALEKMFSCFTLGQCGLHGAQGRERMSEIKLKDLLHGSEFVLTYEDKDGDWMLVGDVPWEIFTETCQKLKIMKGSDSIGLAPGAVEKSKNKERV

SEQ ID NO: 9577 - protein, 98 aa, Arabidopsis thaliana
MSQYNQPPVGVPPPQGYPPEGYPKDAYPPQGYPPQGYPQQGYPPQGYPQQGYPQQGYPPPYAPQYPPPPQHQQQQSSPGFLEGCLAALCCCCLLDACF

SEQ ID NO: 9578 - protein, 305 aa, Arabidopsis thaliana
MAPGGSALKEALESNSTGVDYEVKMAKVEANSKPTKSGSGSIGKFHSSNGVYELLECPVCTNLMYPPIHQCPNGHTLCSSCKLRVQNTCPTCRYELGNIRCLALEKVAESLEVPCRYQNLGCQDIFPYYSKLKHEQHCRFRSYSCPYAGSECSVTGDIPTLVDHLKDDHKVDMHDGCTFNHRYVKSNPHEVENATWMLTVFNCFGRQFCLHFEAFQLGMAPVYMAFLRFMGDENEAKKFSYSLEVGAHSRKLTWQGIPRSIRDSHRKVRDSQDGLIIPRNLALYFSGSDKEELKLRVTGRIWKEE

SEQ ID NO: 9579 - protein, 425 aa, Arabidopsis thaliana
MGEEISSTVNLDLNLGPDPELGLEPATNYARSDWGNGLAARESESLRRFRSRYRSRFRRIDMLPVLAETHSPAMELSQLLITSGNVVALPAGEGSMASGERVIEDSKKCENGSKVMAEDNVTEEKRDVEKSVGSDGSFFDCYICLDLSKDPVVTNCGHLYCWSCLYQWLQVSEAKECPVCKGEVSVKTVTPIYGRGIQKRESEEVSNTKIPSRPQARRTESLRTTLNRSGHIPTEIFRHLQDRLERESSTGERRARPSLNRFMTSRGVRAEENQSSEALVEPSSDEINDIDLILNNAPENEEENENLSSSRALATQRRWAQMYGRVSSFTLSSAERLADTYLITHALGRNQEQNSSPPVGVEDRDSFSSIVGVINSESQVETAAEINSMLTVSTSSSVRRHENSSRVSDVDSADSRPLRRRRRLA

SEQ ID NO: 9580 - protein, 213 aa, Arabidopsis thaliana
MDLCRSSILLLIIALLSPRTLSMRYELKSSKTKCIGEEIHENAMSIGKYFIVNPNEDNHPLPDSHKIIVKVMPPQGKNLHEADKVEAGQFSFTAYENGSYVACITAIDYKPETTLTIDFDWKTGVHSKEWTNVAKKSQVDMMEYQVKTLMDTVISIHEEMYYLREREEEMQELNRSTNSKMAWLSFGSLVVCLSVAGLQFWHLKTFFEKKKLI

SEQ ID NO: 9581 - protein, 463 aa, Arabidopsis thaliana
MEKQNIISNTSSSSSSWIRGSCVGRGCFGTVSKALSKIDGGLFAVKSIDLATCLPSQAESLENEIVILRSMKSHPNIVRFLGDDVSKEGTASFRNLHLEYSPEGDVANGGIVNETLLRRYVWCLVSALSHVHSNGIVHCDVKSKNVLVFNGGSSVKLADFGSAVEFEKSTIHVSPRGSPLWMAPEVVRREYQGPESDVWSLGCTVIEMLTGKPAWEDHGFDSLSRIGFSNDLPFIPVGLSELGRDFLEKCLKRDRSQRWSCDQLLQHPFLCQDHHDSFFTESSPRCVLDWVNSEFDEEEESDEWRPESMVSAMARISKLAITGGANWESNGWTEVRDTSEESEAKKEVLVSPRVELESYISLESSSDDSVRQPRNEESATELASAVTCEAILLVMILVVENIQIYATFYTSSIIMHILYCCSCCCYYHYQNNNKKNNFSKSTSFILSLNFLFGIACDSDRSIY

SEQ ID NO: 9582 - protein, 258 aa, Arabidopsis thaliana
MGRGKVELKRIENKINRQVTFAKRRNGLLKKAYELSVLCDAEIALLIFSNRGKLYEFCSSPSGMARTVDKYRKHSYATMDPNQSAKDLQDKYQDYLKLKSRVEILQHSQRHLLGEELSEMDVNELEHLERQVDASLRQIRSTKARSMLDQLSDLKTKEEMLLETNRDLRRKLEDSDAALTQSFWGSSAAEQQQQHQQQQQGMSSYQSNPPIQEAGFFKPLQGNVALQMSSHYNHNPANATNSATTSQNVNGFFPGWMV

SEQ ID NO: 9583 - protein, 570 aa, Arabidopsis thaliana
MESFRRFSLLSFIALLAYFAFLASAEHHVHQFVITPTPVKRLCRTHQSITVNGQYPGPTLVVRNGDSLAITVINRARYNISIHWHGIRQLRNPWADGPEYITQCPIRPGQTYTYRFKIEDQEGTLWWHAHSRWLRATVYGALIIYPRLGSPYPFSMPKRDIPILLGEWWDRNPMDVLKQAQFTGAAANVSDAYTINGQPGDLYRCSRAGTIRFPIFPGETVQLRVINAGMNQELFFSVANHQFTVVETDSAYTKPFTTNVIMIGPGQTTNVLLTANQRPGRYYMAARAYNSANAPFDNTTTTAILQYVNAPTRRGRGRGQIAPVFPVLPGFNDTATATAFTNRLRYWKRAPVPQQVDENLFFTVGLGLINCANPNSPRCQGPNGTRFAASMNNMSFVLPRSNSVMQAYYQGTPGIFTTDFPPVPPVQFDYTGNVSRGLWQPIKGTKAYKLKYKSNVQIVLQDTSIVTPENHPMHLHGYQFYVVGSGFGNFNPRTDPARFNLFDPPERNTIGTPPGGWVAIRFVADNPGAWFMHCHIDSHLGWGLAMVFLVENGRGQLQSVQAPPLDLPRC

SEQ ID NO: 9584 - protein, 432 aa, Arabidopsis thaliana
MALRPCTGFTISSLRNASAANNNLFSLLSFSSSSPAKRNLLLSSLQDNLRRFASSASLYRQHLRNQQQQHQQQQQSRVKEKSETLAQKIGKSIRRAGAPSKARVYADVNVVRPKDYWDYESLAVQWGVQDDYEVVRKVGRGKYSEVFEGIHATDNEKCVIKILKPVKKKKIKREIKILQNLCGGPNIVKLLDIVRDQQSKTPSLIFEHVNNKDFKVLYPTLSDYDVRYYIFELLKALDFCHSRGIMHRDVKPHNVMIDHEQRKLRLIDWGLAEFYHPGKEYNVRVASRYFKGPELLVDLQDYDYSLDLWSLGCMFAGMIFRKEPFFYGHDNYDQLVKIAKVLGTDELNAYLNKYRIELDPNLTSLVGRHSRKPWTKFINSENQHLAVPEAVDFVDKLLRYDHQERPTAKEAMAHPYFYPIRNAESSRTPRSQ

SEQ ID NO: 9585 - protein, 333 aa, Arabidopsis thaliana
MSKARVYTDVNVVRPKEYWDYESLVVQWGHQDDYEVVRKVGRGKYSEVFEGKNVNTNERCVIKILKPVKKKKIKREIKILQNLCGGPNIVKLYDIVRDEHSKTPSLVFEFVNSVDFKVLYPTLTDYDIRYYIYELLKALDFCHSQGIMHRDVKPHNVMIDHQLRKLRLIDWGLAEFYHPGKEYNVRVASRYFKGPELLVDLQDYDYSLDMWSLGCMFAGMIFRKEPFFYGHDNHDQLVKIAKVLGTNELDHYLNKYQLDLDPQLEALVGRHVPKPWSKFINADNQHLVSPEAIDFLDKLLQYDHQDRLTAREAMDHPYFAQVKAAESSRLRTQ

SEQ ID NO: 9586 - protein, 595 aa, Arabidopsis thaliana
MTVDSALRSPMMHSPSTKDVKALRFIEEMTRNVDFVQKKVIREILSRNSDTEYLKRFGLKGFTDRKTFKTKVPVVIYDDLKPEIQRIANGDRSMILSSYPITEFLTSSGTSAGERKLMPTIDEDMDRRQLLYSLLMPVMNLYVPGLDKGKALYFLFVKTESKTPGGLPARPVLTSYYKSEQFKRRPNDPYNVYTSPNEAILCPDSSQSMYTQMLCGLLMRHEVLRLGAVFASGLLRAIGFLQTNWKELADDISTGTLSSRISDPAIKESMSKILTKPDQELADFITSVCGQDNSWEGIITKIWPNTKYLDVIVTGAMAQYIPMLEYYSGGLPMACTMYASSESYFGINLKPMCKPSEVSYTIMPNMAYFEFLPHHEVPTEKSELVELADVEVGKEYELVITTYAGLNRYRVGDILQVTGFYNSAPQFKFVRRKNVLLSIESDKTDEAELQSAVENASLLLGEQGTRVIEYTSYAETKTIPGHYVIYWELLVKDQTNPPNDEVMARCCLEMEESLNSVYRQSRVADKSIGPLEIRVVKNGTFEELMDYAISRGASINQYKVPRCVSFTPIMELLDSRVVSTHFSPALPHWSPERRR

SEQ ID NO: 9587 - protein, 309 aa, Arabidopsis thaliana
MSGSTRKEMDRIKGPWSPEEDDLLQSLVQKHGPRNWSLISKSIPGRSGKSCRLRWCNQLSPEVEHRGFTAEEDDTIILAHARFGNKWATIARLLNGRTDNAIKNHWNSTLKRKCSGGGGGGEEGQSCDFGGNGGYDGNLTDEKPLKRRASGGGGVVVVTALSPTGSDVSEQSQSSGSVLPVSSSCHVFKPTARAGGVVIESSSPEEEEKDPMTCLRLSLPWVNESTTPPELFPVKREEEEEKEREISGLGGDFMTVVQEMIKTEVRSYMADLQLGNGGGAGGGASSCMVQGTNGRNVGFREFIGLGRIE

SEQ ID NO: 9588 - protein, 902 aa, Arabidopsis thaliana
MASEASPSSSATRSEPPKDSPAEERGPASKEVSEVIESLKKKLAADRCISIKKRIDENKKNLFAITQSFMRSSMERGGSCKDGSDLLVKRQRDSPGMKSGIDESNNNRYVEDGPASSGMVQGSSVPVKISLRPIKMPDIKRLSPYTTWVFLDRNQRMTEDQSVVGRRRIYYDQTGGEALICSDSEEEAIDDEEEKRDFLEPEDYIIRMTLEQLGLSDSVLAELASFLSRSTSEIKARHGVLMKEKEVSESGDNQAESSLLNKDMEGALDSFDNLFCRRCLVFDCRLHGCSQDLIFPAEKPAPWCPPVDENLTCGANCYKTLLKSGRFPGYGTIEGKTGTSSDGAGTKTTPTKFSSKLNGRKPKTFPSESASSNEKCALETSDSENGLQQDTNSDKVSSSPKVKGSGRRVGRKRNKNRVAERVPRKTQKRQKKTEASDSDSIASGSCSPSDAKHKDNEDATSSSQKHVKSGNSGKSRKNGTPAEVSNNSVKDDVPVCQSNEVASELDAPGSDESLRKEEFMGETVSRGRLATNKLWRPLEKSLFDKGVEIFGMNSCLIARNLLSGFKSCWEVFQYMTCSENKASFFGGDGLNPDGSSKFDINGNMVNNQVRRRSRFLRRRGKVRRLKYTWKSAAYHSIRKRITEKKDQPCRQFNPCNCKIACGKECPCLLNGTCCEKYCGCPKSCKNRFRGCHCAKSQCRSRQCPCFAADRECDPDVCRNCWVIGGDGSLGVPSQRGDNYECRNMKLLLKQQQRVLLGISDVSGWGAFLKNSVSKHEYLGEYTGELISHKEADKRGKIYDRENCSFLFNLNDQFVLDAYRKGDKLKFANHSPEPNCYAKVIMVAGDHRVGIFAKERILAGEELFYDYRYEPDRAPAWAKKPEAPGSKKDENVTPSVGRPKKLA

SEQ ID NO: 9589 - protein, 444 aa, Arabidopsis thaliana
MATITVVKARQIFDSRGNPTVEVDIHTSNGIKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 9590 - protein, 737 aa, Arabidopsis thaliana
MNAKDVISRLPDEVLGRILSLISTKEAVSTSVLSKRWKNMFVLVSNLDIDDRQSVPKTKQNRIEIHRNYMAFVDKLLDTQRGSSIKKLTLKSHVGVRGGTDSSRIQSWICNVLDHGVMDLDVFITLKGKSPPVPAMIFKSKTLVKLRVGRGFTIKLSQDVSLPLLRTLCLDSVNFVGGHNVVGTLISRCPVLEELVVEERRCVDWTCSVSSPSLKRLHIRFDRKFTSISLDAPNLIYYKHSGYVLGKYPNVKLDSLIEARLNLRMDETRMVGVRNGSLGSIPADMRNLINGIRNVRILHLSSHTLELLYFSCKEMPLFDSLVSLSIGNDKARGWQMLPLLIKNSPNLETLIFMGLDHYITNRCGDVCVCYDTDESITSCLSSSQVKVLEILSYQGTTRELNQMKHFLEKLPCLELVKICVVNNSNNLQTTMEMRNLMMLPRASSKYRERERPFQQLPNYLLLRCFETLVTSRERESKQTHTKDRSELRTTMQKQEFLELYEAALRAAKSVKGVKNSSKVSRFVDARNRLKDAPTSLACEVVSKTSMGKGLSFLNDHKNPHIRSEGRLLRDLWMKILYASGREKSHDRETQVKIPTHSTMKKTGDSKRDKVREILQTSLVKVASEIVDTEMKTRVTACDPSVVAVSVESAMFEKLGCFMGPHKAKYRSILFNMGDSNNPDLRRKVLIGEINGERLVTMERQEMGSEKIQKEVQRIKENARFKEESRMKILQSASMIMT

SEQ ID NO: 9591 - protein, 162 aa, Arabidopsis thaliana
MGLSSLPGPSEGMLCVILVNTALSISIVKGIVRSFLGIVGISLSPSSSSPSSVTVSSENSSTSESFDFRVCQPESYLEEFRNRTPTLRFESLCRCKKQADNECSVCLSKFQGDSEINKLKCGHLFHKTCLEKWIDYWNITCPLCRTPLVVVPEDHQLSSNVW

SEQ ID NO: 9592 - protein, 393 aa, Arabidopsis thaliana
METSIACYSRGILPPSVSSQRSSTLVSPPSYSTSSSFKRLKSSSIFGDSLRLAPKSQLKATKAKSNGASTVTKCEIGQSLEEFLAQATPDKGLRTLLMCMGEALRTIAFKVRTASCGGTACVNSFGDEQLAVDMLADKLLFEALQYSHVCKYACSEEVPELQDMGGPVEGGFSVAFDPLDGSSIVDTNFTVGTIFGVWPGDKLTGITGGDQVAAAMGIYGPRTTYVLAVKGFPGTHEFLLLDEGKWQHVKETTEIAEGKMFSPGNLRATFDNSEYSKLIDYYVKEKYTLRYTGGMVPDVNQIIVKEKGIFTNVTSPTAKAKLRLLFEVAPLGLLIENAGGFSSDGHKSVLDKTIINLDDRTQVAYGSKNEIIRFEETLYGTSRLKNVPIGVTA

SEQ ID NO: 9593 - protein, 269 aa, Arabidopsis thaliana
MEGCPRNREIGPKLLDLIPQGRKWYQEDKNNTDQEKKLELRLGPPGGDEEDHSAIKKKNTEIRNIKKETEDKSFHCFNGNHFSPSNKTTSVPHISQKRTAPGPVVGWPPVRSFRKNLASTSSSKLGNESSHGGQINKSDDGEKQVETKKEGMFVKINMDGVPIGRKVDLNAYNSYEQLSFVVDKLFRGLLAAQRDISDGQGEEKPIIGLLDGKGEFTLTYEDNEGDKMLVGDVPWQMFVSSVKRLRVIKSSEISSALTFGCSKQEKMMH

SEQ ID NO: 9594 - protein, 326 aa, Arabidopsis thaliana
MDYSKTEETPINEEQGSTNSSESRSNEELFSDCDQQHSSIANEFGLTELPKDDKVYELIYRHCQSKLTSHLSNQFEIVSILKNGFQTPLGQAKLKAFQIYAESVAKKSGSCCGNKAAVAEAARVKYGCCGVEKEELKAILMYGFSNNALCLSPDNAPLQCMIDPSSSCNEDGISFLLFSRIIMGKSEVVCSTSQSYPSSMEFDSGVDSLTSPNKYIIWSTHMNTHVLPEFVVCIKTPSILKRIADLVCLFDIENPKSPWISFPVLINSISKFLNQSQIRLIHKHYKEHQDRRISRCELIQRLRSITGDSLLVQIIKSVGQKVHKDT

SEQ ID NO: 9595 - protein, 355 aa, Arabidopsis thaliana
MSSHARGKELIPLLSFSHQKKQPNLSISSTTKMNKKNPDQKSDMSSSSSSPKKQTLFISSLIILWYTSNIGVLLLNKFLLSNYGFKFPIFLTMCHMSACAILSYVSIVFLKLVPLQYLKSRSQFLKVATLSIVFCASVVGGNISLRYLPVSFNQAVGATTPFFTALFAYIMTFKREAWVTYGALVPVVTGVVIASGGEPGFHWFGFIMCISATAARAFKSVLQGILLSSEGERLNSMNLMLYMSPIAVIALLPVTIFMEPDVMSVTLTLGRQHKYMYILLLVNSVMAYSANLLNFLVTKHTSALTLQVLGNAKGAVAVVISILLFRNPVTVMGIGGYSITVLGVVAYGETKRRFR

SEQ ID NO: 9596 - protein, 158 aa, Arabidopsis thaliana
MGEIGFTEKQEALVKESWEILKQDIPKYSLHFFSQILEIAPAAKGLFSFLRDSDEVPHNNPKLKAHAVKVFKMTCETAIQLREEGKVVVADTTLQYLGSIHLKSGVIDPHFEVVKEALLRTLKEGLGEKYNEEVEGAWSQAYDHLALAIKTEMKQEES

SEQ ID NO: 9597 - protein, 503 aa, Arabidopsis thaliana
MAITVPRRQLFIGGQWTEPVLRKTLPVVNPATEDIIGYIPAATSEDVELAVEAARKAFTRNNGKDWARATGAVRAKYLRAIAAKVIERKSELANLEAIDCGKPLDEAAWDMDDVAGCFEYYADLAEGLDAKQKTPLSLPMDTFKGYILKEPIGVVGMITPWNYPLLMAVWKVAPSLAAGCTAILKPSELASLTCLELADICREVGLPPGVLNILTGLGTEAGAPLASHPHVDKIVFTGSTTTGSSIMTSAAKLVKPVSLELGGKSPIIVFDDVDIDKAVEWTMFGCFWTNGQICSATSRLLVHERIADEFLDKLVKWTKNIKISDPFEEGCRLGPVVSKGQYERVLKFVSNARNEGATVLCGGVRPEHLKKGYFVEPAIVSNVTTSMEIWREEVFGPALCVKTFSTEDEAIQLANDSQYGLAGAVLSNDLERCDRVSKAFQAGIVWVNCSQPCFCQAPWGGTKRSGFGRELGEWGLENYLSVKQVTQYISDEPWGWYKPPSKL

SEQ ID NO: 9598 - protein, 451 aa, Arabidopsis thaliana
MTTALFSPSNRRKRRLTHFFFTVLAFILLAAFIYGHDFISFSRRSLHSPTIVHQSAIVVVVDEPPPPPPTSPPPPSPPPPSPPPPSPPPPSPPPPAFAVGKTPEGCDVFKGNWVKDWSTRPLYRESECPYIQPQLTCRTHGRPDSDYQSWRWRPDSCSLPSFNATVMLESLRGKKMMFVGDSLNRGMYVSLICLLHSQIPENSKSMDTFGSLTVFSLKDYNATIEFYWAPFLLESNSDNATVHRVSDRIVRKGSINKHGRHWRGADIVVFNTYLWWRTGFKMKILEGSFKDEKKRIVEMESEDAYRMALKTMVKWVKKNMDPLKTRVFFATMSPTHYKGEDWGGEQGKNCYNQTTPIQDMNHWPSDCSKTLMKVIGEELDQRAEFPVTVLNITQLSGYRKDAHTSIYKKQWSPLTKEQLANPASYSDCIHWCLPGLQDTWNELFFAKLFYP

SEQ ID NO: 9599 - protein, 469 aa, Arabidopsis thaliana
MAATTENLPQLKSAVDGLTEMSESEKSGFISLVSRYLSGEAQHIEWSKIQTPTDEIVVPYEKMTPVSQDVAETKNLLDKLVVLKLNGGLGTTMGCTGPKSVIEVRDGLTFLDLIVIQIENLNNKYGCKVPLVLMNSFNTHDDTHKIVEKYTNSNVDIHTFNQSKYPRVVADEFVPWPSKGKTDKEGWYPPGHGDVFPALMNSGKLDTFLSQGKEYVFVANSDNLGAIVDLTILKHLIQNKNEYCMEVTPKTLADVKGGTLISYEGKVQLLEIAQVPDEHVNEFKSIEKFKIFNTNNLWVNLKAIKKLVEADALKMEIIPNPKEVDGVKVLQLETAAGAAIRFFDNAIGVNVPRSRFLPVKASSDLLLVQSDLYTLVDGFVTRNKARTNPSNPSIELGPEFKKVATFLSRFKSIPSIVELDSLKVSGDVWFGSSIVLKGKVTVAAKSGVKLEIPDRAVVENKNINGPEDL

SEQ ID NO: 9600 - protein, 263 aa, Arabidopsis thaliana
MLSIPDTRMWNLASSYLTGNIGPKNDIRRPVHAHAECSDDDVSSVGSKDEGLECPICWESFNIVENVPYVLWCGHTMCKNCILGLQWAIVKLPTHPVQLPLFISCPWCNLLSFRLVFRGTLRFPHKNYFVLWMVERMNGERRNSPGGAQTDGNNDHTRETPSPCLHNRHHRSQPEPSRSVNDHRIPRDNIQTSLRKSLVFFVQLTAKFPLVVIFLLIILYAIPTSAAILAMYILVTLLLALPSFLILYFAYPCLDWLVREIVT

SEQ ID NO: 9601 - protein, 156 aa, Arabidopsis thaliana
MDALIAQLQRQFRDYTISLYQQGFLDDQFTELKKLQDDGSPDFVSEVLSLFFEDCVKLISNMARALDTTGTVDFSQVGASVHQLKGSSSSVGAKRVKTLCVSFKECCEAKNYEGCVRCLQQVDIEYKALKTKLQDMFNLEKQIIQAGGIVPQVDIN

SEQ ID NO: 9602 - protein, 219 aa, Arabidopsis thaliana
MAMKLYGDEMSACVARVLLCLHEKNTEFELVPVNLFACHHKLPSFLSMNPFGKVPALQDDDLTLFESRAITAYIAEKHRDKGTDLTRHEDPKEAAIVKLWSEVEAHHFNPAISAVIHQLIVVPLQGESPNAAIVEENLENLGKILDVYEERLGKTKYLAGDTYTLADLHHVPYTYYFMKTIHAGLINDRPNVKAWWEDLCSRPAFLKVSPGLTVAPTTN

SEQ ID NO: 9603 - protein, 406 aa, Arabidopsis thaliana
MDPSFRFIKEEFPAGFSDSPSPPSSSSYLYSSSMAEAAINDPTTLSYPQPLEGLHESGPPPFLTKTYDLVEDSRTNHVVSWSKSNNSFIVWDPQAFSVTLLPRFFKHNNFSSFVRQLNTYGFRKVNPDRWEFANEGFLRGQKHLLKNIRRRKTSNNSNQMQQPQSSEQQSLDNFCIEVGRYGLDGEMDSLRRDKQVLMMELVRLRQQQQSTKMYLTLIEEKLKKTESKQKQMMSFLARAMQNPDFIQQLVEQKEKRKEIEEAISKKRQRPIDQGKRNVEDYGDESGYGNDVAASSSALIGMSQEYTYGNMSEFEMSELDKLAMHIQGLGDNSSAREEVLNVEKGNDEEEVEDQQQGYHKENNEIYGEGFWEDLLNEGQNFDFEGDQENVDVLIQQLGYLGSSSHTN

SEQ ID NO: 9604 - protein, 243 aa, Arabidopsis thaliana
MIGQLMNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWEMFVESCKRLRIMKGSEAVGLAPRAMEKYCKNRS

SEQ ID NO: 9605 - protein, 377 aa, Arabidopsis thaliana
MGLKMSESAKPYFAMVCLQFGYAGMNLVTKVVLDRGMSHYVLVAYRNAFATAAIAPFALLSERKVRPKMTFPIFMQIFVLALLGPLIDQNLYYAGLKLTSPTFAGAVTNIVPALTFIISIICRMEKVEMRKVRFQAKVVGTLVIVVGAMLMILFKIPLITFLRSHLTGHALSPAGEDYLKATVFLLIASFSWASFFVLQAATLKRYSSHLSLSTMVCFMGTLQSTALTFVMEPNLSAWNIGFDMNLLASAYAGIMSSSIAYYVQGMMTKQKSVIFVTAFNPLVVIIGSIIGFLILNQTLNLGGVLGMAILVVGVCTVLWGKEGDIDEEENIEEKFVEIVKCCNRCDIKVLSMMPRIDEEVDVEMQSAGTAKVAVGFS

SEQ ID NO: 9606 - protein, 577 aa, Arabidopsis thaliana
MGLCHGKPIEQQSKNLPISNEIEETPKNSSQKAKSSGFPFYSPSPLPSLFKTSPAVSSSSVSSTPLRIFKRPFPPPSPAKHIRALLARRHGSVKPNEASIPEGSECEVGLDKKFGFSKQFASHYEIDGEVGRGHFGYTCSAKGKKGSLKGQDVAVKVIPKSKMTTAIAIEDVRREVKILRALTGHKNLVQFYDAFEDDENVYIVMELCQGGELLDKILQRGGKYSEVDAKKVMIQILSVVAYCHLQGVVHRDLKPENFLFTTKDESSPLKAIDFGLSDYVRPDERLNDIVGSAYYVAPEVLHRTYGTEADMWSIGVIAYILLCGSRPFWARSESGIFRAVLKAEPNFEEAPWPSLSPDAVDFVKRLLNKDYRKRLTAAQALCHPWLVGSHELKIPSDMIIYKLVKVYIMSSSLRKSALAALAKTLTVPQLTYLQEQFNLLGPSKNGYISMQNYKTAILKSSTEATKDSRVLDFVHMISCLQYKKLDFEEFCASALSVYQLEAMETWEQHARRAYELYEKDGNRVIMIEELATELGLGPSVPVHVVLQDWIRHSDGKLSFLGFVRLLHGVSSRTLQKA

SEQ ID NO: 9607 - protein, 309 aa, Arabidopsis thaliana
MEEEYESRRLRRWEELDTDILVRIFQKFSVFELTSGLAHVCRGWRAACCDPILWKTVDLSNMRSSFIKIPLEPYVYVERRSDEALTRILKLSMNLSGGSTRTLIFHFNLFLSDDQLTYTAERCPGLRRVVLPAWNRIKKTGICKAIRIWKDLESLTMPSIANPPYLLTEIAKNCKNFKELKIMGPFEVFFANTLITCLPNIKTLSIRCSAIKREALMKILDGLPSLEVLNISHSHLVEYSGWQPQQKVIVRELDKTIMEKTARLKKFLTCMDHKTCVMCQRTENDEGIVRWYKYEEGDWKVDEVSSLHL

SEQ ID NO: 9608 - protein, 175 aa, Arabidopsis thaliana
MTLEEQKKVIMPEAVASEPSPPSKEEKSDDSKAIVLVVAAKEPTEDKKVGSVHRDAVLVRLEQDKRISLIKAWEEAEKSKVENKAQKKISSVGAWENSKKASVEAELKKIEEQLNKKKAHYTEQMKNKIAQIHKEAEEKRAMTEAKRGEDVLKAEEMAAKYRATGTAPTKLFGFF

SEQ ID NO: 9609 - protein, 115 aa, Arabidopsis thaliana
MASLNSDVIMGESSSISVPSSSSKNSKRFELKKWSAVALWAWDIVVDNCAICRNHIMDLCIECLANQASATSEECTVAWGVCNHAFHFHCISRWLKTRQVCPLDVCEWEFQKYGH

SEQ ID NO: 9610 - protein, 438 aa, Arabidopsis thaliana
MTLASDFGFPSAISSSFTILEERYHNNFPNTLCVSSGQESMNNNPVPCQVFPLVSGGSSGGNLFSSSSGFCNGVYVSSSSQARPSVSTVPRDRITVAHVSGEGQRQECPVETHSLQLINQPQEQKIMTWSSDQIRGFFDFPVPDPQAASSRTMVSSKEVLSKCEWPDWADQLISDDSLEPNWSELLGDPNVLNLYSKVQTQSSDIARQEIVFRNQHQVDPSMEPFNAKSPPASSMTSKQRMRWTPELHEAFVEAINQLGGSERATPKAVLKLINSPGLTVYHVKSHLQKYRTARYKPELSKDTVKNLKTIEDIKSLDLKTSIEITEALRLQMKVQKQLHEQLEIQRSLQLQIEEQGRYLQMMIEKQQKMQENKKDSTSSSSMPEADPSAPSPNLSQPFLHKATNSEPSITQKLQNGSSTMDQSESTSGTSNRKRVRED

SEQ ID NO: 9611 - protein, 236 aa, Arabidopsis thaliana
MINFEATELRLGLPGGNHGGEMAGKNNGKRGFSETVDLKLNLSSTAMDSVSKVDLENMKEKVVKPPAKAQVVGWPPVRSFRKNVMSGQKPTTGDATEGNDKTSGSSGATSSASACATVAYVKVSMDGAPYLRKIDLKLYKTYQDLSNALSKMFSSFTIGNYGPQGMKDFMNESKLIDLLNGSDYVPTYEDKDGDWMLVGDVPWEMFVDSCKRIRIMKGSEAIGLAPRALEKCKNRS

SEQ ID NO: 9612 - protein, 345 aa, Arabidopsis thaliana
MSGLLDGIPEAVALRCLAHVPLHLHPNLELVSRSWRAAIRSHELFRVRKELRSSEHLLCVCAFDPENIWQVYSPNCDRWLTLPLLPSRIRHLAHFGAVTTAGMLFVLGGGSDAVSPVTGDHDGTFATDQVWSYDFVQRQWTPRASMLVPRAMFACCVLQGKIVVAGGFTTCRKSISGAEMYDPENDVWTSIPDLHQTHNSACSGLVVNGKVHVLHKGLSTVQVLESVKLGWDVKDYGWPQGPMVVVEDVLYVMSHGLVFKQEGDTWKMVASASEFKRRIGMAMTSLSDEVLIVGGVIGPDRLNWDIKPLSDVDALTVGNDRPAWRSVAPMTRCRGTILGCTQLTI

SEQ ID NO: 9613 - protein, 333 aa, Arabidopsis thaliana
MTGNSFNSMKDFLKQTGGYAVIDGGLATEFERHGADLNDPLWSAKCLVTSPHLIHTVHLDYLEAGADIISSASYQATIQGFEAKGFSREESESLLKKSVEIATEARNSYYDKCGTSSSMDDKILKKRPILVAASVGSYGAYLADGSEYSGIYGDSITLEKLKDFHRRRLQVLAESGADLIAFETIPNKIEAQAFADLLEEGDVKIPGWFSFNSKDGVNVVSGDSIKECISIAENCEKVVAVGINCTPPRFIEGLVLEIEKVTSKPILVYPNSGESYDADRKEWVENTGVGDEDFVSYVEKWMDAGVSLLGGCCRTTPTTIRAIHKRLVNRRSL

SEQ ID NO: 9614 - protein, 128 aa, Arabidopsis thaliana
MKYRGVRKRPWGKYAAEIRDSARHGARVWLGTFNTAEDAARAYDRAAFGMRGQRAILNFPHEYQMMKDGPNGSHENAVASSSSGYRGGGGGDDGREVIEFEYLDDSLLEELLDYGERSNQDNCNDANR

SEQ ID NO: 9615 - protein, 122 aa, Arabidopsis thaliana
MESSNRSSNNQSQDDKQARFRGVRRRPWGKFAAEIRDPSRNGARLWLGTFETAEEAARAYDRAAFNLRGHLAILNFPNEYYPRMDDYSLRPPYASSSSEVFEFEYLDDKVLEELLDSEERKR

SEQ ID NO: 9616 - protein, 480 aa, Arabidopsis thaliana
MEAAMNNHDGDCCKSGPGYATPLLAMSGPREKLIYVAAIYTGTGQAKPDYLATVDVEPSSSTYSSVIHRLPMPYLEDELHHSGWNSCSSCYGDSSCERRYLILPSLLSGRIYVIDTKTNPREPSLHKFVDPAEVLEKTGLAYPHQPHCLASGDVLVSCLGDEDGNAEGSGFLLLDSEFNIKGRWEKDGNSPLYGYDFWYQPRHKTMISTSWGAPAAFTKGFDLKDVSDGLYGKHLHVYSWPQGELKQILDLGDTGLLPLEVRFLHEPDKATGFAGCALSSTLVRFFKNDDETWSHEVAISVEPLKVENWILPEMPGLITDFLISLDDRFLYCSNWLHGDIRQYNIEDPKTPVLTGQIHVGGLVQKGSLVLALGEEGKAFQFDVPKIKGQRLRGGPQMFQLSLDGKRLYVTNSLFSVWDRQFYPELVEKGSHMLQIDVDTDKGGLSINPNFFVDFGTEPDGPSLAHEMRYPGGDCTSDIWV

SEQ ID NO: 9617 - protein, 485 aa, Arabidopsis thaliana
MALLVEKTSSGREYKVKDMSQADFGRLEIELAEVEMPGLVSCVTEFGPSQPLKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKNGTFPDPTSTDNPEFQIVLSIIKDGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMLGLETYPGVKRITIKPQTDRWVFPDTNSGIIVLAEGRLMNLGCATGHPSFVMSCSFTNQVIAQLELWNEKSSGKYEKKVYVLPKHLDEKVAALHLGKLGARLTKLTKDQSDYVSIPVEGPYKPVHYRY

SEQ ID NO: 9618 - protein, 209 aa, Arabidopsis thaliana
MENGKRDRQDMEVNTTPRKPRVLLAASGSVAAIKFGNLCHCFTEWAEVRAVVTKSSLHFLDKLSLPQEVTLYTDEDEWSSWNKIGDPVLHIELRRWADVLVIAPLSANTLGKIAGGLCDNLLTCIIRAWDYTKPLFVAPAMNTLMWNNPFTERHLLSLDELGITLIPPIKKRLACGDYGNGAMAEPSLIYSTVRLFWESQAHQQTGGTS

SEQ ID NO: 9619 - protein, 326 aa, Arabidopsis thaliana
MAEGLVLKGIMRAHTDIVTAIATPIDNSDIIVTASRDKSIILWKLTKDDKSYGVAQRRLTGHSHFVEDVVLSSDGQFALSGSWDGELRLWDLATGETTRRFVGHTKDVLSVAFSTDNRQIVSASRDRTIKLWNTLGECKYTISEGDGHKEWVSCVRFSPNTLVPTIVSASWDKTVKVWNLQNCKLRNSLVGHSGYLNTVAVSPDGSLCASGGKDGVILLWDLAEGKKLYSLEAGSIIHSLCFSPNRYWLCAATENSIRIWDLESKSVVEDLKVDLKSEAEKNEGGVGTGNQKKVIYCTSLNWSADGSTLFSGYTDGVVRVWGIGRY

SEQ ID NO: 9620 - protein, 301 aa, Arabidopsis thaliana
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDSAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGEGRRGEFMTVVQEMIKAEVRSYMAEMQKTSGGFVVGGLYESGGNGGFRDCGVITPKVE

SEQ ID NO: 9621 - protein, 323 aa, Arabidopsis thaliana
MVKATKAEKKIAYDTKLCQLIDEYTQILVVAADNVGSTQLQNIRKGLRGDSVVLMGKNTMMKRSVRIHSENSGNTAILNLLPLLQGNVGLIFTKGDLKEVSEEVAKYKVGAPARVGLVAPIDVVVQPGNTGLDPSQTSFFQVLNIPTKINKGTVEIITPVELIKQGDKVGSSEAALLAKLGIRPFSYGLVVQSVYDNGSVFSPEVLDLTEDQLVEKFASGISMVTSLALAVSYPTLAAAPHMFINAYKNALAIAVATDYTFPQAEKVKEFLKDPSKFVVAAAAVSADAGGGSAQAGAAAKVEEKKEESDEEDYEGGFGLFDEE

SEQ ID NO: 9622 - protein, 344 aa, Arabidopsis thaliana
MKIAANGRFFTIGLVASWYSSNIGVLLLNKYLLSNYGFKYPIFLTMCHMTACSLLSYVAIAWMKMVPMQTIRSRVQFLKIAALSLVFCVSVVFGNISLRFLPVSFNQAIGATTPFFTAVFAYLITFKREAWLTYFTLVPVVTGVVIASGKHPWDLPELDHFMICSLYAAQIRLEVVLLCVHSVNPSEPSFHLFGFIMCIAATAARALKSVLQGILLSSEGEKLNSMNLLLYMAPIAVVFLLPATLIMEKNVVGITIALARDDFRIVWYLLFNSALAYFVNLTNFLVTKHTSALTLQVLGNAKGAVAVVVSILIFRNPVSVTGMLGYSLTVCGVILYSEAKKRSK

SEQ ID NO: 9623 - protein, 601 aa, Arabidopsis thaliana
MGLCTSKPNSSNSDQTPARNSPLPASESVKPSSSSVNGEDQCVTTTNNEGKKSPFFPFYSPSPAHYFFSKKTPARSPATNSTNSTPKRFFKRPFPPPSPAKHIRAVLARRHGSVKPNSSAIPEGSEAEGGGVGLDKSFGFSKSFASKYELGDEVGRGHFGYTCAAKFKKGDNKGQQVAVKVIPKAKMTTAIAIEDVRREVKILRALSGHNNLPHFYDAYEDHDNVYIVMELCEGGELLDRILSRGGKYTEEDAKTVMIQILNVVAFCHLQGVVHRDLKPENFLFTSKEDTSQLKAIDFGLSDYVRPDERLNDIVGSAYYVAPEVLHRSYSTEADIWSVGVIVYILLCGSRPFWARTESGIFRAVLKADPSFDDPPWPLLSSEARDFVKRLLNKDPRKRLTAAQALSHPWIKDSNDAKVPMDILVFKLMRAYLRSSSLRKAALRALSKTLTVDELFYLREQFALLEPSKNGTISLENIKSALMKMATDAMKDSRIPEFLGQLSALQYRRMDFEEFCAAALSVHQLEALDRWEQHARCAYELFEKEGNRPIMIDELASELGLGPSVPVHAVLHDWLRHTDGKLSFLGFVKLLHGVSSRTIKAH

SEQ ID NO: 9624 - protein, 546 aa, Arabidopsis thaliana
MTMFASLTSKMLSVSTSDHASVVSLNLFVALLCACIVIGHLLEENRWMNESITALLIGLGTGVVILLISRGKNSHLLVFSEDLFFIYLLPPIIFNAGFQVKKKQFFRNFVTIMAFGAIGTVVSCTIISLGAIQFFKKLDIGTFDLGDFLAIGAIFAATDSVCTLQVLNQDETPLLYSLVFGEGVVNDATSVVLFNAIQSFDLTHLNHEAAFQFLGNFFYLFLLSTGLGVATGLISAYVIKKLYFGRHSTDREVALMMLMAYLSYMLAELFALSGILTVFFCGIVMSHYTWHNVTESSRITTKHAFATLSFLAETFIFLYVGMDALDIEKWRFVSDSPGTSVAVSSILMGLVMLGRAAFVFPLSFLSNLAKKHQSEKISIKQQVVIWWAGLMRGAVSMALAYNKFTRSGHTELRGNAIMITSTITVCLFSTMVFGMLTKPLIRYLMPHQKATTSTTSMLSDDSTPKSIHIPLLDGEQLDSFELPGSHQDVPRPNSLRGFLMRPTRTVHYYWRQFDDAFMRPVFGGRGFVPFVPGSPTERSSHDLSKP

SEQ ID NO: 9625 - protein, 554 aa, Arabidopsis thaliana
MWLLAISLVGLLVVVVCVFLRFSKDKGLDGIVNEKKRDKNSAPRVSASGEDGTKNEQVEKKSDPSGGLGEENEKTNSESKVLSVPSDQNINKTLPVMLPSLELRKYDENETPGKVVNRRLLVSTNEMKYGRNGYEVFQGVYGRRSSVAVKCLDLAHTTEAFIQNEIDNHCLCDDHSNIIRFHGLEQDQSFAYICLEPWKCSLDDLIKLSVRRTKRDTQAVAPVDDLEKVMKRIKFWKEKGKPLPLTPMLKLMRDVVCGLAHLHKLKTIHRNLNPQNVLIIVKDMTLTAKISDMSLSKHLGGKKSSYKHLATCSGSSGWQAPEQLNKDKKKKEDFPADMFNFGCLLHYAVMGTHPFGSPSERDTNIKTNNKTNLSLVTNLEAINLIEQLLNYKPDLRPSATQVLLHPLFWDSEKRLFFLREASDRIELDITMWGDLNKTIAPRVLGESKDWASKLGKTFITHIENLAQAQPGQESRQYNRSYKYWSLRHLLRLIRNILSHHREILDDPKIKEMVGKVPEGLDIFFTARFPNLMMEIYAFISMHCKGEEAFEKYFN

SEQ ID NO: 9626 - protein, 57 aa, Arabidopsis thaliana
MAFDGCCPDCKLPGDDCPLIWGACNHAFHLHCILKWVNSQTSQAHCPMCRREWQFKE

SEQ ID NO: 9627 - protein, 330 aa, Arabidopsis thaliana
MEDDNSNNNNNNNVIAPFIVKTYQMVNDPSTDWLITWGPAHNSFIVVDPLDFSQRILPAYFKHNNFSSFVRQLNTYGFRKVDPDRWEFANEHFLRGQKHLLNNIARRKHARGMYGQDLEDGEIVREIERLKEEQRELEAEIQRMNRRIEATEKRPEQMMAFLYKVVEDPDLLPRMMLEKERTKQQQQVSDKKKRRVTMSTVKSEEEEVEEDEGRVFRVMSSSTPSPSSTENLYRNHSPDGWIVPMTQGQFGSYETGLVAKSMLSNSTSSTSSSLTSTFSLPESVNGGGGGGCGSIQGERRYKETATFGGVVESNPPTTPPYPFSLFRGGF

SEQ ID NO: 9628 - protein, 234 aa, Arabidopsis thaliana
MGMAAESQFHVLAVDDSLFDRKLIERLLQKSSCQVTTVDSGSKALEFLGLRQSTDSNDPNAFSKAPVNHQVVEVNLIITDYCMPGMTGYDLLKKVKESSAFRDIPVVIMSSENVPARISRCLEEGAEEFFLKPVRLADLNKLKPHMMKTKLKNQKLEEIETTSKVENGVPTAVADPEIKDSTNIEIEILPLQQDLLLVQQEEQTLSINNKRKSVEEGISTDRARPRFDGIATAV

SEQ ID NO: 9629 - protein, 539 aa, Arabidopsis thaliana
MTGATPENRTAPSPPPVKHVPESVLPAKPPKRNNYAFACAILASMTSILLGYDIGVMSGAMIYIKRDLKINDLQIGILAGSLNIYSLIGSCAAGRTSDWIGRRYTIVLAGAIFFAGAILMGLSPNYAFLMFGRFIAGIGVGYALMIAPVYTAEVSPASSRGFLNSFPEVFINAGIMLGYVSNLAFSNLPLKVGWRLMLGIGAVPSVILAIGVLAMPESPRWLVMQGRLGDAKRVLDKTSDSPTEATLRLEDIKHAAGIPADCHDDVVQVSRRNSHGEGVWRELLIRPTPAVRRVMIAAIGIHFFQQASGIDAVVLFSPRIFKTAGLKTDHQQLLATVAVGVVKTSFILVATFLLDRIGRRPLLLTSVGGMVLSLAALGTSLTIIDQSEKKVMWAVVVAIATVMTYVATFSIGAGPITWVYSSEIFPLRLRSQGSSMGVVVNRVTSGVISISFLPMSKAMTTGGAFYLFGGIATVAWVFFYTFLPETQGRMLEDMDELFSGFRWRDSKSKPKGNPEKTVPNPEVEIGSNKQWKEGDTQSS

SEQ ID NO: 9630 - protein, 599 aa, Arabidopsis thaliana
MGGCTSKPSSSVKPNPYAPKDAVLQNDDSTPAHPGKSPVRSSPAVKASPFFPFYTPSPARHRRNKSRDGGGGESKSVTSTPLRQLARAFHPPSPARHIRDVLRRRKEKKEAALPAARQQKEEEEREEVGLDKRFGFSKELQSRIELGEEIGRGHFGYTCSAKFKKGELKDQEVAVKVIPKSKMTSAISIEDVRREVKILRALSGHQNLVQFYDAFEDNANVYIVMELCGGGELLDRILARGGKYSEDDAKAVLIQILNVVAFCHLQGVVHRDLKPENFLYTSKEENSMLKVIDFGLSDFVRPDERLNDIVGSAYYVAPEVLHRSYTTEADVWSIGVIAYILLCGSRPFWARTESGIFRAVLKADPSFDEPPWPSLSFEAKDFVKRLLYKDPRKRMTASQALMHPWIAGYKKIDIPFDILIFKQIKAYLRSSSLRKAALMALSKTLTTDELLYLKAQFAHLAPNKNGLITLDSIRLALATNATEAMKESRIPDFLALLNGLQYKGMDFEEFCAASISVHQHESLDCWEQSIRHAYELFEMNGNRVIVIEELASELGVGSSIPVHTILNDWIRHTDGKLSFLGFVKLLHGVSTRQSLAKTR

SEQ ID NO: 9631 - protein, 590 aa, Arabidopsis thaliana
MVKHEILNYSEDEEENYSDEGDWGDWKADDNGIEGGEEEEEDDGDDSESDFLCLFCDSHFVSCDLLFEHCRLSHGFDFHGVRKELKLDFYSSFKLINYIRSQVAENMCFSWKIEADDYKDVKFPWDEEKYLKPFWQEDSLLYSFADDEEDEEVTFDREEVMEELQKLGDLSIDVEALGESSMSNSDKCNINGSKDVTSLSNCNGLKQSSADDLIVNGKDAEPKVCDGRLVNRNIRKVNENYFGSYSSFGIHREMLSDKVRTEAYRDALLKNPTLLNGSVVMDVGCGTGILSLFAAKAGASRVVAVEASEKMAKDNKVFNDNEHNGVLEVAHSMVEELDKSIQIQPHSVDVLVSEWMGYCLLYESMLSSVLYARDRWLKPGGAILPDTATMFVAGFGKGATSLPFWEDVYGFDMSSIGKEIHDDTTRLPIVDVIAERDLVTQPTLLQTFDLATMKPDEVDFTATATLEPTESEAKTRLCHGVVLWFDTGFTSRFCKENPTVLSTSPYTPPTHWAQTILTFQEPISVAPASVLSGNDRREAIGTEECPASSIHLRVSVARAHEHRSIDISLEATGLSSKGQKRHWPVQIFNL

SEQ ID NO: 9632 - protein, 537 aa, Arabidopsis thaliana
MSVVLLSSTSATITKSQSKKIPFLSPTTKFPLKVSISPSRSKLFHNPLRVAAPPSVPTSDSTEEKRIEEEYGGDKEEEGSEFKWRDHWYPVSLVEDLDPNVPTPFQLLGRDLVLWFDRNDQKWAAFDDLCPHRLAPLSEGRLDENGHLQCSYHGWSFGGCGSCTRIPQAATSGPEARAVKSPRACAIKFPTMVSQGLLFVWPDENGWDRANSIEPPRLPDDFDKPEFSTVTIQRDLFYGYDTLMENVSDPSHIDFAHHKVTGRRDRAKPLPFKVESSGPWGFQGANDDSPRITAKFVAPCYSMNKIELDAKLPIVGNQKWVIWICSFNIPMAPGKTRSIVCSARNFFQFSVPGPAWWQVVPRWYEHWTSNLVYDGDMIVLQGQEKVFLAKSMESPDYDVNKQYTKLTFTPTQADRFVLAFRNWLRRHGKSQPEWFGSTPSNQPLPSTVLTKRQMLDRFDQHTQVCSSCKGAYNSFQILKKFLVGATVFWAATAGVPSDVQIRLVLAGLSLISAASAYALHEQEKNFVFRDYVHSEIE

SEQ ID NO: 9633 - protein, 542 aa, Arabidopsis thaliana
MAHNHSNEDGSIGTSLHGVTAREQVFSFSVQEDVPSSQAVRTNDPTAKFALPVDSEHRAKVFKPLSFAKPHMRAFHLGWISFFTCFISTFAAAPLVPVIRDNLDLTKTDIGNAGVASVSGAIFSRLAMGAVCDLLGARYGTAFSLMLTAPAVFSMSFVADAGSYLAVRFMIGFCLATFVSCQYWTSVMFTGKIIGLVNGCAGGWGDMGGGVTQLLMPMVFHVIKLTGATPFTAWRFAFFIPGILQIVMGILVLTLGQDLPDGNLSTLQKSGQVSKDKFSKVFWFAVKNYRTWILFMLYGFSMGVELTINNVISGYFYDRFNLTLHTAGIIAASFGMANFFARPFGGYASDVAARLFGMRGRLWILWILQTVGALFCIWLGRASSLPIAILAMMLFSMGTQAACGALFGVAPFVSRRSLGLISGLTGAGGNFGSGVTQLLFFSSSRFSTAEGLSLMGVMAVVCSLPVAFIHFPQWGSMFLRPSQDGEKSKEEHYYGAEWTEEEKSLGLHEGSIKFAENSRSERGRKAMLADIPTPETGSPAHV

SEQ ID NO: 9634 - protein, 552 aa, Arabidopsis thaliana
MVIGLSTMLEKTEALFASDHASVVSMNLFVALLCACIVLGHLLEETRWMNESITALIIGSCTGIVILLISGGKSSRILVFSEDLFFIYLLPPIIFNAGFQVKKKQFFRNFMTIMLFGAIGTLISFVIISFGAKHLFEKMNIGDLTIADYLAIGAIFSATDSVCTLQVLNQDETPLLYSLVFGEGVVNDATSVVLFNAIQRFDLTNINSAIALEFAGNFFYLFILSTALGVAAGLLSAFVIKKLYIGRHSTDREVALMMLLAYLSYMLAELFHLSSILTVFFCGIVMSHYTWHNVTDKSKVTTKHTFAAMSFLAEIFIFLYVGMDALDIEKWDVVRNSPGQSIGVSSILLGLILLGRAAFVFPLSFLSNLTKSSPDEKIDLKKQVTIWWAGLMRGAVSMALAYNQFTTSGHTKVLGNAIMITSTITVVLFSTVVFGLLTKPLVKHLQPSSKQSSTTALQITLRSSFHDPILHEPLLSTQGQSEYDPEQHVSFRMFWKSPSRAIHHYWRKFDNAVMRRIFGGRGVSPVVPGSPIENSVPQWSEEVENKEQNGEP

SEQ ID NO: 9635 - protein, 380 aa, Arabidopsis thaliana
MTFRSLLQEMRSRPHRVVHAAASTANSSDPFSWSELPEELLREILIRVETVDGGDWPSRRNVVACAGVCRSWRILTKEIVAVPEFSSKLTFPISLKQSGPRDSLVQCFIKRNRNTQSYHLYLGLTTSLTDNGKFLLAASKLKRATCTDYIISLRSDDISKRSNAYLGRMRSNFLGTKFTVFDGSQTGAAKMQKSRSSNFIKVSPRVPQGSYPIAHISYELNVLGSRGPRRMRCIMDTIPMSIVESRGVVASTSISSFSSRSSPVFRSHSKPLRSNSASCSDSGNNLGDPPLVLSNKAPRWHEQLRCWCLNFHGRVTVASVKNFQLVAVSDCEAGQTSERIILQFGKVGKDMFTMDYGYPISAFQAFAICLSSFETRIACE

SEQ ID NO: 9636 - protein, 326 aa, Arabidopsis thaliana
MVLEKKSALLEDLIKKCGGCAVVDGGFATQLEIHGAAINDPLWSAVSLIKNPELIKRVHMEYLEAGADIVVTSSYQATIPGFLSRGLSIEESESLLQKSVELAVEARDRFWEKVSKVSGHSYNRALVAASIGSYGAYLADGSEYSGHYGENVSLDKLKDFHRRRLQVLVEAGPDLLAFETIPNKLEAQACVELLEEEKVQIPAWICFTSVDGEKAPSGESFEECLEPLNKSNNIYAVGINCAPPQFIENLIRKFAKLTKKAIVVYPNSGEVWDGKAKQWLPSQCFGDDEFEMFATKWRDLGAKLIGGCCRTTPSTINAISRDLKRR

SEQ ID NO: 9637 - protein, 308 aa, Arabidopsis thaliana
MAPGGSALKEVMESNSTGMDYEVKTAKVEVNNNKPTKPGSAGIGKYGIHSNNGVYELLECPVCTNLMYPPIHQCPNGHTLCSNCKLRVQNTCPTCRYELGNIRCLALEKVAESLEVPCRYQNLGCHDIFPYYSKLKHEQHCRFRPYTCPYAGSECSVTGDIPTLVVHLKDDHKVDMHDGCTFNHRYVKSNPHEVENATWMLTVFNCFGRQFCLHFEAFQLGMAPVYMAFLRFMGDENEAKKFSYSLEVGAHGRKLTWQGIPRSIRDSHRKVRDSQDGLIIPRNLALYFSGGDRQELKLRVTGRIWKEE

SEQ ID NO: 9638 - protein, 561 aa, Arabidopsis thaliana
MSDLQTPLVRPKRKKTWVDYFVKFRWIIVIFIVLPFSATFYFLIYLGDMWSESKSFEKRQKEHDENVKKVIKRLKGRDASKDGLVCTARKPWIAVGMRNVDYKRARHFEVDLGEFRNILEINKEKMTARVEPLVNMGQISRATVPMNLSLAVVAELDDLTVGGLINGYGIEGSSHIYGLFADTVEAYEIVLAGGELVRATRDNEYSDLYYAIPWSQGTLGLLVAAEIRLIKVKEYMRLTYIPVKGDLQALAQGYIDSFAPKDGDKSKIPDFVEGMVYNPTEGVMMVGTYASKEEAKKKGNKINNVGWWFKPWFYQHAQTALKKGQFVEYIPTREYYHRHTRCLYWEGKLILPFGDQFWFRYLLGWLMPPKVSLLKATQGEAIRNYYHDMHVIQDMLVPLYKVGDALEWVHREMEVYPIWLCPHKLFKQPIKGQIYPEPGFEYENRQGDTEDAQMYTDVGVYYAPGCVLRGEEFDGSEAVRRMEKWLIENHGFQPQYAVSELDEKSFWRMFNGELYEECRKKYRAIGTFMSVYYKSKKGRKTEKEVREAEQAHLETAYAEAD

SEQ ID NO: 9639 - protein, 244 aa, Arabidopsis thaliana
MRKGRGSSVVGPALPVTAGGSVKEPRYRGVRKRPWGRFAAEIRDPLKKSRVWLGTFDSAVDAARAYDTAARNLRGPKAKTNFPIDCSPSSPLQPLTYLHNQNLCSPPVIQNQIDPFMDHRLYGGGNFQEQQQQQIISRPASSSMSSTVKSCSGPRPMEAAAASSSVAKPLHAIKRYPRTPPVAPEDCHSDCDSSSSVIDDGDDIASSSSRRKTPFQFDLNFPPLDGVDLFAGGIDDLHCTDLRL

SEQ ID NO: 9640 - protein, 391 aa, Arabidopsis thaliana
MLPVTSRRHFTMSLYMLRSSSPHINHHSFLLPSFVSSKFKHHTLSPPPSPPPPPPMAACIDTCRTGKPQISPRDSSKHHDDESGFRYMNYFRYPDRSSFNGTQTKTLHTRPLLEDLDRDAEVDDVWAKIREEAKSDIAKEPIVSAYYHASIVSQRSLEAALANTLSVKLSNLNLPSNTLFDLFSGVLQGNPDIVESVKLDLLAVKERDPACISYVHCFLHFKGFLACQAHRIAHELWTQDRKILALLIQNRVSEAFAVDFHPGAKIGTGILLDHATAIVIGETAVVGNNVSILHNVTLGGTGKQCGDRHPKIGDGVLIGAGTCILGNITIGEGAKIGAGSVVLKDVPPRTTAVGNPARLLGGKDNPKTHDKIPGLTMDQTSHISEWSDYVI

SEQ ID NO: 9641 - protein, 370 aa, Arabidopsis thaliana
MNTGGGQYTDFPAVETHGGQFISYDIFGSLFEITSKYRPPIIPIGRGAYGIVCSVLDTETNELVAMKKIANAFDNHMDAKRTLREIKLLRHLDHENIIAIRDVVPPPLRRQFSDVYISTELMDTDLHQIIRSNQSLSEEHCQYFLYQLLRGLKYIHSANIIHRDLKPSNLLLNANCDLKICDFGLARPTSENDFMTEYVVTRWYRAPELLLNSSDYTAAIDVWSVGCIFMELMNRKPLFPGKDHVHQMRLLTELLGTPTESDLGFTHNEDAKRYIRQLPNFPRQPLAKLFSHVNPMAIDLVDRMLTFDPNRRITVEQALNHQYLAKLHDPNDEPICQKPFSFEFEQQPLDEEQIKEMIYQEAIALNPTYG

SEQ ID NO: 9642 - protein, 554 aa, Arabidopsis thaliana
MRGVKLLAACLYLAAAATVVVRAEDPYFHHVWNVTYGTVSPLGVPQQVILINGQFPGPNVNSTSNNNVIINVFNNLDEPFLLTWNGIQHRKNCWQDGTPGTMCPIMPGTNYTYHFQPKDQIGSYFYYPSTAMHRSAGGFGGLRVNSRLLIPVPYADPEDDYTVLIGDWYTKSHTQLKKFLDSGRTLGRPDGILINGKSGKGDGSDAPLFTLKPGKTYRVRICNVGLKTSLNFRIQNHKLKLVEMEGSHVLQNDYDSLDVHVGQCYGTILTANQEAKDYYMVASSRFLKSVITTTGLLRYEGGKGPASSQLPPGPVGWAWSLNQFRSFRWNLTASAARPNPQGSYHYGKINITRTIKLVNTQGKVDGKLRYALNGVSHTDPETPLKLAEYFGVADKVFKYDSITDNPTPEQIKSIKIVPNVLNITHRTFIEVVFENHEKSVQSWHLDGYSFFAVAVEPGTWTPEKRKNYNLLDAVSRHTVQVYPKCWAAILLTFDNCGMWNVRSENSERRYLGQQLYASVLSPEKSLRDEYNMPETSLQCGLVKGTPKPNPYAGA

SEQ ID NO: 9643 - protein, 551 aa, Arabidopsis thaliana
MQGGRLLTVLVCLASTVALVSAGDPYFYYTWNVTYGTAAPLGIPQQVILINGQFPGPNLNSTSNNNVVINVFNNLDEPFLLTWSGLQHRKNSWQDGVTGTSCPIPAGTNFTYHFQPKDQIGSYFYYPSTALHRFAGGFGGLRVNSRLLIPVPYADPEDDRTILINDWYAKSHTALKNFLDSGRTLGSPDGVLINGKSGKLGGNNAPLFTMKPGKTYKYRICNVGFKSTLNFRIQGHKMKLVEMEGSHVLQNDYDSLDVHVGQCFAVLVTADQVAKNYYMVASTRFLKKEVSTVGVMSYEGSNVQASSDIPKAPVGWAWSLNQFRSFRWNLTASAARPNPQGSYHYGKINITRTIKLANTKNLVNGKVRFGFNGVSHVDTETPLKLAEYFGMSEKVFKYNVIKDEPAAKITTLTVEPNVLNITFRTFVEVVFENHEKSMQSFHLDGYSFFAVASEPGRWTPEKRNNYNLLDAVSRHTVQVYPKSWSAILLTFDNAGMWNIRSENWERRYLGQQLYVSVLSPEKSLRDEYNIPLNTNLCGIVKGLPLPTPYTI

SEQ ID NO: 9644 - protein, 315 aa, Arabidopsis thaliana
MEDASETSYWCHMCSRSVIPLIQDEIIKCNFCQSGFVEEMDNNDDHQAADSLWTPILMEMMNNNHDQHSTNQEDSESILEDEDEDEDDGDDGDQNNDGEIDITHQLEEIRRIRTRHSTAIVNLLQGIRAGLLIESENNEDNPDNSELVVLINSFNQRIRVHQDSVDTTSVPSGSLGDYFIGPGFETLLQRLAENDLNNRYGTPPATKEAVEALAMVKIEDSLLQCSVCLDDFEIGMEAKEMPCKHKFHSDCLLPWLELHSSCPVCRYLLPTGDDDEPKTDAETSRNDDNNEDISNASMASNGSSPDSSSNNSSVN

SEQ ID NO: 9645 - protein, 358 aa, Arabidopsis thaliana
MAAALVRRFCRGSSFPVSGHGYRMLSTVENVSESGKSMNLYSAINQALHIALETDPRSYVFGEDVGFGGVFRCTTGLAERFGKSRVFNTPLCEQGIVGFGIGLAAMGNRVIAEIQFADYIFPAFDQIVNEAAKFRYRSGNQFNCGGLTIRAPYGAVGHGGHYHSQSPEAFFCHVPGIKVVIPRSPREAKGLLLSSIRDPNPVVFFEPKWLYRQAVEDVPEDDYMIPLSEAEVMREGSDITLVGWGAQLTIMEQACLDAENEGISCELIDLKTLIPWDKEIVETSVRKTGRLLISHEAPVTGGFGAEIAATIVERCFLRLEAPVSRVCGLDTPFPLVFEPFYMPTKNKILDAIRSTVNY

SEQ ID NO: 9646 - protein, 660 aa, Arabidopsis thaliana
MEEEKASAAQSLIDVVNEIAAISDYRITVKKLCYNLARRLKLLVPMFEEIRESNEPISEDTLKTLMNLKEAMCSAKDYLKFCSQGSKIYLVMEREQVTSKLMEVSVKLEQSLSQIPYEELDISDEVREQVELVLSQFRRAKGRVDVSDDELYEDLQSLCNKSSDVDAYQPVLERVAKKLHLMEIPDLAQESVALHEMVASSGGDVGENIEEMAMVLKMIKDFVQTEDDNGEEQKVGVNSRSNGQTSTAASQKIPVIPDDFRCPISLEMMRDPVIVSSGQTYERTCIEKWIEGGHSTCPKTQQALTSTTLTPNYVLRSLIAQWCEANDIEPPKPPSSLRPRKVSSFSSPAEANKIEDLMWRLAYGNPEDQRSAAGEIRLLAKRNADNRVAIAEAGAIPLLVGLLSTPDSRIQEHSVTALLNLSICENNKGAIVSAGAIPGIVQVLKKGSMEARENAAATLFSLSVIDENKVTIGALGAIPPLVVLLNEGTQRGKKDAATALFNLCIYQGNKGKAIRAGVIPTLTRLLTEPGSGMVDEALAILAILSSHPEGKAIIGSSDAVPSLVEFIRTGSPRNRENAAAVLVHLCSGDPQHLVEAQKLGLMGPLIDLAGNGTDRGKRKAAQLLERISRLAEQQKETAVSQPEEEAEPTHPESTTEAADT

SEQ ID NO: 9647 - protein, 372 aa, Arabidopsis thaliana
MGYMCDFCGEQRSMVYCRSDAACLCLSCDRSVHSANALSKRHSRTLVCERCNAQPATVRCVEERVSLCQNCDWSGHNNSNNNNSSSSSTSPQQHKRQTISCYSGCPSSSELASIWSFCLDLAGQSICEQELGMMNIDDDGPTDKKTCNEDKKDVLVGSSSIPETSSVPQGKSSSAKDVGMCEDDFYGNLGMDEVDMALENYEELFGTAFNPSEELFGHGGIDSLFHKHQTAPEGGNSVQPAGSNDSFMSSKTEPIICFASKPAHSNISFSGVTGESSAGDFQECGASSSIQLSGEPPWYPPTLQDNNACSHSVTRNNAVMRYKEKKKARKFDKRVRYASRKARADVRRRVKGRFVKAGEAYDYDPLTPTRSY

SEQ ID NO: 9648 - protein, 245 aa, Arabidopsis thaliana
MSEDPEYRCFIGGLAWTTSDRGLRDAFEKYGHLVEAKVVLDKFSGRSRGFGFITFDEKKAMDEAIAAMNGMDLDGRTITVDKAQPHQGGAGRDNDGDRGRDRGYDRDRSRPSGGRGGGDCFKCGKPGHFARECPSESSRDGGGRFSSKDDRYSSKDDRYGAKDDRYGAKEDRYGAKDDRYSSKDDRYSSKDDRYGSRDGGGSRYGPDRSGERAGGRSRDGGSRGAPGGERHSRAPYDRPRAGGFH

SEQ ID NO: 9649 - protein, 346 aa, Arabidopsis thaliana
MVTSSDQIQNGSEEQSKRSEIYTYEAPWQIYAMNWSIRRDKKYRLAITSLIEQYPNRVEIVQLDESNGEIRSDPNLCFEHPYPPTKTSFIPDKECQRPDLLATSSDFLRLWRISDDESRVELKSCLSSDKNSEFSGPITSFDWNEAEPRRIGTSSIDTTCTIWDIEREVVDTQLIAHDKEVYDIAWGGVGVFASVSEDGSVRVFDLRDKEHSTIIYESGEPSTPLVRLSWNKQDPRYMATVIMGSAKIVVLDIRFPALPVVELQRHQASVNAIAWAPHSSSHICSAGDDSQALIWDISSMGQHVEGGLDPILAYTAGAEVEQLQWSSSQPDWVAIAFSNKLQILRV

SEQ ID NO: 9650 - protein, 287 aa, Arabidopsis thaliana
MTYENNSVPRIVIKKVLAKLEKEGEGAVVRNGITKIDQKLLDPFVLLVEFSFSLSAGFPDHPHRGFESVTYMLQGGIIHKDPKGHKGTIQAGDVQWMTAGRGIIHSEFPEEEVNNGLQLWINLPSTEKMTEPKYKELSSLDIPRAEENGVEVKVIAGDSMGIKSPVYTRTPTMFLDFTLKPGSQTHQTVPESWTAFAYIIEGDEGVFGSLNSSAISAHHVVVFGPGDLVSVWNKSTSRSLRFLLIAGEPIGEPVVQCGPFVMNSQAEIDMAFDDYQNAKNGFEMAKC

SEQ ID NO: 9651 - protein, 271 aa, Arabidopsis thaliana
MKVMVLSLGKASPSKSDHELLDPFVSLVEFSVSPPGGFKDHPHRGFESVTYMFQGGIIHQDCNGNKGTIHEGDVQWMTAGRGIIHSEMPEEQVNKGLQLWINLPSSAKMIEPKNIEISSSEIPSADDYGVEVKVIAGESMGVKSPFYTKTPIMFLDFTLDPKAQTHQAVPESWTAFAYIVEGDEGVFSSSDSSTVQAHNVVVFGTGDEVSVWNTSNSRPLRFLLIAGEPIGEPVVQHGPFVMNSQDEIEMTIGDYRNGMNGFEMAKHWRSE

SEQ ID NO: 9652 - protein, 241 aa, Arabidopsis thaliana
MVYFNFNRIKTKKTLIGFGLGQILSLLSTSLSFTSSEIARKDFSFFFFSNHPIFKHSHELTKFEIFIGINAPTSQSFLGYVLLAIVYGAKWYHYLLLAFVDVEANFLAEAAEKVICYLTIYDEILIRFYSCAFLVTKYRLMKISGVVICNVGVVMVVFSDVHAGDRAGGSNPIKGDFLVIAGATLYAVSNVSQEFLVKNADRVQLMSLLGLFGAIIGAIQMYPSNNKAKTLMFLKTYMCNL

SEQ ID NO: 9653 - protein, 895 aa, Arabidopsis thaliana
MRMFETRAREWILLVKLVLFTSIWQLASALGSMSSIAISYGEGGSVFCGLKSDGSHLVVCYGSNSAILYGTPGHLQFIGLTGGDGFMCGLLMLSHQPYCWGNSAFIQMGVPQPMTKGAEYLEVSAGDYHLCGLRKPIVGRRKNSNIISSSLVDCWGYNMTRNFVFDKQLHSLSAGSEFNCALSSKDKSVFCWGDENSSQVISLIPKEKKFQKIAAGGYHVCGILDGLESRVLCWGKSLEFEEEVTGTSTEEKILDLPPKEPLLAVVGGKFYACGIKRYDHSAVCWGFFVNRSTPAPTGIGFYDLAAGNYFTCGVLTGTSMSPVCWGLGFPASIPLAVSPGLCIDTPCPPGTHELSNQENSPCKFTGSHICLPCSTSCPPGMYQKSVCTERSDQVCVYNCSSCSSHDCSSNCSSSATSGGKEKGKFWSLQLPIATAEIGFALFLVAVVSITAALYIRYRLRNCRCSENDTRSSKDSAFTKDNGKIRPDLDELQKRRRARVFTYEELEKAADGFKEESIVGKGSFSCVYKGVLRDGTTVAVKRAIMSSDKQKNSNEFRTELDLLSRLNHAHLLSLLGYCEECGERLLVYEFMAHGSLHNHLHGKNKALKEQLDWVKRVTIAVQAARGIEYLHGYACPPVIHRDIKSSNILIDEEHNARVADFGLSLLGPVDSGSPLAELPAGTLGYLDPEYYRLHYLTTKSDVYSFGVLLLEILSGRKAIDMHYEEGNIVEWAVPLIKAGDINALLDPVLKHPSEIEALKRIVSVACKCVRMRGKDRPSMDKVTTALERALAQLMGNPSSEQPILPTEVVLGSSRMHKKSWRIGSKRSGSENTEFRGGSWITFPSVTSSQRRKSSASEGDVAEEEDEGRKQQEALRSLEEEIGPASPGQSLFLHHNF

SEQ ID NO: 9654 - protein, 300 aa, Arabidopsis thaliana
MGSSLSNLNDGTNGLAMGPGLGDIPESCVACVFMYLTPPEICNLAGLNRSFRGAASSDSVWEKKLPENYQDLLDLLPPERYHSLSKKDIFAVLSRPIPFDDDNKEVWIDRVTGRVCMAISARGMSITGIEDRRYWNWIPTEESRFHVVAYLQQIWWFEVDGTVRFHLPPGVYSLSFRIHLGRFTKRLGRRVCHFELTHGWDLKPVRFSLSTSDGQEASCEYYLDDVERNEALGKHKRGYWIEYRVGEFIVNGSEPSTEIQWSMKQIDCTHSKGGLCVDSVFINPIGDVKEHKRKAVLKEA

SEQ ID NO: 9655 - protein, 228 aa, Arabidopsis thaliana
MAESQTGGGGGGSHESGGDQSPRSLNVREQDRFLPIANISRIMKRGLPLNGKIAKDAKETMQECVSEFISFVTSEASDKCQREKRKTINGDDLLWAMATLGFEDYIDPLKVYLMRYREMEGDTKGSGKGGESSAKRDGQPSQVSQFSQVPQQGSFSQGPYGNSQSLRFGNSIEHLEVLMSSTRTLFITIFRDSTMPVVSENLSDPLSIDMDCEAIYHHFIGLLILSCK

SEQ ID NO: 9656 - protein, 484 aa, Arabidopsis thaliana
MAAATQFLSQPSSLNPHQLKNQTSQRSRSIPVLSLKSTLKPLKRLSVKAAVVSQNSSKTVTKFDHCFKKSSDGFLYCEGTKVEDIMESVERRPFYLYSKPQITRNLEAYKEALEGVSSVIGYAIKANNNLKILEHLRSLGCGAVLVSGNELRLALRAGFDPTKCIFNGNGKSLEDLVLAAQEGVFVNVDSEFDLNNIVEASRISGKQVNVLLRINPDVDPQVHPYVATGNKNSKFGIRNEKLQWFLDQVKAHPKELKLVGAHCHLGSTITKVDIFRDAAVLMIEYIDEIRRQGFEVSYLNIGGGLGIDYYHAGAVLPTPMDLINTVRELVLSRDLNLIIEPGRSLIANTCCFVNHVTGVKTNGTKNFIVIDGSMAELIRPSLYDAYQHIELVSPPPAEAEVTKFDVVGPVCESADFLGKDRELPTPPQGAGLVVHDAGAYCMSMASTYNLKMRPPEYWVEEDGSITKIRHAETFDDHLRFFEGL

SEQ ID NO: 9657 - protein, 586 aa, Arabidopsis thaliana
MEFFTEYGDANRYRILEVIGKGSYGVVCAAIDTQTGEKVAIKKINDVFEHVSDALRILREVKLLRLLRHPDIVEIKSIMLPPSKREFKDIYVVFELMESDLHQVIKANDDLTREHHQFFLYQMLRALKYMHTANVYHRDLKPKNILANANCKLKVCDFGLARVSFNDTPTTVFWTDYVATRWYRAPELCGSFCSKYTPAIDIWSIGCIFAEVLTGKPLFPGKSVVHQLDLITDLLGTPKSETIAGVRNEKARKYLNEMRKKNLVPFSQKFPNADPLALRLLQRLLAFDPKDRPTAAEALADPYFKCLAKVEREPSCQPISKMEFEFERRRLTKDDIRELIYREILEYHPQLLKDYMNSEGSSFLYPSAIGHLRKQFAYLEENSGKSGPVIPPDRKHASLPRSAVHSSAVNSNAQPSLNASDSRRVSIEPSRNGVVPSTSAYSTKPLGPPPRVPSGKPGRVVESSVTYENDRNLKESSYDARTSYYRSTVLPPQTVSPNCYFLPNTMNQEKRSGTEAASQPKPQFVPTQCNSAKPAELNPNPYVQSQHKVGIDAKLLHAQSQYGPAGAAAVAVAAHRNIGAVGYGMS

SEQ ID NO: 9658 - protein, 581 aa, Arabidopsis thaliana
MSKQTYKVCFCFRRRFRYTASEAPREIKTIFEKYSENGVMTVDHLHRFLIDVQKQDKATREDAQSIINSASSLLHRNGLHLDAFFKYLFGDNNPPLALHKVHHDMDAPISHYFIFTGHNSYLTGNQLSSDCSEVPIIDALKKGVRVIELDIWPNSNKDDIDVLHGMTLTTPVGLIKCLKAIRAHAFDVSDYPVVVTLEDHLTPDLQSKVAEMVTEIFGEILFTPPVGESLKEFPSPNSLKRRIIISTKPPKEYKEGKDVEVVQKGKDLGDEEVWGREVPSFIQRNKSEAKDDLDGNDDDDDDDDEDKSKINAPPQYKHLIAIHAGKPKGGITECLKVDPDKVRRLSLSEEQLEKAAEKYAKQIVRFTQHNLLRIYPKGTRVTSSNYNPLVGWSHGAQMVAFNMQGYGRSLWLMQGMFRANGGCGYIKKPDLLLKSGSDSDIFDPKATLPVKTTLRVTVYMGEGWYFDFRHTHFDQYSPPDFYTRVGIAGVPGDTVMKKTKTLEDNWIPAWDEVFEFPLTVPELALLRLEVHEYDMSEKDDFGGQTCLPVWELSEGIRAFPLHSRKGEKYKSVKLLVKVEFV

SEQ ID NO: 9659 - protein, 381 aa, Arabidopsis thaliana
MVDQVQHPTIAQKAAGQFMRSSVSKDVQVGYQRPSMYQRHATYGNYSNAAFQFPPTSRMLATTASPVFVQTPGEKGFTNFALDFLMGGVSAAVSKTAAAPIERVKLLIQNQDEMIKAGRLSEPYKGIGDCFGRTIKDEGFGSLWRGNTANVIRYFPTQALNFAFKDYFKRLFNFKKDRDGYWKWFAGNLASGGAAGASSLLFVYSLDYARTRLANDAKAAKKGGGGRQFDGLVDVYRKTLKTDGIAGLYRGFNISCVGIIVYRGLYFGLYDSVKPVLLTGDLQDSFFASFALGWVITNGAGLASYPIDTVRRRMMMTSGEAVKYKSSLDAFKQILKNEGAKSLFKGAGANILRAVAGAGVLSGYDKLQLIVFGKKYGSGGA

SEQ ID NO: 9660 - protein, 345 aa, Arabidopsis thaliana
MGRSPCCDKAGLKKGPWTPEEDQKLLAYIEEHGHGSWRSLPEKAGLQRCGKSCRLRWTNYLRPDIKRGKFTVQEEQTIIQLHALLGNRWSAIATHLPKRTDNEIKNYWNTHLKKRLIKMGIDPVTHKHKNETLSSSTGQSKNAATLSHMAQWESARLEAEARLARESKLLHLQHYQNNNNLNKSAAPQQHCFTQKTSTNWTKPNQGNGDQQLESPTSTVTFSENLLMPLGIPTDSSRNRNNNNNESSAMIELAVSSSTSSDVSLVKEHEHDWIRQINCGSGGIGEGFTSLLIGDSVGRGLPTGKNEATAGVGNESEYNYYEDNKNYWNSILNLVDSSPSDSATMF

SEQ ID NO: 9661 - protein, 378 aa, Arabidopsis thaliana
MVSVSLADNNEEKSTDLKKFKGGVTDHSISKANDNDHDDDDHDQDDDNDGDHDDDDHDDDNDHDDDNNDHDDDDNNDDNNDGDDDHDDDNNDDGDDEKKTLRVHELKKGNLTVKFTNRGASIMSLLFPNINASKKEKAAANDGKNTIHGGTKESSDVIWRVKKHKHNGKKPYIVFTYTTSPDGDQGKLEVTVTYKLVGENRLKMVMQAKAKEKTTPLNLVHRSYWNLGGHNNEDIFSEEIQILGSGYTHLDDNLTPTGKILAVKGTPFDFRQLRPIKDNINELKTGYGINYCLDGVANKMRKVVELVDNKSKIKMELSTDQSGLRLKTTKPKNGSVHKAYSGLCLESHAINYQYRSSQIIEPGETYKHTMLFKFSFVP

SEQ ID NO: 9662 - protein, 272 aa, Arabidopsis thaliana
MESNSFFFDPSASHGNSMFFLGNLNPVVQGGGARSMMNMEETSKRRPFFSSPEDLYDDDFYDDQLPEKKRRLTTEQVHLLEKSFETENKLEPERKTQLAKKLGLQPRQVAVWFQNRRARWKTKQLERDYDLLKSTYDQLLSNYDSIVMDNDKLRSEVTSLTEKLQGKQETANEPPGQVPEPNQLDPVYINAAAIKTEDRLSSGSVGSAVLDDDAPQLLDSCDSYFPSIVPIQDNSNASDHDNDRSCFADVFVPTTSPSHDHHGESLAFWGWP

SEQ ID NO: 9663 - protein, 489 aa, Arabidopsis thaliana
MGGGNSKEESSSPSSSSWASHQSYPQYGPDSYNYPPPPTYAPAPSPAPAPAPVPAPSPASSYGPQYSQEGYASQPNNPPPPTYAPAPSPASSYGHQYSQEGYASAASQPNYPPPPSQSQVADRKKFDRRYSKISDNYSSLLQVSEALGRAGLESSNLIVGIDFTKSNEWTGAKSFNRKSLHHLSNTPNPYEQAITIIGRTLAAFDEDNLIPCYGFGDASTHDQDVFSFYPEGRFCNGFEEVLARYREIVPQLKLAGPTSFAPIIEMAMTVVEQSSGQYHVLVIIADGQVTRSVDTEHGRLSPQEQKTVDAIVKASTLPLSIVLVGVGDGPWDMMQEFDDNIPARAFDNFQFVNFTEIMSKNKDQSRKETEFALSALMEIPPQYKATIELNLLGVRNGNIPQRIPLPPPVQSGSSFSSSRIPNFEPSVPPYPFESKQMSSADDIQLCPICLSNPKNMAFGCGHQTCCECGPDLKVCPICRAPIQTRIKLY

SEQ ID NO: 9664 - protein, 276 aa, Arabidopsis thaliana
MYKERSGGGGGGSSRSEILGGAIDRKRINDALNKKLEKSSTSTTTSRVFSSKDKDPFSFTSTKTQLPDVESETDSEGSDVSGSEGDDTSWISWFCNLRGNDFFCEVDEDYIQDDFNLCGLSGQVPYYDYALDLILDVDASNSEMFTDEQHEMVESAAEMLYGLIHVRYILTTKGMAAMTEKYKNCDFGRCPRVFCCGQSCLPVGQSDIPRSSTVKIYCPKCEDISYPRSKFQGNIDGAYFGTTFPHLFLMTYGNLKPQKPTQSYVPKIFGFKVHKP

SEQ ID NO: 9665 - protein, 315 aa, Arabidopsis thaliana
MADEIGFFQLNTGAKIPSVGLGTWQAAPGVVGDAVAAAVKIGYQHIDCASRYGNEIEIGKVLKKLFDDGVVKREKLFITSKIWLTDLDPPDVQDALNRTLQDLQLDYVDLYLMHWPVRLKKGTVDFKPENIMPIDIPSTWKAMEALVDSGKARAIGVSNFSTKKLSDLVEAARVPPAVNQVECHPSWQQHKLHEFCKSKGIHLSGYSPLGSPGTTWVKADVLKSPVIEMIAKEIGKSPAQTALRWGLQMGHSILPKSTNEGRIRENFDVLGWSIPKEMFDKFSKIEQARLVQGTSFVHETLSPYKTLEELWDGEI

SEQ ID NO: 9666 - protein, 417 aa, Arabidopsis thaliana
MAATAATTTSSHLLLSSSRHVASSSQPSILSPRSLFSNNGKRAPTGVRNHQYASGVRCMAVAADAAETKTAARKKSGYELQTLTGWLLRQEMKGEIDAELTIVMSSISLACKQIASLVQRAGISNLTGVQGAVNIQGEDQKKLDVISNEVFSNCLRSSGRTGIIASEEEDVPVAVEESYSGNYVVVFDPLDGSSNIDAAVSTGSIFGIYSPNDECIVDDSDDISALGSEEQRCIVNVCQPGNNLLAAGYCMYSSSVIFVLTLGKGVFSFTLDPMYGEFVLTQENIEIPKAGRIYSFNEGNYQMWDDKLKKYIDDLKDPGPTGKPYSARYIGSLVGDFHRTLLYGGIYGYPRDAKSKNGKLRLLYECAPMSFIVEQAGGKGSDGHSRVLDIQPTEIHQRVPLYIGSTEEVEKLEKYLA

SEQ ID NO: 9667 - protein, 570 aa, Arabidopsis thaliana
MEEKDVYTQDGTVDIHKNPANKEKTGNWKACRFILGNECCERLAYYGMGTNLVNYLESRLNQGNATAANNVTNWSGTCYITPLIGAFIADAYLGRYWTIATFVFIYVSGMTLLTLSASVPGLKPGNCNADTCHPNSSQTAVFFVALYMIALGTGGIKPCVSSFGADQFDENDENEKIKKSSFFNWFYFSINVGALIAATVLVWIQMNVGWGWGFGVPTVAMVIAVCFFFFGSRFYRLQRPGGSPLTRIFQVIVAAFRKISVKVPEDKSLLFETADDESNIKGSRKLVHTDNLKFFDKAAVESQSDSIKDGEVNPWRLCSVTQVEELKSIITLLPVWATGIVFATVYSQMSTMFVLQGNTMDQHMGKNFEIPSASLSLFDTVSVLFWTPVYDQFIIPLARKFTRNERGFTQLQRMGIGLVVSIFAMITAGVLEVVRLDYVKTHNAYDQKQIHMSIFWQIPQYLLIGCAEVFTFIGQLEFFYDQAPDAMRSLCSALSLTTVALGNYLSTVLVTVVMKITKKNGKPGWIPDNLNRGHLDYFFYLLATLSFLNFLVYLWISKRYKYKKAVGRAH

SEQ ID NO: 9668 - protein, 232 aa, Arabidopsis thaliana
MARGKIQIKRIENQTNRQVTYSKRRNGLFKKAHELTVLCDARVSIIMFSSSNKLHEYISPNTTTKEIVDLYQTISDVDVWATQYERMQETKRKLLETNRNLRTQIKQRLGECLDELDIQELRRLEDEMENTFKLVRERKFKSLGNQIETTKKKNKSQQDIQKNLIHELELRAEDPHYGLVDNGGDYDSVLGYQIEGSRAYALRFHQNHHHYYPNHGLHAPSASDIITFHLLE

SEQ ID NO: 9669 - protein, 222 aa, Arabidopsis thaliana
MAKMGLKPDPATTNQTHNNAKEIRYRGVRKRPWGRYAAEIRDPGKKTRVWLGTFDTAEEAARAYDTAARDFRGAKAKTNFPTFLELSDQKVPTGFARSPSQSSTLDCASPPTLVVPSATAGNVPPQLELSLGGGGGGSCYQIPMSRPVYFLDLMGIGNVGRGQPPPVTSAFRSPVVHVATKMACGAQSDSDSSSVVDFEGGMEKRSQLLDLDLNLPPPSEQA

SEQ ID NO: 9670 - protein, 136 aa, Arabidopsis thaliana
MAGKGGKGLVAAKTMAANKDKDKDKKKPISRSARAGIQFPVGRIHRQLKTRVSAHGRVGATAAVYTASILEYLTAEVLELAGNASKDLKVKRITPRHLQLAIRGDEELDTLIKGTIAGGGVIPHIHKSLINKTTKE

SEQ ID NO: 9671 - protein, 323 aa, Arabidopsis thaliana
MGEEVQMSDYDVSGDGDRVSEWEMGLPSDEDLASLSYSLIPPNLAMAFSITPERSRTIQDVNRASETTLSSLRGGSSGPNTSSSNNNVEEEDRVGSSSPGSDSKKQKTSNGDGDDGGGVDPDSAMAAEEGDSGTEDLSGKTLKRPRLVWTPQLHKRFVDVVAHLGIKNAVPKTIMQLMNVEGLTRENVASHLQKYRLYLKRMQGLTNEGPSASDKLFSSTPVPPQSFQDIGGGGGSSGNVGVPIPGAYGTQQMMQMPVYAHHMGMQGYHHQNHNHDPYHQNHRHHHGAGGNGAFESNPYMMQQNKFGSMASYPSVGGGSANEN

SEQ ID NO: 9672 - protein, 320 aa, Arabidopsis thaliana
MVKATKAEKKIAYDTKLCQLIDEYTQILVVAADNVGSTQLQNIRKGLRGDSVVLMGKNTMMKRSVRIHSENTGNTAILNLLPLLQGNVGLIFTKGDLKEVSEEVAKYKVGAPARVGLVAPIDVVVQPGNTGLDPSQTSFFQVLNIPTKINKGTVEIITPVELIKQGDKVGSSEAALLAKLGIRPFSYGLVVQSVYDNGSVFSPEVLDLTEDQLVEKFASGISMVTSLALAVSYPTLAAAPHMFINAYKNALAIAVATEYTFPQAEKVKEYLKDPSKFAVASVAAVSADAGGGAPAAAKVEEKEESDEEDYGGDFGLFDEE

SEQ ID NO: 9673 - protein, 567 aa, Arabidopsis thaliana
MEGVRVPIACALILLAISSITSASIVEHTFNVQNLTVSRLCKRQVITVVNGSLPGPTIRVKEGDSLVIHVLNHSPHNITIHWHGIFHKLTVWADGPSMITQCPIQPGQRYAYRFNITGQEGTLWWHAHASFLRATVYGALVIRPKSGHSYPFPKPHKEVPILFGEWWNTDVVALEEAAIATGVPPNNSDAYTINGRPGNLYPCSKDRMFSLNVVKGKRYLLRIINAAMNIQLFFKIANHRLTVVAADAVYTAPYVTDVIVIAPGQTIDALLFADQSVDTSYYMAAHPYASAPAVPFPNTTTRGVIHYGGASKTGRSKPVLMPKLPSFFDTLTAYRFYSNLTALVNGPHWVPVPRYVDEEMLVTIGLGLEACADNTTCPKFSASMSNHSFVLPKKLSILEAVFHDVKGIFTADFPDQPPVKFDYTNPNVTQTNPGLLFTQKSTSAKILKFNTTVEVVLQNHALIAAESHPMHLHGFNFHVLAQGFGNYDPSRDRSKLNLVDPQSRNTLAVPVGGWAVIRFTANNPGAWIFHCHIDVHLPFGLGMIFVVKNGPTKSTTLPPPPPDLPKC

SEQ ID NO: 9674 - protein, 225 aa, Arabidopsis thaliana
MASNQQSYKAGETRGKAQEKTGQAMGTMRDKAEEGRDKTSQTAQTAQQKAHETAQSAKDKTSQTAQAAQQKAHETAQSAKEKTSQTAQTAQQKAHETTQAAKEKTSQAGDKAREAKDKAGSYLSETGEAIKNKAQDAAQYTKETAQGAAQYTKETAEAGRDKTGGFLSQTGEHVKQMAMGAADAVKHTFGMATEEEDKEHYPGSTTTTTATTRTTDPTHQTYQRK

SEQ ID NO: 9675 - protein, 245 aa, Arabidopsis thaliana
MAKVSFKDSLKALEADIQHANTVALDYPREKDGARVQMRLSYTPAAQFLLFLVQWTDCHLAGTLGLLRVLIYMTYADGKTTMSVYERKTSIKDFYAVIFPSLLQLERGITDLDDRKQKEVCKIRYRNKDETEKVKLSEIDIEREEECGICMEMNNMVVLPNCTHSLCIKCYRDWHGRSESCPFCRDSLKRVNSGDLWMLMEKSDTVNMYTIERENKKRLFVYIEKLPLVVPDQVFASSPYDCHVK

SEQ ID NO: 9676 - protein, 775 aa, Arabidopsis thaliana
METRCSLLFLSLILLYLPKPGSGFGSSGPIAASFGGSAFFCAIDASGRQDVICWGKNYSSPSSPSSSSSSSSIASSTSASYNIPSMAVLSGGDGFLCGILSNTSQAFCFSSLGSSSGMDLVPLAYRTTAYSQIAAGNSHVCAVRGAYYSDHDSGTIDCWEITRATNNNSLIAKENPNFYDQIVSNLVFNNIVSGDGFSCGGIRDGGMLCFGPNSSNLGFNTTSDNFQVLAAGKNSVCAILNLSREVKCWGEDESFVNSPMNDSRFVSLTAGPRHFCGIREDNHEVECWGNSNFSLIPKGSGFKAIASSDFIVCGIREEDLVLDCWMVNGSSTLAYDPPLELCSPGMCRAGPCNEKEFAFNASILNEPDLTSLCVRKELMVCSPCGSDCSHGFFLSSSCTANSDRICTPCSLCQNSSCSDICKLHNSNFPDKHWHQLQRLVLIIGSCASALLIIIIGCCVVPRIVTSPNKEDGAANQFKSCIGKPDLDTDQPLENVSPAPSVTPFAQVFRLSELKDATNGFKEFNELGRGSYGFVYKAVLADGRQVAVKRANAATIIHTNTREFETELEILCNIRHCNIVNLLGYSTEMGERLLVYEYMPHGTLHDHLHSGFSPLSWSLRIKIAMQTAKGLEYLHNEAEPRIIHGDVKSSNVLLDSEWVARVADFGLVTSSNEKNLDIKRDVYDFGVVLLEILTGRKRYDRDCDPPEIVEWTVPVIREGKAAAIVDTYIALPRNVEPLLKLADVAELCVREDPNQQPTMSELANWLEHVARDALIF

SEQ ID NO: 9677 - protein, 344 aa, Arabidopsis thaliana
MASSDFDGILLGMGNPLLDVSAVVDQQFLDKYDIKLNNAILAEDKHLPMYDEMSQKFNVEYIAGGATQNSIKVAQWMLQVPGATSYMGSIGKDKYGEAMKKDATAAGVYVHYYEDEATPTGTCGVCVLGGERSLIANLSAANCYKVEHLKKPENWALVEKAKFYYIAGFFLTVSPESIQLVREHAAANNKVFTMNLSAPFICEFFKDVQEKCLPYMDYIFGNETEARTFSRVHGWETDDVEQIAIKMSQLPKASGTYKRTTVITQGADPVVVAEDGKVKKYPVIPLPKEKLVDTNGAGDAFVGGFLSQLVHGKGIEECVRAGCYASNVVIQRSGCTYPEKPDFN

SEQ ID NO: 9678 - protein, 473 aa, Arabidopsis thaliana
MAMAKLAIFTTLMAILVMTSQGRIPTEGGEKEAEADRITSLPGQPNVTFEQFSGYVTVDKLSGRSLFYWLTEASDLPLSKPLVIWLNGGPGCSSVAYGASEEIGPFRISKGGSGLYLNKFAWNSISNLLFLEAPAGVGFSYTNRSSDLFNTGDRRTAKDSLQFLIQWLHRFPRYNHREIYITGESYAGHYVPQLAKEIMNYNKRSKNPLNLKGIMVGNAVTDNHYDNLGTVSYWWSHAMISDRTYHQLISTCDFSRQKESDECETLYSYAMEQEFGNIDQYNIYAPPCNKSSDGGGSYNGSSGRRSMRLPHLPHSVLRKISGYDPCTERYAEIYYNRPDVQKALHANTTKIPYKWTACSEVLNRNWNDTDSTVLPIYREMIAGGIRVWVFSGDVDSVVPVTATRYSLARLSLSTKLPWYPWYVKKQVGGWTEVYEGLTFVTVRGAGHEVPLFKPRAAFELFKYFLRGKPLPKA

SEQ ID NO: 9679 - protein, 250 aa, Arabidopsis thaliana
MGRGRVELKRIENKINRQVTFAKRRNGLLKKAYELSVLCDAEVSLIVFSNRGKLYEFCSTSNMLKTLERYQKCSYGSIEVNNKPAKELENSYREYLKLKGRYENLQRQQRNLLGEDLGPLNSKELEQLERQLDGSLKQVRCIKTQYMLDQLSDLQGKEHILLDANRALSMKLEDMIGVRHHHIGGGWEGGDQQNIAYGHPQAHSQGLYQSLECDPTLQIGYSHPVCSEQMAVTVQGQSQQGNGYIPGWML

SEQ ID NO: 9680 - protein, 414 aa, Arabidopsis thaliana
MKSSSSIFRETSEKKSERWMMMNIGRFSPFFLSSFCITLFFTGFFVYQNPFKSIADQNVLSFQPQIDPECDLFKGHWVPDKRGSLYTNSSCATIPDSKNCIKQGRPDKDFLFWRWKPDGCDLPRFNPKAFLSMVRGKKMNFIGDSVARNHMESLLCLLSMEETPKDIYKDGEDRNRIWYFPKHDFTLSTSWTKFLVEERERRDSNNTGTGLFDLDIGKIDEGWFNGLPNTDIAIVSAAHWFFRPIFIHRGDETLGCIYCNLPNMTQISPEEGFKLVYSAVLRQINECEMCKKDLVTVLRTISPAHFENGTWDTGGTCSRTSPFGENKIDLQSNEMKIRKSQIEQLEGITKRGNKAKKFAVLDVTRVMQMRPDGHPNGYWGNKWMKGYNDCVHWCLPGPIDAWNDFLMAIIRQLR

SEQ ID NO: 9681 - protein, 281 aa, Arabidopsis thaliana
MAADNAYLMQFVDETSFYNRIVLSHLLPANLWEPLPHFLQTWLRNYLAGTLLYFISGFLWCFYIYYLKINVYLPKDAIPTIKAMRLQMFVAMKAMPWYTLLPTVSESMIERGWTKCFASIGEFGWILYFVYIAIYLVFVEFGIYWMHRELHDIKPLYKYLHATHHIYNKQNTLSPFAGLAFHPVDGILQAVPHVIALFIVPIHFTTHIGLLFMEAIWTANIHDCIHGNIWPVMGAGYHTIHHTTYKHNYGHYTIWMDWMFGSLRDPLLEEDDNKDSFKKAE

SEQ ID NO: 9682 - protein, 279 aa, Arabidopsis thaliana
MAATMADYNDQIVNETSFYNRMVLSHLLPVNLWEPLPHFLQTWLRNYLAGNILYFISGFLWCFYIYYLKLNVYVPKESIPTRKAMLLQIYVAMKAMPWYTLLPAVSEYMIEHGWTKCYSTLDHFNWFLCFLYIALYLVLVEFMIYWVHKELHDIKFLYKHLHATHHMYNKQNTLSPFAGLAFHPLDGILQAIPHVIALFIVPIHLITHLSLLFLEGIWTASIHDCIHGNIWPIMGAGYHTIHHTTYKHNYGHYTIWMDWMFGSLMVPLAEKDSFKEKEK

SEQ ID NO: 9683 - protein, 963 aa, Arabidopsis thaliana
MGRRGRLEIQSGTCNVCSAPCSSCMHHNAEFSGSKSDESSDENSHGVLASQCSFNGDNLLRSSGVNAPGSSHNTSSEASHLVNSNHDTSSENAESKEIIRSSDISHGPLLDRPHKDQDSMKVDSCNDHQARSTLGQGKVKEKSGAKNNEEKKNTLTGSSKHSGPRVGKSGENVLLNKADESNTSAMSDSESENDPEMLELDVKVCDTCGDAGREDLLAICSRCSDGAEHTYCMRVMLKKVPKGYWLCEECKFAEKAEKHKLETKRKRESEVNVNTQISSKRHIDKFEAVPDSKRLAVGAQIGSPKRSVLPRMSTLSRETSFKGLEKPTRKLAHYSSFNSHSSDDTESTRSTDSQLQSPKGSFLKSNSFNSLSSRSKVRPVDDDMLPRQKTGNENSSLEVKEGFSKNVGKSMSSRCIDVGSSNCNDSKVKGSKQLKDWSTEANPSASISRGNSSIPYAKSPRDLKDLQSDGKQVGDSSKNEKCSSSEQISSEAKCKDELAQVDGVPRSREFREAGEKTKDAVGNHQKRNIGEDNNKGNRLRAAVDAALRKKPSFSKNRGLEQSDLPPVSNVDSGCNKALKCLSSKVPVIRDWPVGFQGLPGGHPNLRTDKQTNTVNEKQFTLAGTDATTASQSVEPEVNDPSVQSVMRDLPVAAPNVLSTTSAIPKPEYIWQGDLEVQKSRNLSAMHSGIQAYLSTLASPKVVEVVKQFPEKVTLNEVPRLSSWPAQFQDTGAKEQHVALFFFAKDIESYEKNYKPLVDNMIQKDLALKGNLEGVELLIFASNQLPQDCQRWNMLFFLWGVFRGKKESCSNPPKNTPLPASCVSPNRDTFRHENPSNKKSLTDRTLSRMQSCMKEEDAKEGKACSGTEKENAFSVSYGEGEVDVETEEGEIGVSPQLKYEKTAGPGTVKSADMNQRVNVDDLNKEGLCEGPANKKLKTVTGVETGCSIVRRDTSVHKFASRKFV

SEQ ID NO: 9684 - protein, 211 aa, Arabidopsis thaliana
MAAFTGTTDKCKACDKTVYVMDLMTLEGMPYHKSCFRCSHCNGTLVICNYSSMDGVLYCKTHFEQLFKESGNFSKNFQTAGKTEKSNDAAPNRLSSFFSGTQDKCAACKKTVYPLEKMTMEGESYHKTCFRCAHSGCPLTHSSYAALDGVLYCKVHFSQLFLEKGNYNHVLQAAANHRRSTAEEDKTEPKEDEANPTEEETSDAAAEEHES

SEQ ID NO: 9685 - protein, 299 aa, Arabidopsis thaliana
MGRTPCCDKIGLKKGPWTPEEDEVLVAHIKKNGHGSWRTLPKLAGLLRCGKSCRLRWTNYLRPDIKRGPFTADEEKLVIQLHAILGNRWAAIAAQLPGRTDNEIKNLWNTHLKKRLLSMGLDPRTHEPLPSYGLAKQAPSSPTTRHMAQWESARVEAEARLSRESMLFSPSFYSGVVKTECDHFLRIWNSEIGEAFRNLAPLDESTITSQSPCSRATSTSSALLKSSTNSWGGKEVTVAIHGSDYSPYSNDLEDDSTDSALQLLLDFPISDDDMSFLEENIDSYSQAPPIGLVSMVSKF

SEQ ID NO: 9686 - protein, 212 aa, Arabidopsis thaliana
MAEEQKIALESESPAKVTTPAPADTPAPAPAEIPAPAPAPTPADVTKDVAEEKIQNPPPEQIFDDSKALTVVEKPVEEPAPAKPASASLDRDVKLADLSKEKRLSFVRAWEESEKSKAENKAEKKIADVHAWENSKKAAVEAQLKKIEEQLEKKKAEYAERMKNKVAAIHKEAEERRAMIEAKRGEDVLKAEETAAKYRATGIVPKATCGCF

SEQ ID NO: 9687 - protein, 154 aa, Arabidopsis thaliana
MDLVQKQKSLQDYTKSLFLEGILDSQFLQLQQLQDESNPDFVSQVVTLFFQDSDRILNDLSLSLDQQVVDFKKVDPHVHQLKGSSSSIGAQRVKNACVVFRSFCEQQNVEACHRCLQQVKQEYYLVKNRLETLFKLEQQIVASGGMIPAVELGF

SEQ ID NO: 9688 - protein, 756 aa, Arabidopsis thaliana
MATLTDIGVAATINILTAFAFFIAFAILRLQPVNDRVYFPKWYLKGLRSSPIKTGGFASKFVNLDFRSYIRFLNWMPQALRMPEPELIDHAGLDSVVYLRIYLLGLKIFFPIACIAFTVMVPVNWTNSTLDQLKNLTFSDIDKLSISNIPTGSSRFWVHLCMAYVITFWTCFVLQREYKHIASMRLQFLASEHRRPDQFTVLVRNIPPDPDESVSELVEHFFKVNHPDYYLTYQAVYNANKLSELVQKRMKLQNWLDYYQNKHSRNPSKRPLIKIGFLGCWGEEVDAIDHYIEKIEGLTRKISEEKETVMSSTKSLVPAAFVSFKKRWGAVVCSQTQQSRNPTEWLTEWAPEPRDIYWDNLALPYVQLTIRRLVIAVAFFFLTFFFMIPIAFVQTLANIEGIEKAVPFLKPLIEVKTVKSFIQGFLPGIALKIFLIVLPSILMLMSKFEGFISKSSLERRCASRYYMFQFINVFLCSIIAGTALQQLDSFLNQSATEIPKTIGVSIPMKATFFITYIMVDGWAGVAGEILRLKPLIIYHLKNFFLVKTEKDREEAMDPGTIGFNTGEPQIQLYFILGLVYAAVSPILLPFILVFFALAYVVYRHQIINVYNQEYESAAAFWPDVHRRVVIALIVSQLLLMGLLSTKKAARSTPLLFILPVLTIGFHKFCQGRYQPIFVTYPLQDAMVKDTLERMREPNLNLKTFLQNAYAHPVFKAADNLANEMVVEEPAPDKTPDLVATKRGSRRFNSGSAETFT

SEQ ID NO: 9689 - protein, 170 aa, Arabidopsis thaliana
MGFPVGYTEVFLPKLFVQTLSILGFIRTIVFSIFRFLGLSDFLEMDQTWPDYTSYPTRIPETRSPFSALLIREILPVIKFEELTNSGEDLPENCAVCLYEFEGEQEIRWLRNCRHIFHRSCLDRWMDHDQKTCPLCRTPFVPDEMQEEFNQRLWAASGVHDFHCPVTELL

SEQ ID NO: 9690 - protein, 506 aa, Arabidopsis thaliana
MDSSPNDGVHQPLLHPQPSPSPPESTNGELETVLSDVETPLFLRLRKATIIESKLLFNLAAPAVIVYMINYLMSMSTQIFSGHLGNLELAAASLGNTGIQVFAYGLMLGMGSAVETLCGQAYGGRKYEMLGVYLQRSTVLLTLTGLLLTLIYVFSEPILLFLGESPAIASAASLFVYGLIPQIFAYAANFPIQKFLQSQSIVAPSAYISTATLFVHLLLSWLAVYKLGMGLLGASLVLSLSWWIIVVAQFVYIVTSERCRETWRGFSVQAFSGLWSFFKLSAASAVMLCLETWYFQILVLLAGLLENPELALDSLSICMTISGWVFMISVGFNAAISVRVSNELGAGNPKSAAFSVIIVNIYSLITCVILAIVILACRDVLSYAFTEGKEVSDAVSDLCPLLAVTLVLNGIQPVLSGVAVGCGWQTFVAKVNVGCYYIIGIPLGALFGFYFNFGAKGIWTGMIGGTVIQTFILAWVTFRTDWTKEVEEASKRLDKWSNKKQEVVPE

SEQ ID NO: 9691 - protein, 364 aa, Arabidopsis thaliana
MEPKCDHCATSQALIYCKSDLAKLCLNCDVHVHSANPLSHRHIRSLICEKCFSQPAAIRCLDEKVSYCQGCHWHESNCSELGHRVQSLNPFSGCPSPTDFNRMWSSILEPPVSGLLSPFVGSFPLNDLNNTMFDTAYSMVPHNISYTQNFSDNLSFFSTESKGYPDMVLKLEEGEEDLCEGLNLDDAPLNFDVGDDIIGCSSEVHIEPDHTVPNCLLIDKTNTSSFTGSNFTVDKALEASPPGQQMNINTGLQLPLSPVLFGQIHPSLNITGENNAADYQDCGMSPGFIMSEAPWETNFEVSCPQARNEAKLRYKEKKLKRSFGKQIRYASRKARADTRKRVKGRFVKAGDSYDYDPSSPTTNN

SEQ ID NO: 9692 - protein, 273 aa, Arabidopsis thaliana
MSFVFRGSRGDLESGFSGGFLPERRAMRVHGARPVNSNSLAFLVTVLLLFMILNSHQMPPNFLLWLVLGVFLMATTLRMYATCQQLQAHAQAQAAAASGLFSHTELRLHVPPSIALATRGRLQGLRLQLALLDREFDDLDYETLRALDSDNVSTTSMSEEEINALPVHKYKVLDPENGCSLAKQASTSSSAEKMLDSANESKKGTEDELTCSVCLEQVTVGEIVRTLPCLHQFHAGCIDPWLRQQGTCPVCKFRAHSGWQEQDEIDDDASDMV

SEQ ID NO: 9693 - protein, 269 aa, Arabidopsis thaliana
MASSRFQSGFCPISSCPSLENFIERIKDACRFTLSAVLGTILSAVLTFFFALELRKLFPSSVGTLLGALTGALIGQETESGFIRGAAVGAISGAVFSIEIDVIVSLISGRLVRERIGPAMLSAVQTMRSPLIIFISLLTDQMGAVDSTFEELSSIFDTGGSKGLTGDLVDKIPKIKITGKNNLDASGNKDSCSVCLQVFCSFQLKRNLNSPNAEPKGLVLDLLLCNFLQDFQLGETVRSLPHCHHMFHLPCIDNWLFRHGSCPMCRRDL

SEQ ID NO: 9694 - protein, 161 aa, Arabidopsis thaliana
MADSDNDSGGHKDGGNASTREQDRFLPIANVSRIMKKALPANAKISKDAKETVQECVSEFISFITGEASDKCQREKRKTINGDDLLWAMTTLGFEDYVEPLKVYLQKYREVEGEKTTTAGRQGDKEGGGGGGGAGSGSGGAPMYGGGMVTTMGHQFSHHFS

SEQ ID NO: 9695 - protein, 772 aa, Arabidopsis thaliana
MATLKDIGVSAGINILTAFIFFIIFAFLRLQPFNDRVYFSKWYLRGLRSSPASGGGFAGRFVNLELRSYLKFLHWMPEALKMPERELIDHAGLDSVVYLRIYWLGLKIFAPIAMLAWAVLVPVNWTNNELELAKHFKNVTSSDIDKLTISNIPEGSNRFWAHIIMAYAFTIWTCYMLMKEYETVANMRLQFLASEGRRPDQFTVLVRNVPPDPDETVSELVEHFFLVNHPDNYLTHQVVCNANKLADLVSKKTKLQNWLDYYQLKYTRNNSQIRPITKLGCLGLCGQKVDAIEHYIAEVDKTSKEIAEERENVVNDQKSVMPASFVSFKTRWAAAVCAQTTQTRNPTEWLTEWAAEPRDIYWPNLAIPYVSLTVRRLVMNVAFFFLTFFFIIPIAFVQSLATIEGIEKVAPFLKVIIEKDFIKSLIQGLLAGIALKLFLIFLPAILMTMSKFEGFTSVSFLERRSASRYYIFNLVNVFLGSVIAGAAFEQLNSFLNQSPNQIPKTIGMAIPMKATFFITYIMVDGWAGVAGEILMLKPLIIYHLKNAFLVKTEKDREEAMNPGSIGFNTGEPQIQLYFLLGLVYAPVTPMLLPFILVFFALAYVVYRHQIINVYNQEYESAAAFWPDVHGRVITALIISQLLLMGLLGTKHAASAAPFLIALPVITIGFHRFCKGRFEPAFVRYPLQEAMMKDTLERAREPNLNLKGYLQDAYIHPVFKGGDNDDDGDMIGKLENEVIIVPTKRQSRRNTPAPSRISGESSPSLAVINGKEV

SEQ ID NO: 9696 - protein, 266 aa, Arabidopsis thaliana
MAAMQLTRTALVGLSKAFPGIKAPATLAASSRKVSRICFATSVSQNEGRDPLDNARDSRADSAYGSKKWREDTGEYYAQAAKDKANEGASKAADKAYETKEQAKDKAYETKEKAKDTAYNAKEKAKDYAERTKDKVNEGAYKAADKAEDTKEKAKDYAEDTMDNAKEKARHAKEKVKEYGEDTKEKAEGFKETVKGKAEELGEKTKETVKGAWESTKNAAQTVTEAVVGPEEDAEKARADMNKGVEDHRKKKAEKDQKEDDFITFN

SEQ ID NO: 9697 - protein, 390 aa, Arabidopsis thaliana
MTKNSNHDENEFISFEPNQNTKIRFEDADEDEVAEGSGVAGEETPQDESMFDAGESADTAEVTDDTTSADYYFDSYSHFGIHEEMLKDVVRTKTYQNVIYQNKFLIKDKIVLDVGAGTGILSLFCAKAGAAHVYAVECSQMADMAKEIVKANGFSDVITVLKGKIEEIELPTPKVDVIISEWMGYFLLFENMLDSVLYARDKWLVEGGVVLPDKASLHLTAIEDSEYKEDKIEFWNSVYGFDMSCIKKKAMMEPLVDTVDQNQIVTDSRLLKTMDISKMSSGDASFTAPFKLVAQRNDYIHALVAYFDVSFTMCHKLLGFSTGPKSRATHWKQTVLYLEDVLTICEGETITGTMSVSPNKKNPRDIDIKLSYSLNGQHCKISRTQHYKMR

SEQ ID NO: 9698 - protein, 484 aa, Arabidopsis thaliana
MKHSGGNQACYVLGQKTPSIRDLYSLGHKLGQGQFGTTYMCKEISTGREYACKSITKRKLISKEDVEDVRREIQIMHHLAGYKNIVTIKGAYEDPLYVHIVMELCSGGELFDRIIQRGHYSERKAAELIKIIVGVVEACHSLGVMHRDLKPENFLLVNKDDDFSLKAIDFGLSVFFKPGQIFEDVVGSPYYVAPEVLLKHYGPEADVWTAGVILYILVSGVPPFWAETQQGIFDAVLKGHIDFDSDPWPLISDSAKNLIRGMLCSRPSERLTAHQVLRHPWICENGVAPDRALDPAVLSRLKQFSAMNKLKQMALRVIAESLSEEEIAGLKEMFKAMDTDNSGAITFDELKAGLRRYGSTLKDTEIRDLMEAADIDKSGTIDYGEFIAATIHLNKLEREEHLLSAFRYFDKDGSGYITIDELQHACAEQGMSDVFLEDVIKEVDQDNDGRIDYGEFVAMMQKGIVGRTMRKSINMSIRNNAVSQ

SEQ ID NO: 9699 - protein, 431 aa, Arabidopsis thaliana
MIRSSIVILSLLLISHLVSAKVLLIGNSTSLSFDDVEATFTPMIKRSDQGGVLYVAEPLDACSDLVNTVNVKNGTTVSPPYVLIIRGGCSFEDKIRNAQKAGYKAAIVYDYEDFGFLVSTTGEVLKEYAGRTDFEVWLMPSFETSAWSIMAISFISLLAMSAVLATCFFVRRHRVRRRRILALNGNDFHRMPKSMIIRMPTTIFNGICDEATTSILCCICLENYEKGDKLRILPCHHKFHVACVDLWLGQRKSFCPVCKRDARSISTDKPPSEHTPFLSRTPSMTPTSSFLLSSSSTTPLQSSHELPISIRVDPSLPSTSMQPHTVPMYLSHSRSHTSFQNGSNRFSRPIPVSRSSADLRNAVSQRSYNSPHQVSLPRFLHSRYTHILGPGNASRSQVVGLLTSQREHSLHQNDSRRSFIHFASASSLPGW

SEQ ID NO: 9700 - protein, 266 aa, Arabidopsis thaliana
MQKREFMELFEAALRAAKSVKGDENSPEVSRFVDAMNRLKEAPKSLVCDVVCKTSMGQGLEFFIDHKNPKIRSEGRILRDLWMKFFYASGREKSRDNREAAVKIPTHATMKKTGDSKRDKVREILQTSLAKVASEVVDTEMKTRVTACDPWVVAVSVETAMFENLGCFMGPQKAKYRSILFNMGDSNNPDLRRKVLLGEISGERLVKMEKEEMGSSWYTNSRRNPLYESTHYTDFRFPQIKAHLWHKVRVFSLFTYILERTKRSFT

SEQ ID NO: 9701 - protein, 483 aa, Arabidopsis thaliana
MEDIQEEENGTDEEVLGSSLTMEKVAAAKQYIENHYKAQNKNIQERKERRWILERKLASSGVPKEEQINMIKDLERKETEFMRLKRNKISVDDFELLTIIGRGAFGEVRLCRERKSGNIYAMKKLKKSEMVMRGQVEHVRAERNLLAEVESHYIVKLYYSFQDPEYLYLIMEYLPGGDMMTLLMREDTLREDVARFYIAQSVLAIESIHRYNYIHRDIKPDNLLLDKDGHMKLSDFGLCKPLDCRNLPSIQENRATDDETMSEPMDVDRCFPDTDNKRSWRSPQEQLQHWQMNRRKLAFSTVGTPDYIAPEVLLKKGYGMECDWWSLGAIMYEMLVGYPPFYADDPISTCRKIVHWRNHLKFPEDAKFSSEAKDLICRLLCNVDHRLGTGGGAQQIKDHPWFKDVVWEKLYEMEAAYKPEVNDELDTQNFMKFDEVNSPAPERTRSGLSRKMLLAPKDLSFVGYTYKNFDAVKGLRHSLGKFT

SEQ ID NO: 9702 - protein, 360 aa, Arabidopsis thaliana
MGSNEEGNPTNNSDKPSQAAAPEQSNVHVYHHDWAAMQAYYGPRVGIPQYYNSNLAPGHAPPPYMWASPSPMMAPYGAPYPPFCPPGGVYAHPGVQMGSQPQGPVSQSASGVTTPLTIDAPANSAGNSDHGFMKKLKEFDGLAMSISNNKVGSAEHSSSEHRSSQSSENDGSSNGSDGNTTGGEQSRRKRRQQRSPSTGERPSSQNSLPLRGENEKPDVTMGTPVMPTAMSFQNSAGMNGVPQPWNEKEVKREKRKQSNRESARRSRLRKQAETEQLSVKVDALVAENMSLRSKLGQLNNESEKLRLENEAILDQLKAQATGKTENLISRVDKNNSVSGSKTVQHQLLNASPITDPVAAS

SEQ ID NO: 9703 - protein, 376 aa, Arabidopsis thaliana
MSAESCFGSSGDQSSSKGVATHGGSYVQYNVYGNLFEVSRKYVPPLRPIGRGAYGIVCAATNSETGEEVAIKKIGNAFDNIIDAKRTLREIKLLKHMDHENVIAVKDIIKPPQRENFNDVYIVYELMDTDLHQIIRSNQPLTDDHCRFFLYQLLRGLKYVHSANVLHRDLKPSNLLLNANCDLKLGDFGLARTKSETDFMTEYVVTRWYRAPELLLNCSEYTAAIDIWSVGCILGETMTREPLFPGKDYVHQLRLITELIGSPDDSSLGFLRSDNARRYVRQLPQYPRQNFAARFPNMSAGAVDLLEKMLVFDPSRRITVDEALCHPYLAPLHDINEEPVCVRPFNFDFEQPTLTEENIKELIYRETVKFNPQDSV

SEQ ID NO: 9704 - protein, 349 aa, Arabidopsis thaliana
MTFLKMKSLSFFFTILLSLSTLFTISNARKFNVGGSGAWVTNPPENYESWSGKNRFLVHDTLYFSYAKGADSVLEVNKADYDACNTKNPIKRVDDGDSEISLDRYGPFYFISGNEDNCKKGQKLNVVVISARIPSTAQSPHAAAPGSSTPGSMTPPGGAHSPKSSSPVSPTTSPPGSTTPPGGAHSPKSSSAVSPATSPPGSMAPKSGSPVSPTTSPPAPPKSTSPVSPSSAPMTSPPAPMAPKSSSTIPPSSAPMTSPPGSMAPKSSSPVSNSPTVSPSLAPGGSTSSSPSDSPSGSAMGPSGDGPSAAGDISTPAGAPGQKKSSANGMTVMSITTVLSLVLTIFLSA

SEQ ID NO: 9705 - protein, 595 aa, Arabidopsis thaliana
MDSVSSSSFLSSTFSLHHSLLRRRSSSPTLLRINSAVVEERSPITNPSDNNDRRNKPKTLHNRTNHTLVSSPPKLRPEMTLATALFTTVEDVINTFIDPPSRPSVDPKHVLSDNFAPVLDELPPTDCEIIHGTLPLSLNGAYIRNGPNPQFLPRGPYHLFDGDGMLHAIKIHNGKATLCSRYVKTYKYNVEKQTGAPVMPNVFSGFNGVTASVARGALTAARVLTGQYNPVNGIGLANTSLAFFSNRLFALGESDLPYAVRLTESGDIETIGRYDFDGKLAMSMTAHPKTDPITGETFAFRYGPVPPFLTYFRFDSAGKKQRDVPIFSMTSPSFLHDFAITKRHAIFAEIQLGMRMNMLDLVLEGGSPVGTDNGKTPRLGVIPKYAGDESEMKWFEVPGFNIIHAINAWDEDDGNSVVLIAPNIMSIEHTLERMDLVHALVEKVKIDLVTGIVRRHPISARNLDFAVINPAFLGRCSRYVYAAIGDPMPKISGVVKLDVSKGDRDDCTVARRMYGSGCYGGEPFFVARDPGNPEAEEDDGYVVTYVHDEVTGESKFLVMDAKSPELEIVAAVRLPRRVPYGFHGLFVKESDLNKL

SEQ ID NO: 9706 - protein, 365 aa, Arabidopsis thaliana
MMKEEQWAPVIVMLISSVAMGSVNALVKKALDVGVNHMIFGAYRMAISALILVPFSYIWERKTRPQLTFMLLCEHFISGLLGASLMQFFFLLGLSYTSATVSMALVSMLPAITFALALIFRIENAQNLKSKAGVLKVMGTLICIMGAMLLTFYKGPELSNPHSHPQARHNNNNNNGHDQTKKWLLGCLYLVIGTVLLSLWMLFQGKLSFKYPGNKYSSTCLMSVFASFQCAILSLYKSRDVKDWIIEDKFVILVTLYAGIVGQAMSTVVTSWSIKMTGAVFVSTFSPVSLVAATLFDFLILHSPLYLGSILGSVVTITGLYVFLWGRKNETDQSVSKTLNSSQFSQNKDNEDHTIANHKDTNLPV

SEQ ID NO: 9707 - protein, 365 aa, Arabidopsis thaliana
MGYCDGKWTPVIIMVMINSALGLANALVKKVLDGGVNHMVIATYRLAISTLFLAPIAFFWERKTRPTLTLNILVQLFFSALVGASLTQYFFLLGLSYTSATLACAFISMTPAITFVMALIFRVEKLNMKSKAGMGMVMGALICIGGALLLTMYKGVPLTKLRKLETHQLINNNHAMKPENWIIGCVLLFAGSSCFGSWMLIQAKVNEKYPCQYSSTVVLSFFGTIQCALLSLIKSRDITAWILTDKLDIVTIVYAGAVAQGICTVGTSWCIRKRGPIFTSIFTPVGLIFATLFDFLILHRQIFLGSVVGSGVVIFGLYIFLLGKVRLMKEECEKKLPCRFNEDDQEEDDDEQYKKGHLMVVPMTP

SEQ ID NO: 9708 - protein, 361 aa, Arabidopsis thaliana
MGFIDGKWAPMIVLIVSNMIAGMVNALVKKVLDGGINHMVIATYRLGISTLFLLPVAYFWERKTRPKLTLSISCQLFVSALFGASLMQYFYLLGLSYTSATLGSAFWAIMPSLTFVMALIFGFEKLSLKTKIGYGVVLGTLISLVGGLLLTMYQGIPLTNSPEQAANSNNHTGHENWIKGCFFLLTGVVLFSSWMLIQAKINVKYPCPYSSTVILSVFGTLQCALLSLIKTRHLEDWILRDELTIITVVIAGVVAQGMCTVGMSWCIKQQGPVVSSSFSPVVLMSATVFDFLILHREIYLGSVIGSVVVVIGLYIFLWSRSKQIVECKIMKLPTNTVEEEKEEEGRTNVNNGQLLVIPMTP

SEQ ID NO: 9709 - protein, 373 aa, Arabidopsis thaliana
MAEAIGAVSLVGHRPSIVRITVKNELKTQKSQSIVRFPVKVDYSAKGVLSHLMTQSVKKNRMSVFPIRALAMELTKEKKKDDRLPKTWNYLDSGADDKPSLWPPENKADKPSLHNPLLRQERMGCGWLGAIFEWEGVLIEDNPDLDNQSWLTLAQEEGKSPPPAFMLRRVEGMKNEQAISEVLCWSRDPVQVRRMAKRKEEIFKALHGGVYRLRDGSQEFVNVLMNNKIPMALVSTRPRETLENAVGSIGIRKFFSVIVASEDVYRGKPDPEMFIYAAQLLDFIPERCIVFGNSNQTIEAAHDGRMKCVAVASKHPIYELGAAELVVRRLDELSIIDLKKLADTDLTEFEPELEMEKEDERELPSSAVAVDDF

SEQ ID NO: 9710 - protein, 333 aa, Arabidopsis thaliana
MTKVESTSGEVSEWADLNKDILELIFNKLDVMDITMGASRVCISWFLASHNKTLWNTVDLTNLQELDVSRIFNFKDKERPIFFYKHPVDHKHGLTNLLTKIISRFFLDFFEVEGSISLMNLLVEISKLSRMAPKNLFFNFNSYIQENGLKFAAEKMPNIEKLALPIWCYQNEKSLRFAFSQWKNLKTLIIAHEHSFSGRFDFKAVGESCSNLTNLKYLGRLEEYTSREIVSYLHSLKRLSLRCFLVSSIAVYRFITGLPNLTILNVSHCKNPYDYFLPIAKSIDNYVITAATQKLEKFITCPHDCMICKDRCRYSLSYLAEVWRNDEIKELEF

SEQ ID NO: 9711 - protein, 327 aa, Arabidopsis thaliana
METDSMECVSSTGNEIHQNGNGHQSYQFSSTKTHGGAAAAAVVTNIVGPTATAPATSVYELLECPVCTYSMYPPIHQCHNGHTLCSTCKVRVHNRCPTCRQELGDIRCLALEKVAESLELPCKFYNLGCPEIFPYYSKLKHESLCNFRPYSCPYAGSECGIVGDIPFLVAHLRDDHKVDMHAGSTFNHRYVKSNPREVENATWMLTVFHCFGQYFCLHFEAFQLGMGPVYMAFLRFMGDEEDARSYSYSLEVGGSGRKLTWEGTPRSIRDSHRKVRDSNDGLIIQRNMALFFSGGDRKELKLRVTGKIWKEQHSPDSGLSIPNLSSS

SEQ ID NO: 9712 - protein, 221 aa, Arabidopsis thaliana
MVRGKTEMKRIENATSRQVTFSKRRNGLLKKAFELSVLCDAEVALIIFSPRGKLYEFSSSSSIPKTVERYQKRIQDLGSNHKRNDNSQQSKDETYGLARKIEHLEISTRKMMGEGLDASSIEELQQLENQLDRSLMKIRAKKYQLLREETEKLKEKERNLIAENKMLMEKCEMQGRGIIGRISSSSSTSELDIDDNEMEVVTDLFIGPPETRHFKKFPPSN

SEQ ID NO: 9713 - protein, 196 aa, Arabidopsis thaliana
MAASMTKPISITSLGFYSDRKNIAFSDCISICSGFRHSRPSCLDLVTKSPSNNSRVLPVVSAQISSDYIPDSKFYKVEAIVRPWRIQQVSSALLKIGIRGVTVSDVRGFGAQGGSTERHGGSEFSEDKFVAKVKMEIVVKKDQVESVINTIIEGARTGEIGDGKIFVLPVSDVIRVRTGERGEKAEKMTGDMLSPS

SEQ ID NO: 9714 - protein, 547 aa, Arabidopsis thaliana
MEWWLNGGVWMMMMTTTIISFVKAEDTLFYNWRVTYGKIALDTLPRRGILINGQFPGPEIRSLTNDNLVINVQNDLDDPFLLSWNGVHMRKNSYQDGVYGTNCPIPPGKNYTYDFQVKDQVGSYFYFPSLAVQKAAGGYGSLRIYSLPRIPVPFPEPAEDFTFLVNDWYRRNHTTLKKILDGGRKLPLMPDGVMINGQGVSTVYSITVDKGKTYRFRVSNVGLQTSLNLEILGHQLKLIEVEGTHTVQTMYTSLDIHVGQTYSFLVTMDQPPQNYSIVVSTRFINAEVVIRATLHYSNSKGHKIITARRPDPDDVEWSIKQAQSIRTNLTASGPRTNPQGSYHYGKMKISRTLILESSAALVKRKQRYAINGVSFVPSDTPLKLADHFKIKDVFKVGTIPDKPRRGGGIRLDTAVMGAHHNAFLEIIFQNREKIVQSYHLDGYNFWVVGINKGIWSRASRREYNLKDAISRSTTQVYPKSWTAVYVALDNVGMWNLRSQFWARQYLGQQFYLRVHSPNHSPKDEYPLPKNALLCGRASNKNMSIITP

SEQ ID NO: 9715 - protein, 361 aa, Arabidopsis thaliana
MAMLVDPPNGIRQEGKHYYTMWQTLFEIDTKYVPIKPIGRGAYGVVCSSINSETNERVAIKKIHNVFENRIDALRTLRELKLLRHVRHENVISLKDVMLPTHRYSFRDVYLVYELMDSDLNQIIKSSQSLSDDHCKYFLFQLLRGLKYLHSANILHRDLKPGNLLVNANCDLKICDFGLARTYEQFMTEYVVTRWYRAPELLLCCDNYGTSIDVWSVGCIFAEILGRKPIFPGTECLNQLKLIINVVGSQQDWDLQFIDNQKARRFIKSLPFSKGTHFSHIYPHANPLAIDLLQRMLVFDPTKRISVSDALLHPYMEGLLEPECNPSENVPVSSLEIDENMEGDMIREMMWEEMLHYLPRA

SEQ ID NO: 9716 - protein, 374 aa, Arabidopsis thaliana
MAFDLPNDFRCPISLEIMSDPVILQSGHTFDRVSIQQWIDSGNRTCPITKLPLSETPYLIPNHALRSLILNFAHVSLKESSRPRTQQEHSHSQSQALISTLVSQSSSNASKLESLTRLVRLTKRDSSIRRKVTESGAVRAALDCVDSCNQVLQEKSLSLLLNLSLEDDNKVGLVADGVIRRIVTVLRVGSPDCKAIAATLLTSLAVVEVNKATIGSYPDAISALVSLLRVGNDRERKESATALYALCSFPDNRKRVVDCGSVPILVEAADSGLERAVEVLGLLVKCRGGREEMSKVSGFVEVLVNVLRNGNLKGIQYSLFILNCLCCCSGEIVDEVKREGVVEICFGFEDNESEKIRRNATILVHTLLGIPMSS

SEQ ID NO: 9717 - protein, 206 aa, Arabidopsis thaliana
MEPKLTHLCYCLLLFLPLLCQSTIAKPSSSPNPSSSINFIVSSCRVTRYQTLCVKCLAAFADKIRRNENQLAQTALAVTLVRVQSTTIYVGKLTKARRIKRREYLAVKDCVENLGDGLEMLAQSMRELKQVGRSGRDRDEFLWRLSNVETWVSAALTDETTCLDGFDGKVMDGVVKSAIRRRVVHVARVTSNALALVNRFAARHKS

SEQ ID NO: 9718 - protein, 587 aa, Arabidopsis thaliana
MDLFKILLLVFFVNISFCFAADPYSFYNFEVSYITASPLGVPQQVIAINGKFPGPTINVTTNENLVVNVRNKLDEGLLLHWNGIQQRRVSWQDGVLGTNCPIPPKWNWTYEFQVKDQIGSFFYFPSLHFQRASGGFGSFVVNPRAIIPVPFSTPDGDITVTIGDWYIRNHTALRKALDDGKDLGMPDGVLINGKGPYRYNDTLVADGIDFETITVHPGKTYRLRVSNVGISTSLNFRIQGHNLVLAESEGSYTVQQNYTSLDIHVGQSYSFLVTMDQNASSDYYIVASARVVNETIWRRVTGVGILKYTNSKGKAKGQLPPGPQDEFDKTFSMNQARSIRWNVSASGARPNPQGSFKYGSINVTDVYVLRNMPPVTISGKRRTTLNGISFKNPSTPIRLADKLKVKDVYKLDFPKRPLTGPAKVATSIINGTYRGFMEVVLQNNDTKMQSYHMSGYAFFVVGMDYGEWTENSRGTYNKWDGIARSTIQVYPGAWSAILISLDNPGAWNLRTENLDSWYLGQETYVRVVNPDENNKTEFGHPDNVLYCGALSKLQKPQKVSSSASKSIGFTSLSMVVMALVMMMMLQH

SEQ ID NO: 9719 - protein, 284 aa, Arabidopsis thaliana
MTAVTAAQRSVPAPFLSKTYQLVDDHSTDDVVSWNEEGTAFVVWKTAEFAKDLLPQYFKHNNFSSFIRQLNTYGFRKTVPDKWEFANDYFRRGGEDLLTDIRRRKSVIASTAGKCVVVGSPSESNSGGGDDHGSSSTSSPGSSKNPGSVENMVADLSGENEKLKRENNNLSSELAAAKKQRDELVTFLTGHLKVRPEQIDKMIKGGKFKPVESDEESECEGCDGGGGAEEGVGEGLKLFGVWLKGERKKRDRDEKNYVVSGSRMTEIKNVDFHAPLWKSSKVCN

SEQ ID NO: 9720 - protein, 960 aa, Arabidopsis thaliana
MTSMIVKTTPELFKGNGVFRTDHLGENRMVSRSNRLGDGSNRFPRTGTIHCQRLSIAKTGLHRETKARAILSPVSDPAASIAQKLGGKGANLAEMASIGLSVPPGLTISTEACQQYQIAGKKLPEGLWEEILEGLSFIERDIGASLADPSKPLLLSVRSGAAISMPGMMDTVLNLGLNDQVVVGLAAKSGERFAYDSFRRFLDMFGDVVMGIPHAKFEEKLERMKERKGVKNDTDLSAADLKELVEQYKSVYLEAKGQEFPSDPKKQLELAIEAVFDSWDSPRANKYRSINQITGLKGTAVNIQCMVFGNMGDTSGTGVLFTRNPSTGEKKLYGEFLVNAQVWHLSQCVNLISTRIRTPEDLDTMKRFMPEAYAELVENCNILERHYKDMMDIEFTVQEERLWMLQCRAGKRTGKGAVKIAVDMVGEGLVEKSSAIKMVEPQHLDQLLHPQFHDPSGYREKVVAKGLPASPGAAVGQVVFTAEEAEAWHSQGKTVILVRTETSPDDVGGMHAAEGILTARGGMTSHAAVVARGWGKCCIAGCSEIRVDENHKVLLIGDLTINEGEWISMNGSTGEVILGKQALAPPALSPDLETFMSWADAIRRLKVMANADTPEDAIAARKNGAQGIGLCRTEHMIVCIQMFNVVFGLVFKFFGADRIKAVRKMIMAVTTEQRKASLDILLPYQRSDFEGIFRAMDGLPVTIRLLDPPLHEFLPEGDLDNIVHELAEETGVKEDEVLSRIEKLSEVNPMLGFRGCRLGISYPELTEMQARAIFEAAASMQDQGVTVIPEIMVPLVGTPQELGHQVDVIRKVAKKVFAEKGHTVSYKVGTMIEIPRAALIADEIAKEAEFFSFGTNDLTQMTFGYSRDDVGKFLPIYLAKGILQHDPFEVLDQQGVGQLIKMATEKGRAARPSLKVGICGEHGGDPSSVGFFAEAGLDYVSCSPFRVPIARLAAAQVVVA

SEQ ID NO: 9721 - protein, 1094 aa, Arabidopsis thaliana
MGISARIFAGHLGSTQLAAASIGNSSFSLVYALMLGMGSAVETLCGQAYGAHRYEMLGIYLQRATIVLALVGFPMTILYTFSYPILLLLGEPKTVSYMGSLYIAGLIPQIFAYAVYFTAQKFLQAQSVVAPSAYISAAALVLQISLTWITVYAMGQGLMAQTFYVITSVRFKDTWTGFSWKSLHGLWSFFKLSAGSAVMICLELWYTQILVLLAGLLKDPALSLDSLSICMSISALSFMVSVGFNAAVSVRTSNELGAGNPKSALFSTWTATFVSFVISVVEALVVIASRDNVSYIFTSDADVAKAVSDLCPFLAVTIILNGIQPVLSGVAVGCGWQTYVAYVNIGCYYIVGIPIGCILGFTFNFQAKGIWTGMIGGTLMQTLILLYVTYQADWDKEQNELSNEIEKTFIAFFIALRRPALSLSNSLTHPSQVSFFYHYCFRIPSGVRVSSSTFANAKLVTLRNHTVNLHIYYCSMAGTDNRRSRHDDESPKNPNKKKKGNRNPEKSLLINLHSCSKRKDLSAALALYDAAITSSDIRLNQQHFQSLLYLCSAFISDPSLQTVAIDRGFQIFDRMVSSGISPNESSVTAVARLAAAKGDGDYAFKLVKDLVAVGGVSVPRLRTYAPALLCFCDTLEAEKGYEVEDHMDASGIVLEEAEISALLKKLRECVGCVSEETSKAIEEWFYGVKASEVSDNGIGSDIELLRAAVLKNGGGWHGLGWVGEGKWIVKKGNVSSAGKCLSCDEHLACVDTNEVETEDFVNSLVTLAMERKAKMNSCEPMADFSEFQEWLEKHGDYEAILDGANIGLYQQNFADGGFSLPQILSQFSTKRLTYDISKRFFLFGWKRLNQQNQDIMNSPPPSSNDGLAKRKRGRPRKDENSTPKPDMNLVGKVVTGVIEGSFDAGYLLNVKVKDSDTQLRGLVFIRGRVTPITPENDVAPLVKMYGREDIKNNQTDHSFPTDQPMQDAAVTTTDMDISESSRALVVVPQATNGQAKEATKDEDGVIEGQADTRLVEFFPTPGTMMMTAQPNLVLVPKETEQQKTTGGSHGFDLMEEEPVRQGEKLPEELLHLELGNKTTLSVDNNISTTEAPDL

SEQ ID NO: 9722 - protein, 717 aa, Arabidopsis thaliana
MASSAFAFPSYIITKGGLSTDSCKSTSLSSSRSLVTDLPSPCLKPNNNSHSNRRAKVCASLAEKGEYYSNRPPTPLLDTINYPIHMKNLSVKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAVGRDLKGKNNNVVAVIGDGAMTAGQAYEAMNNAGYLDSDMIVILNDNKQVSLPTATLDGPSPPVGALSSALSRLQSNPALRELREVAKGMTKQIGGPMHQLAAKVDEYARGMISGTGSSLFEELGLYYIGPVDGHNIDDLVAILKEVKSTRTTGPVLIHVVTEKGRGYPYAERADDKYHGVVKFDPATGRQFKTTNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEADLFNMVATAVAIDDRPSCFRYPRGNGIGVALPPGNKGVPIEIGKGRILKEGERVALLGYGSAVQSCLGAAVMLEERGLNVTVADARFCKPLDRALIRSLAKSHEVLITVEEGSIGGFGSHVVQFLALDGLLDGKLKWRPMVLPDRYIDHGAPADQLAEAGLMPSHIAATALNLIGAPREALF

SEQ ID NO: 9723 - protein, 541 aa, Arabidopsis thaliana
MRGSCKVSIVLLLVLINGVLGDNPYRFFTWKITYGDIYPLGVKQQGILINGQFPGPHIDAITNDNIIISVFNYLKEPFLISWNGVQQRKNSWQDGVVGTTCPIPPGKNFTYVIQVKDQIGSFYYFPSLAFHKAAGAFGAIRVWSRPRIPVPFSPPDGDFWLLAGDWYKTNHYVLRRLLEAGRNLPNPDGVLINGRGWGGNTFTVQPGKTYRFRISNVGVATSLNFRIQGHTMKLVEVEGSHTVQNIYTSLDIHLGQSYSVLVTANQAPQDYYIVISSRFTRKVLTTTSILHYSNSRKGVSGPVPNGPTLDIASSLYQARTIRRNLTASGPRPNPQGSYHYGLIKPGRTIILANSAPWINGKQRYAVNGASFVAPDTPLKLADYFKIPGVFNLGSIPTSPSGGNGGYLQSSVMAANFREFIEVVFQNWENSVQSWHVSGYSFFVVGMDGGQWTPGSRAKYNLRDAVSRSTVQVYPRAWTAIYIALDNVGMWNIRSENWARQYLGQQFYLRVYTSSTSYRDEYPPPKNALMCGRAKGRHTRPF

SEQ ID NO: 9724 - protein, 697 aa, Arabidopsis thaliana
MATLQDIGVSAGINILSAFVFFIIFAVLRLQPFNDRVYFSKWYLKGLRSSPARGGAFAQRFVNLDFRSYMKFLNWMPEALKMPEPELIDHAGLDSVVYLRIYWLGLKIFTPIAVLAWAVLVPVNWTNNTLEMAKQLRNVTSSDIDKLSVSNIPEYSMRFWTHIVMAYAFTIWTCYVLMKEYETIANMRLQFVASEARRPDQFTLGFLGLWGQKVDAIEHYIAEIDKISKEISKEREEVVNDPKAIMPAAFVSFKTRWAAAVCAQTQQTRNPTQWLTEWAPEPRDVFWSNLAIPYVSLTVRRLIMHVAFFFLTFFFIVPIAFVQSLATIEGIVKAAPFLKFIVDDKFMKSVIQGFLPGIALKLFLAFLPSILMIMSKFEGFTSISSLERRAAFRYYIFNLVNVFLASVIAGAAFEQLNSFLNQSANQIPKTIGVAIPMKATFFITYIMVDGWAGVAGEILMLKPLIMFHLKNAFLVKTDKDREEAMDPGSIGFNTGEPRIQLYFLLGLVYAPVTPMLLPFILVFFALAYIVYRHQIINVYNQEYESAAAFWPDVHGRVIAALVISQLLLMGLLGTKHAALAAPFLIALPVLTIGFHHFCKGRYEPAFIRYPLQEAMMKDTLETAREPNLNLKGYLQNAYVHPVFKGDEDDYDIDDKLGKFEDEAIIVPTKRQSRRNTPAPSIISGDDSPSLPFSGKLV

SEQ ID NO: 9725 - protein, 335 aa, Arabidopsis thaliana
MAPVKKSDKKATLDAAAWMFNVVTSVGIIIVNKALMATYGFSFATTLTGLHFATTTLMTLVLRCLGYIQPSHLPFTELLKFILFANFSIVGMNVSLMWNSVGFYQIAKLSMIPVSCLLEVVFDKIRYSRDTKLSIGLVLVGVGVCTVTDVSVNTKGFVAAFVAVWSTALQQYYVHYLQRKYSLSSFNLLGHTAPAQAATLLIVGPFLDYWLTDKRVDMYDYNSVSVMFITLSCTIAIGTNLSQFICIGRFTAVSFQVLGHMKTILVLVMGFFFFDRDGLNLHVILGMIIAVLGMIWYGNASSKPGGKEKKNYSLPTTRQQKLGATSDSDEHRDKA

SEQ ID NO: 9726 - protein, 465 aa, Arabidopsis thaliana
MARTHFIFLLLVALLSTTFPSSSSSREQEKDRIKALPGQPKVAFSQYSGYVNVNQSHGRALFYWLTESSSPSPHTKPLLLWLNGGPGCSSIAYGASEEIGPFRINKTGSNLYLNKFAWNKDANLLFLESPAGVGYSYTNTSSDLKDSGDERTAQDNLIFLIKWLSRFPQYKYRDFYIAGESYAGHYVPQLAKKINDYNKAFSKPIINLKGFLVGNAVTDNQYDSIGTVTYWWTHAIISDKSYKSILKYCNFTVERVSDDCDNAVNYAMNHEFGDIDQYSIYTPTCVAAQQKKNTTGFFVRMKNTLLRRRLVSGYDPCTESYAEKYFNRPDVQRAMHANVTGIRYKWTACSDVLIKTWKDSDKTMLPIYKELAASGLRIWIFSGDTDSVVPVTATRFSLSHLNLPVKTRWYPWYTDNQVGGWTEVYKGLTFATVRGAGHEVPLFEPKRALILFRSFLAGKELPRSY

SEQ ID NO: 9727 - protein, 1083 aa, Arabidopsis thaliana
MARNDWINSYLEAILDVGTSKKKRFESNSKIVQKLGDINSKDHQEKVFGDMNGKDHQEKVFSPIKYFVEEVVNSFDESDLYKTWIKVIATRNTRERSNRLENICWRIWHLARKKKQIVWDDGVRLSKRRIEREQGRNDAEEDLLSELSEGEKDKNDGEKEKSEVVTTLEPPRDHMPRIRSEMQIWSEDDKSSRNLYIVLIRQVEIGFSDLFVVFNMLVGLTWCLYLVPCFTNCSMHGLVRGENMELGRDSDTGGQVKYVVELARALANTEGVHRVDLLTRQISSPEVDYSYGEPVEMLSCPPEGSDSCGSYIIRIPCGSRDKYIPKESLWPHIPEFVDGALNHIVSIARSLGEQVNGGKPIWPYVIHGHYADAGEVAAHLAGALNVPMVLTGHSLGRNKFEQLLQQGRITREDIDRTYKIMRRIEAEEQSLDAAEMVVTSTRQEIDAQWGLYDGFDIKLERKLRVRRRRGVSCLGRYMPRMVVIPPGMDFSYVLTQDSQEPDGDLKSLIGPDRNQIKKPVPPIWSEIMRFFSNPHKPTILALSRPDHKKNVTTLVKAFGECQPLRELANLVLILGNRDDIEEMPNSSSVVLMNVLKLIDQYDLYGQVAYPKHHKQSEVPDIYRLAAKTKGVFINPALVEPFGLTLIEAAAYGLPIVATRNGGPVDIVKALNNGLLVDPHDQQAISDALLKLVANKHLWAECRKNGLKNIHRFSWPEHCRNYLSHVEHCRNRHPTSSLDIMKVPEELTSDSLRDVDDISLRFSTEGDFTLNGELDAGTRQKKLVDAISQMNSMKGCSAAIYSPGRRQMLFVVAVDSYDDNGNIKANLNEIIKNMIKAADLTSGKGKIGFVLASGSSLQEVVDITQKNLINLEDFDAIVCNSGSEIYYPWRDMMVDADYETHVEYKWPGESIRSVILRLICTEPAAEDDITEYASSCSTRCYAISVKQGVKTRRVDDLRQRLRMRGLRCNIVYTHAATRLNVIPLCASRIQALRYLSIRWGIDMSKTVFFLGEKGDTDYEDLLGGLHKTIILKGVVGSDSEKLLRSEENFKREDAVPQESPNISYVKENGGSQEIMSTLEAYGIK

SEQ ID NO: 9728 - protein, 169 aa, Arabidopsis thaliana
MSEVEYRCFVGGLAWATNDEDLQRTFSQFGDVIDSKIINDRESGRSRGFGFVTFKDEKAMRDAIEEMNGKELDGRVITVNEAQSRGSGGGGGGRGGSGGGYRSGGGGGYSGGGGGGYSGGGGGGYERRSGGYGSGGGGGGRGYGGGGRREGGGYGGGDGGSYGGGGGGW

SEQ ID NO: 9729 - protein, 1196 aa, Arabidopsis thaliana
MKTFSSFFLSVTTLFFFSFFSLSFQASPSQSLYREIHQLISFKDVLPDKNLLPDWSSNKNPCTFDGVTCRDDKVTSIDLSSKPLNVGFSAVSSSLLSLTGLESLFLSNSHINGSVSGFKCSASLTSLDLSRNSLSGPVTTLTSLGSCSGLKFLNVSSNTLDFPGKVSGGLKLNSLEVLDLSANSISGANVVGWVLSDGCGELKHLAISGNKISGDVDVSRCVNLEFLDVSSNNFSTGIPFLGDCSALQHLDISGNKLSGDFSRAISTCTELKLLNISSNQFVGPIPPLPLKSLQYLSLAENKFTGEIPDFLSGACDTLTGLDLSGNHFYGAVPPFFGSCSLLESLALSSNNFSGELPMDTLLKMRGLKVLDLSFNEFSGELPESLTNLSASLLTLDLSSNNFSGPILPNLCQNPKNTLQELYLQNNGFTGKIPPTLSNCSELVSLHLSFNYLSGTIPSSLGSLSKLRDLKLWLNMLEGEIPQELMYVKTLETLILDFNDLTGEIPSGLSNCTNLNWISLSNNRLTGEIPKWIGRLENLAILKLSNNSFSGNIPAELGDCRSLIWLDLNTNLFNGTIPAAMFKQSGKIAANFIAGKRYVYIKNDGMKKECHGAGNLLEFQGIRSEQLNRLSTRNPCNITSRVYGGHTSPTFDNNGSMMFLDMSYNMLSGYIPKEIGSMPYLFILNLGHNDISGSIPDEVGDLRGLNILDLSSNKLDGRIPQAMSALTMLTEIDLSNNNLSGPIPEMGQFETFPPAKFLNNPGLCGYPLPRCDPSNADGYAHHQRSHGRRPASLAGSVAMGLLFSFVCIFGLILVGREMRKRRRKKEAELEMYAEGHGNSGDRTANNTNWKLTGVKEALSINLAAFEKPLRKLTFADLLQATNGFHNDSLIGSGGFGDVYKAILKDGSAVAIKKLIHVSGQGDREFMAEMETIGKIKHRNLVPLLGYCKVGDERLLVYEFMKYGSLEDVLHDPKKAGVKLNWSTRRKIAIGSARGLAFLHHNCSPHIIHRDMKSSNVLLDENLEARVSDFGMARLMSAMDTHLSVSTLAGTPGYVPPEYYQSFRCSTKGDVYSYGVVLLELLTGKRPTDSPDFGDNNLVGWVKQHAKLRISDVFDPELMKEDPALEIELLQHLKVAVACLDDRAWRRPTMVQVMAMFKEIQAGSGIDSQSTIRSIEDGGFSTIEMVDMSIKEVPEGKL

SEQ ID NO: 9730 - protein, 379 aa, Arabidopsis thaliana
MDGSKHPSVFQKLHGQSYLINRLSPSVQARGYCVSGAYVNGGLQSLLQPTSHGVGSSLIPHGSFPVLAHAPSEKTGTGFLIDFLMGGVSAAVSKTAAAPIERVKLLIQNQDEMIKAGRLSEPYKGISDCFARTVKDEGMLALWRGNTANVIRYFPTQALNFAFKDYFKRLFNFKKEKDGYWKWFAGNLASGGAAGASSLLFVYSLDYARTRLANDAKAAKKGGQRQFNGMVDVYKKTIASDGIVGLYRGFNISCVGIVVYRGLYFGLYDSLKPVVLVDGLQDSFLASFLLGWGITIGAGLASYPIDTVRRRMMMTSGEAVKYKSSLQAFSQIVKNEGAKSLFKGAGANILRAVAGAGVLAGYDKLQLIVLGKKYGSGGG

SEQ ID NO: 9731 - protein, 809 aa, Arabidopsis thaliana
MANPKLTRVLSTRDRVQDTLSAHRNELVALLSRYVDQGKGILQPHNLIDELESVIGDDETKKSLSDGPFGEILKSAMEAIVVPPFVALAVRPRPGVWEYVRVNVFELSVEQLTVSEYLRFKEELVDGPNSDPFCLELDFEPFNANVPRPSRSSSIGNGVQFLNRHLSSVMFRNKDCLEPLLDFLRVHKYKGHPLMLNDRIQSISRLQIQLSKAEDHISKLSQETPFSEFEYALQGMGFEKGWGDTAGRVLEMMHLLSDILQAPDPSSLEKFLGMVPMVFNVVILSPHGYFGQANVLGLPDTGGQVVYILDQVRALETEMLLRIKRQGLDISPSILIVTRLIPDAKGTTCNQRLERVSGTEHTHILRVPFRSEKGILRKWISRFDVWPYLENYAQDAASEIVGELQGVPDFIIGNYSDGNLVASLMAHRMGVTQCTIAHALEKTKYPDSDIYWKDFDNKYHFSCQFTADLIAMNNADFIITSTYQEIAGTKNTVGQYESHGAFTLPGLYRVVHGIDVFDPKFNIVSPGADMTIYFPYSEETRRLTALHGSIEEMLYSPDQTDEHVGTLSDRSKPILFSMARLDKVKNISGLVEMYSKNTKLRELVNLVVIAGNIDVNKSKDREEIVEIEKMHNLMKNYKLDGQFRWITAQTNRARNGELYRYIADTRGAFAQPAFYEAFGLTVVEAMTCGLPTFATCHGGPAEIIEHGLSGFHIDPYHPEQAGNIMADFFERCKEDPNHWKKVSDAGLQRIYERYTWKIYSERLMTLAGVYGFWKYVSKLERRETRRYLEMFYILKFRDLVKTVPSTADD

SEQ ID NO: 9732 - protein, 838 aa, Arabidopsis thaliana
MAAVIRKLLPFPSPNPKRDNRESDDDDETSSGYRIEYSFASEYKGPLIANVPRALPVEVDQIPTALPVSFSSLRSGISYPVAPLVMTKDTKRPPDSGIEKKNGFVDSAAGSSVVLIGRDVVSGSSSSSSSKRLDVPEEVKSPADFRLSPSSPLSASAREEDHLDDDRVSDVGPRAVRFVEPFQSSECDESSYVSDGESIAATHRAERKGKRGSCYRCQLGNRFTEKEVCIVCDAKYCFNCVRRAMGAMPEGRKCQACIGYRIDESKRASLGKCSRMLKRHLTDSELRQVMNAEITCKANQLPSRLIIVNDKPLSEDELYTLQTCPNPPKKLKPGHYWYDKVAGYWGKIGEKPSQIISPNNSIGGYISEKVSNGDTEIYINGREITKPELTMLKWAGVQCEGKPHFWVDSDGSYREEGQKHPIGNIWSKKRAKIACAVFSLPVPPASSAVEPYDVPLYEQKMLNKLLLIGSEKGGATTIYKQARSLYNVSFSLEDRERIKFIIQTNLYTYLAMVLEAHERFEKEMSNDQSSDWVLKEKEDGNLKIFPPSSRENAQTVADLWRVPAIQATYKRLRDTLPRNAVYFLERILEISRSEYDPSDMDILQAEGLSSMEGLSCVDFSFPSTSQEESLESDYQHDTDMKYQLIRLNPRSLGENWKLLEMFEDADLVIFCVSLTDYAENIEDGEGNIVNKMLATKQLFENMVTHPSLANKRFLLVLTKFDLLEEKIEEVPLRTCEWFEDFNPLISQNQTSRHNPPMAQRAFHYIGYKFKRLYDSILEPVNMRGRSFKPKLFVCQVSLESDTVDNALRYAREILKWHVEETSMFQEMSTTSIEASSSS

SEQ ID NO: 9733 - protein, 246 aa, Arabidopsis thaliana
MAEDLVLDTAIRDWVLIPLSVVMVLIGILRYFVSKLMRSTPTPDAKMVKEGQVVIRARNLKVGANFIPPKSFRARRFYFSNEENGLLHVPKGEAQNPQAAMFSDPNMAMDMMKKNLSMIIPQTLTFAWVNFFFSGFVAAKIPFPLTQRFRSMLQNGIDLSTVDVSYVSSRSWYFLNLFGLRGLFSLILGDENAIDDTQRMMQMGGFGFDASKSLGAEKDGLDIIQHEWALPRFEQRAESVLRKLVK

SEQ ID NO: 9734 - protein, 541 aa, Arabidopsis thaliana
MKQTNLLVCKLFIGALFWLGSVLVNAEDPYMFYTWTVTYGTRSPLGVPQQVILINGQFPGPAIEAVTNNNIVVNLINKLDEPFLITWNGVKQRRTSWQDGVLGTNCPIQPNSNWTYQFQLKDQIGTYTYFASTSLHRASGAFGALNINQRSVITTPYPTPDGDFTLLVSDWFSNMTHKDLRKSLDAGSALPLPDALLINGVSKGLIFTGQQGKTYKFRVSNVGIATSINFRIQNHTMSLIEVEGAHTLQESYESLDVHVGQSMTVLVTLKASVRDYFIVASTRFTKPVLTTTASLRYQGSKNAAYGPLPIGPTYHIHWSMKQARTIRMNLTANAARPNPQGSFHYGTIPINRTLVLANAATLIYGKLRYTVNRISYINPTTPLKLADWYNISGVFDFKTIISTPTTGPAHIGTSVIDVELHEFVEIVFQNDERSIQSWHMDGTSAYAVGYGSGTWNVTMRKRYNLVDAVPRHTFQVYPLSWTTILVSLDNKGMWNLRSQIWSRRYLGQELYVRVWNDEKSLYTEAEPPLNVLYCGKAKRPL

SEQ ID NO: 9735 - protein, 320 aa, Arabidopsis thaliana
MSNPTRKNMERIKGPWSPEEDDLLQRLVQKHGPRNWSLISKSIPGRSGKSCRLRWCNQLSPEVEHRAFSQEEDETIIRAHARFGNKWATISRLLNGRTDNAIKNHWNSTLKRKCSVEGQSCDFGGNGGYDGNLGEEQPLKRTASGGGGVSTGLYMSPGSPSGSDVSEQSSGGAHVFKPTVRSEVTASSSGEDPPTYLSLSLPWTDETVRVNEPVQLNQNTVMDGGYTAELFPVRKEEQVEVEEEEAKGISGGFGGEFMTVVQEMIRTEVRSYMADLQRGNVGGSSSGGGGGGSCMPQSVNSRRVGFREFIVNQIGIGKME

SEQ ID NO: 9736 - protein, 603 aa, Arabidopsis thaliana
MAVDSPLQSRMVSATTSEKDVKALKFIEEMTRNPDSVQEKVLGEILTRNSNTEYLKRFDLDGVVDRKTFKSKVPVVTYEDLKPEIQRISNGDCSPILSSHPITEFLTSSGTSAGERKLMPTIEEDLDRRQLLYSLLMPVMNLYVPGLDKGKGLYFLFVKSESKTSGGLPARPVLTSYYKSDHFKRRPYDPYNVYTSPNEAILCSDSSQSMYAQMLCGLLMRHEVLRLGAVFASGLLRAISFLQNNWKELARDISTGTLSSRIFDPAIKNRMSKILTKPDQELAEFLVGVCSQENWEGIITKIWPNTKYLDVIVTGAMAQYIPTLEYYSGGLPMACTMYASSESYFGINLKPMCKPSEVSYTIMPNMAYFEFLPHNHDGDGAAEASLDETSLVELANVEVGKEYELVITTYAGLYRYRVGDILRVTGFHNSAPQFKFIRRKNVLLSVESDKTDEAELQKAVENASRLFAEQGTRVIEYTSYAETKTIPGHYVIYWELLGRDQSNALMSEEVMAKCCLEMEESLNSVYRQSRVADKSIGPLEIRVVRNGTFEELMDYAISRGASINQYKVPRCVSFTPIMELLDSRVVSAHFSPSLPHWSPERRR

SEQ ID NO: 9737 - protein, 555 aa, Arabidopsis thaliana
MKSFCDNDDNNHSNTTNLLGFSLSSNMMKMGGRGGREAIYSSSTSSAATSSSSVPPQLVVGDNTSNFGVCYGSNPNGGIYSHMSVMPLRSDGSLCLMEALNRSSHSNHHQDSSPKVEDFFGTHHNNTSHKEAMDLSLDSLFYNTTHEPNTTTNFQEFFSFPQTRNHEEETRNYGNDPSLTHGGSFNVGVYGEFQQSLSLSMSPGSQSSCITGSHHHQQNQNQNHQSQNHQQISEALVETSVGFETTTMAAAKKKRGQEDVVVVGQKQIVHRKSIDTFGQRTSQYRGVTRHRWTGRYEAHLWDNSFKKEGHSRKGRQVYLGGYDMEEKAARAYDLAALKYWGPSTHTNFSAENYQKEIEDMKNMTRQEYVAHLRRKSSGFSRGASIYRGVTRHHQHGRWQARIGRVAGNKDLYLGTFGTQEEAAEAYDVAAIKFRGTNAVTNFDITRYDVDRIMSSNTLLSGELARRNNNSIVVRNTEDQTALNAVVEGGSNKEVSTPERLLSFPAIFALPQVNQKMFGSNMGGNMSPWTSNPNAELKTVALTLPQMPVFAAWADS

SEQ ID NO: 9738 - protein, 388 aa, Arabidopsis thaliana
MELKSIKDAFDRVATKQKLSYSKTNEIVHMLSQEIDKALSILEETPSSDTMLLDHRSILADVKKVFMEIAPITQLEATEKELHAALTKYPKVLEKQLNPDISKAYRHNVEFDTHIVNQIIANFFYRQGMFDIGDCFVAETGESECSTRQSFVEMYRILEAMKRRDLEPALNWAVSNSDKLKEARSDLEMKLHSLHFLEIARGKNSKEAIDYARKHIATFADSCLPEIQKLMCSLLWNRKLDKSPYSEFLSPALWNNAVKELTRQYCNLLGESSESPLSITVTAGTQALPVLLKYMNVVMANKKLDWQTMEQLPVDAQLSEEFQFHSVFVCPVSKEQSSDDNPPMMMSCGHVLCKQTINKMSKNGSKSSFKCPYCPTDVDISRCRQLHF

SEQ ID NO: 9739 - protein, 219 aa, Arabidopsis thaliana
MVRGKTEMKRIENATSRQVTFSKRRNGLLKKAFELSVLCDAEVALVIFSPRSKLYEFSSSSIAATIERYQRRIKEIGNNHKRNDNSQQARDETSGLTKKIEQLEISKRKLLGEGIDACSIEELQQLENQLDRSLSRIRAKKYQLLREEIEKLKAEERNLVKENKDLKEKWLGMGTATIASSQSTLSSSEVNIDDNMEVETGLFIGPPETRQSKKFPPQN

SEQ ID NO: 9740 - protein, 284 aa, Arabidopsis thaliana
MMFEKDDLGLSLGLNFPKKQINLKSNPSVSVTPSSSSFGLFRRSSWNESFTSSVPNSDSSQKETRTFIRGIDVNRPPSTAEYGDEDAGVSSPNSTVSSSTGKRSEREEDTDPQGSRGISDDEDGDNSRKKLRLSKDQSAILEETFKDHSTLNPKQKQALAKQLGLRARQVEVWFQNRRARTKLKQTEVDCEFLRRCCENLTEENRRLQKEVTELRALKLSPQFYMHMSPPTTLTMCPSCEHVSVPPPQPQAATSAHHRSLPVNAWAPATRISHGLTFDALRPRS

SEQ ID NO: 9741 - protein, 124 aa, Arabidopsis thaliana
MSGVWVFNKNGVMRLVENPYNQSAGDSSESSSSGGNQQQRMRRKILVHLPSSEVVSSYGSLEKILKNLGWERYYSGDNTDHLLQFHKRTSIDLISLPRDFSKFNSIHMYDIVVKNPNVFHVRDM

SEQ ID NO: 9742 - protein, 200 aa, Arabidopsis thaliana
MSRVYVGNLDPRVTERELEDEFRAFGVVRSVWVARRPPGYAFLDFEDPRDARDAIRALDGKNGWRVEQSHNRGERGGGGRGGDRGGGGGGRGGRGGSDLKCYECGETGHFARECRNRGGTGRRRSKSRSRTPPRYRRSPSYGRRSYSPRARSPPPPRRRSPSPPPARGRSYSRSPPPYRAREEVPYANGNGLKERRRSRS

SEQ ID NO: 9743 - protein, 582 aa, Arabidopsis thaliana
MMRPKRSSDTVHVFNLMVLCFIALFFSSVLCQGKIRRFKWEVKYEFKSPDCFEKLVITINGKFPGPTIKAQQGDTIVVELKNSFMTENVAVHWHGIRQIGTPWFDGVEGVTQCPILPGEVFIYQFVVDRPGTYMYHSHYGMQRESGLIGMIQVSPPATEPEPFTYDYDRNFLLTDWYHKSMSEKATGLASIPFKWVGEPQSLMIQGRGRFNCSNNLTTPPSLVSGVCNVSNADCSRFILTVIPGKTYRLRIGSLTALSALSFQIEGHNLTVVEADGHYVEPFTVKNLFVYSGETYSVLLKADQNPRRNYWITSSIVSRPATTPPATAVLNYYPNHPRRRPPTSESSNIVPEWNDTRSRLAQSLAIKARRGFIHALPENSDKVIVLLNTQNEVNGYRRWSVNNVSYHHPKTPYLIALKQNLTNAFDWRFTAPENYDSRNYDIFAKPLNANATTSDGIYRLRFNSTVDVILQNANTMNANNSETHPWHLHGHDFWVLGYGEGKFNESEDPKRYNRVDPIKKNTVAVQPFGWTALRFRADNPGVWSFHCHIESHFFMGMGIVFESGIDKVSSLPSSIMGCGQTKR

SEQ ID NO: 9744 - protein, 282 aa, Arabidopsis thaliana
MMMGKEDLGLSLSLGFAQNHPLQLNLKPTSSPMSNLQMFPWNQTLVSSSDQQKQQFLRKIDVNSLPTTVDLEEETGVSSPNSTISSTVSGKRRSTEREGTSGGGCGDDLDITLDRSSSRGTSDEEEDYGGETCRKKLRLSKDQSAVLEDTFKEHNTLNPKQKLALAKKLGLTARQVEVWFQNRRARTKLKQTEVDCEYLKRCVEKLTEENRRLEKEAAELRALKLSPRLYGQMSPPTTLLMCPSCERVAGPSSSNHNQRSVSLSPWLQMAHGSTFDVMRPRS

SEQ ID NO: 9745 - protein, 294 aa, Arabidopsis thaliana
MKRLSSSDSMCGLISTSTDEQSPRGYGSNYQSMLEGYDEDATLIEEYSGNHHHMGLSEKKRRLKVDQVKALEKNFELENKLEPERKTKLAQELGLQPRQVAVWFQNRRARWKTKQLEKDYGVLKGQYDSLRHNFDSLRRDNDSLLQEISKIKAKVNGEEDNNNNKAITEGVKEEEVHKTDSIPSSPLQFLEHSSGFNYRRSFTDLRDLLPNSTVVEAGSSDSCDSSAVLNDETSSDNGRLTPPVTVTGGSFLQFVKTEQTEDHEDFLSGEEACGFFSDEQPPSLHWYSASDHWT

SEQ ID NO: 9746 - protein, 785 aa, Arabidopsis thaliana
MASVQDIGLSAAINLLSAFAFLFAFAMLRLQPVNDRVYFPKWYLKGIRGSPTRSRGIMTRFVNLDWTTYVKFLNWMPAALQMPEPELIEHAGLDSAVYIRIYLLGLKMFVPITLLAFGVLVPVNWTGETLENIDDLTFSNVDKLSISNVPPGSPRFWAHITMTYVITFWTCYILYMEYKAVANMRLRHLAAESRRPDQLTVLVRNVPPDPDESVNEHVEHFFCVNHPDHYLCHQVVYNANDLAKLVAQRKAMQNWLTYYENKFERKPSSRPTTKTGYGGFWGTTVDAIDFYTSKMDILAEQEAVEREKIMNDPKAIMPAAFVSFRSRWGTAVCAQTQQCHNPTIWLTEWAPEPRDVFWDNLAIPYVELSIRRLLTTVALFFLIFCFMIPIAFVQSLANLEGIQKVLPFLKPVIEMKTVKSVIQGFLPGIALKIFLIILPTILMTMSQIEGYTSLSYLDRRSAEKYFWFIIVNVFLGSIITGTAFQQLKSFLEQPPTEIPKTVGVSIPMKATFFITYIMVDGWAGIAAEILRVVPLVIFHLKNTFLVKTEQDRQQAMDPGHLDFATSEPRIQFYFLLGLVYAAVAPILLPFIIVFFAFAYVVFRHQVINVYDQKYESGARYWPDVHRRLIICLIISQLLMMGLLSTKKFAKVTALLLPQPILTFWFYRYCAGRFESAFSKFPLQEAMVKDTLEKATEPNLNLKEYLKDAYVHPVFKGNDFDRPRVVDEEESNPLVRTKRTSQGTTRYNSEASSSATTTPVANNDSPRCWGTKIGSFGCVIVVSYSC

SEQ ID NO: 9747 - protein, 118 aa, Arabidopsis thaliana
MVCNTNILKDVSTKISAFENVRMIMVEGEMFQVARIHKQLKNRVSAHSSVGATDVVYMTSILEYLTTEVLQLAENTSKDLKVKRITPRHLQLAIRGDEELDTLIKGTIIGGSVIPHIH

SEQ ID NO: 9748 - protein, 485 aa, Arabidopsis thaliana
MALLVEKTSSGREYKVKDMSQADFGRLELELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGQVPDPTSTDNPEFQIVLSIIKEGLQVDPKKYHKMKERLVGVSEETTTGVKRLYQMQQNGTLLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETKAGIIVLAEGRLMNLGCATGHPSFVMSCSFTNQVIAQLELWNEKASGKYEKKVYVLPKHLDEKVALLHLGKLGARLTKLSKDQSDYVSIPIEGPYKPPHYRY

SEQ ID NO: 9749 - protein, 490 aa, Arabidopsis thaliana
MATETEVVAPVTVSNGGSKGCCKYGGPGYATPLAAMSGPSEKLIYVTAVYTGTGIDKPDYLATVDVDPSSPSYSSVIHRLPMPFVGDELHHSGWNSCSSCHGDASVDRRYLVLPSLISGRIYAIDTKENPRAPSLYKYVDPKEIADKTGLAFPHTAHCLATGEILVSCLGDEEGNAKGNGFLLLDSDFNIKNRWEKPGHSPLYGYDFWYQPRHKTMISTSWGAPKAFSKGFNLQHVADGLYGSHLHVYSWPGGEIKQLIDLGPTGLLPLEIRFLHDPSKDTGFVGSALSSNMIRFFKNSDETWSHEVVISVKPLKVENWILPEMPGLITDFLISLDDRFIYFVNWLHGDIRQYNIEDPKNPVLTGQIWVGGLLQKGSPVKAVGEDGNTFQFEVPQIKGKSLRGGPQMIQLSLDGKRLYATNSLFSAWDRQFYPEIMEKGSHIIQIDVDTEKGGLTINPDFFVDFGDEPDGPSLAHEMRYPGGDCTSDIWI

SEQ ID NO: 9750 - protein, 487 aa, Arabidopsis thaliana
MATETVLATAVSNGKSKGCCKSGPGYATPLAAMAGPREKLIYVTALYSGTGRDKPDYLATVDVDPSSPTFSSVIHRLKMPYIGDELHHTGWNSCSSCHGDASADRRYLVLPGLISGRIYAIDTKTDPKAPSLYKVVEPKEIAEKTGLAFPHTSHCLASGDMLVSCLGDKEGNAKGNGFLLLDSDFNVKSRWDKPGHGPLFGYDFWYQPRFKTMISTSWGAPKAFSKGFNLQHVADGLYGSHLHIYQWPEGEMKQIIDLGNTGLLPLEIRFLHDPSKDTGYVGSALSSNMIRFFKNSDDTWSHEVVISVKPLKVENWILPEMPGLITDFLISLDDRFFYFVNWLHGDIRQYNIEDPKNPVLTGQIWVGGLLQKGSPYKAVGEDGNTYQFDVPQIKGKSLRAGPQMIQLSLDGKRLYATNSLFSAWDRQFYPEIMEKGSHIIQIDVDTDKGGLTLNPDFFVDFGDEPDGPALAHEMRYPGGDCTSDIWI

SEQ ID NO: 9751 - protein, 384 aa, Arabidopsis thaliana
MEGVSATMHKLRPYLLMIFLQFGAAGTYIVIMATLNQGQNRYVVIVYRNLVAALVLAPFALIFERKVRPKMTLSVLWKIMALGFLEPVLDQGFGYLGMNMTSATYTSAIMNILPSVTFIIAWILRMEKVNIAEVRSKAKIIGTLVGLGGALVMTLYKGPLIPLPWSNPNMDQQNGHTNNSQDHNNWVVGTLLILLGCVAWSGFYVLQSITIKTYPADLSLSALICLAGAVQSFAVALVVERHPSGWAVGWDARLFAPLYTGIVSSGITYYVQGMVMKTRGPVFVTAFNPLCMILVALIASFILHEQIHFGCVIGGAVIAAGLYMVVWGKGKDYEVSGLDILEKNSLQELPITTKSEDDNKLVSSISDNSNVTIPGGAHSNTSGI

SEQ ID NO: 9752 - protein, 552 aa, Arabidopsis thaliana
MTMEQEIEVLDQFPVGMRVLAVDDDQTCLRILQTLLQRCQYHVTTTNQAQTALELLRENKNKFDLVISDVDMPDMDGFKLLELVGLEMDLPVIMLSAHSDPKYVMKGVKHGACDYLLKPVRIEELKNIWQHVVRKSKLKKNKSNVSNGSGNCDKANRKRKEQYEEEEEEERGNDNDDPTAQKKPRVLWTHELHNKFLAAVDHLGVERAVPKKILDLMNVDKLTRENVASHLQKFRVALKKVSDDAIQQANRAAIDSHFMQMNSQKGLGGFYHHHRGIPVGSGQFHGGTTMMRHYSSNRNLGRLNSLGAGMFQPVSSSFPRNHNDGGNILQGLPLEELQINNNINRAFPSFTSQQNSPMVAPSNLLLLEGNPQSSSLPSNPGFSPHFEISKRLEHWSNAALSTNIPQSDVHSKPDTLEWNAFCDSASPLVNPNLDTNPASLCRNTGFGSTNAAQTDFFYPLQMNQQPANNSGPVTEAQLFRSSNPNEGLLMGQQKLQSGLMASDAGSLDDIVNSLMTQEQSQSDFSEGDWDLDGLAHSEHAYEKLHFPFSLSA

SEQ ID NO: 9753 - protein, 282 aa, Arabidopsis thaliana
MYRERGMVGSKSEVVDRKRINEIHDNRPSHSMSQPVNGKGKVTSTSVLMGKQQLHDKESSRSGSISKTNISDAVDISDTDSEESEVSGSDGEDTSWISWFCNLRGNEFFCEVDDDYIQDDFNLCGLSHQVPYYDYALDLILDVESSHGEMFTEEQNELIESAAEMLYGMIHARFILTSKGLASMLDKYKNYDFGRCPRVYCCGQPCLPVGQSDIPRASTVKIYCPKCEDVYYPRSKYQGNIDGAYFGTTFPHLFLMTYGHLKPQKASQSYTQRVFGFKLHKP

SEQ ID NO: 9754 - protein, 350 aa, Arabidopsis thaliana
MGKGGALSDGVIKKILLSYTYVAIWIFLSFTVIVYNKYILDKKMYNWPFPITLTMIHMAFCSSLAVILIKVFKIVEPVSMSRDTYIRSVVPIGALYSLSLWLSNSAYIYLSVSFIQMLKALMPVAVYSIGVLLKKESFKSETMTNMLSISFGVAIAAYGEAKFDTWGVMLQLGAVAFEATRLVLIQILLTSKGINLNPITSLYYVAPCCLVFLFFPWIFVELPILRETSSFHFDFVIFGTNSVCAFALNLAVFLLVGKTSALTMNVAGVVKDWLLIAFSWSVIKDTVTPLNLFGYGLAFLGVAYYNHCKLQALKAKDAQKKVQQGDEEEAGKLLEERESEAAAKRNETED

SEQ ID NO: 9755 - protein, 1081 aa, Arabidopsis thaliana
MEASAGLVAGSYRRNELVRIRHESDGGTKPLKNMNGQICQICGDDVGLAETGDVFVACNECAFPVCRPCYEYERKDGTQCCPQCKTRFRRHRGSPRVEGDEDEDDVDDIENEFNYAQGANKARHQRHGEEFSSSSRHESQPIPLLTHGHTVSGEIRTPDTQSVRTTSGPLGPSDRNAISSPYIDPRQPVPVRIVDPSKDLNSYGLGNVDWKERVEGWKLKQEKNMLQMTGKYHEGKGGEIEGTGSNGEELQMADDTRLPMSRVVPIPSSRLTPYRVVIILRLIILCFFLQYRTTHPVKNAYPLWLTSVICEIWFAFSWLLDQFPKWYPINRETYLDRLAIRYDRDGEPSQLVPVDVFVSTVDPLKEPPLVTANTVLSILSVDYPVDKVACYVSDDGSAMLTFESLSETAEFAKKWVPFCKKFNIEPRAPEFYFAQKIDYLKDKIQPSFVKERRAMKREYEEFKVRINALVAKAQKIPEEGWTMQDGTPWPGNNTRDHPGMIQVFLGHSGGLDTDGNELPRLIYVSREKRPGFQHHKKAGAMNALIRVSAVLTNGAYLLNVDCDHYFNNSKAIKEAMCFMMDPAIGKKCCYVQFPQRFDGIDLHDRYANRNIVFFDINMKGLDGIQGPVYVGTGCCFNRQALYGYDPVLTEEDLEPNIIVKSCCGSRKKGKSSKKYNYEKRRGINRSDSNAPLFNMEDIDEGFEGYDDERSILMSQRSVEKRFGQSPVFIAATFMEQGGIPPTTNPATLLKEAIHVISCGYEDKTEWGKEIGWIYGSVTEDILTGFKMHARGWISIYCNPPRPAFKGSAPINLSDRLNQVLRWALGSIEILLSRHCPIWYGYHGRLRLLERIAYINTIVYPITSIPLIAYCILPAFCLITDRFIIPEISNYASIWFILLFISIAVTGILELRWSGVSIEDWWRNEQFWVIGGTSAHLFAVFQGLLKVLAGIDTNFTVTSKATDEDGDFAELYIFKWTALLIPPTTVLLVNLIGIVAGVSYAVNSGYQSWGPLFGKLFFALWVIAHLYPFLKGLLGRQNRTPTIVIVWSVLLASIFSLLWVRINPFVDANPNANNFNGKGGVF

SEQ ID NO: 9756 - protein, 556 aa, Arabidopsis thaliana
MGNSCRGSFKDKLDEGDNNKPEDYSKTSTTNLSSNSDHSPNAADIIAQEFSKDNNSNNNSKDPALVIPLREPIMRRNPDNQAYYVLGHKTPNIRDIYTLSRKLGQGQFGTTYLCTEIASGVDYACKSISKRKLISKEDVEDVRREIQIMHHLAGHGSIVTIKGAYEDSLYVHIVMELCAGGELFDRIIQRGHYSERKAAELTKIIVGVVEACHSLGVMHRDLKPENFLLVNKDDDFSLKAIDFGLSVFFKPGQIFTDVVGSPYYVAPEVLLKRYGPEADVWTAGVILYILLSGVPPFWAETQQGIFDAVLKGYIDFESDPWPVISDSAKDLIRRMLSSKPAERLTAHEVLRHPWICENGVAPDRALDPAVLSRLKQFSAMNKLKKMALKVIAESLSEEEIAGLREMFQAMDTDNSGAITFDELKAGLRKYGSTLKDTEIHDLMDAADVDNSGTIDYSEFIAATIHLNKLEREEHLVAAFQYFDKDGSGFITIDELQQACVEHGMADVFLEDIIKEVDQNNDGKIDYGEFVEMMQKGNAGVGRRTMRNSLNISMRDA

SEQ ID NO: 9757 - protein, 612 aa, Arabidopsis thaliana
MPEAPKKESLEVFDLTLDQKNKQKLQLIEELTSNADQVQRQVLEEILTRNADVEYLRRHDLNGRTDRETFKNIMPVITYEDIEPEINRIANGDKSPILSSKPISEFLTSSGTSGGERKLMPTIEEELDRRSLLYSLLMPVMSQFVPGLENGKGMYFLFIKSESKTPGGLPARPVLTSYYKSSHFKERPYDPYTNYTSPNETILCSDSYQSMYSQMLCGLCQHQEVLRVGAVFASGFIRAIKFLEKHWIELVRDIRTGTLSSLITDPSVREAVAKILKPSPKLADFVEFECKKSSWQGIITRLWPNTKYVDVIVTGTMSQYIPTLDYYSNGLPLVCTMYASSECYFGVNLRPLCKPSEVSYTLIPSMAYFEFLPVHRNNGVTNSINLPKALTEKEQQELVDLVDVKLGQEYELVVTTYAGLCRYRVGDLLRVTGFKNKAPQFSFICRKNVVLSIDSDKTDEVELQNAVKNAVTHLVPFDASLSEYTSYADTSSIPGHYVLFWELCLDGNTPIPPSVFEDCCLAVEESFNTVYRQGRVSDKSIGPLEIKIVEPGTFDKLMDYAISLGASINQYKTPRCVKFAPIIELLNSRVVDSYFSPKCPKWVPGHKQWGSN

SEQ ID NO: 9758 - protein, 175 aa, Arabidopsis thaliana
MSLSRRDPLVVGSVVGDVLDPFTRLVSLKVTYGHREVTNGLDLRPSQVLNKPIVEIGGDDFRNFYTLVMVDPDVPSPSNPHQREYLHWLVTDIPATTGNAFGNEVVCYESPRPPSGIHRIVLVLFRQLGRQTVYAPGWRQQFNTREFAEIYNLGLPVAASYFNCQRENGCGGRRT

SEQ ID NO: 9759 - protein, 526 aa, Arabidopsis thaliana
MELPLFAILQRTPRVAITLAFVLFVLTIVPALYTLLADPILPPSISSFETDHTRLSHLNSSSNQIPSPVNGSIPTPPYHTPSKHRKSSFHRIPKPKKGPISSPTDHIPLRQRSSSFDQIPSPMNSPVPAPPHRNSSADQSPSPVNGPIPAPLNHTSLRHLNSSSDDHSSPVTTSPSRTRIRDDEQMCDLFTGEWVPNEEAPYYTNTTCWAIHEHQNCMKYGRPDTGFMRWRWKPESCDLPIFDPQEFLEMVRGKAMGFVGDSISRNQVQSLLCLLSRVEYPEDISPSPDTDFKVWNYTSYNFTLHVMWSPFLVKATKPDPKSNFFSLYLDEYDTKWTSQLDQLDYLVISSGHWFSRPVIFYENQQISGCQYCALPNTTELPLTYGYRKALRISLKAIIENFKGLAFLRSFSPQHFEGGAWNEGGDCVRTQPYRRNETIPEADLKVHDIQREEFRAAEEDGMKKSGLRLKLMDTTQAMLLRPDGHPGRYGHLQNPNVTLRNDCIHWCLPGPIDTLNDILLQMMKTDN

SEQ ID NO: 9760 - protein, 426 aa, Arabidopsis thaliana
MELVHSATFPCKQKLLIAVTIATSLLTIIPLLYPLLEDPNFFLKQQPPSQSSIINLENGVVTSHDSCDIFSGEWVPNPEAPYYTNTTCWAIHEHQNCMKFGRPDTDFIKWKWKPYGCEDGLPVFDPVRFLEIVRGKTMAFVGDSVSRNHMQSLICLLSQVEYPMDASVKNDDYFKRWTYETYNFTIAAFWTPHLVKSKEPDQTQPKHIDIFDLYLDEADESWTADIGDFDFVIISSGHWHYRPSVYYENRTITGCHYCQLPNITDLTMFYGYRKAFRTAFKAILDSESFKGVMYLRSFAPSHFEGGLWNEGGDCLRKQPYRSNETQDETTMKLHKIQLEEFWRAEEEAKKKGKRLRLLDTTQAMWLRPDGHPSRYGHIPEANVTLYNDCVHWCLPGPIDNLNDFLLAMLKREEDKGFLAQVRKMLS

SEQ ID NO: 9761 - protein, 586 aa, Arabidopsis thaliana
MTVEEVGDDYTKDGTVDLRGNRVRRSQTGRWKACSFVVVYEVFERMAYYGISSNLVIYMTTKLHQGTVKSSNNVTNWVGTSWLTPILGAYVADAHFGRYITFVISSAIYLLGMALLTLSVSLPGLKPPKCSTANVENCEKASVIQLAVFFGALYTLAIGTGGTKPNISTIGADQFDEFDPKDKIHKHSFFNWWMFSIFFGTFFATTVLVYVQDNVGWAIGYGLSTLGLAFSIFIFLLGTRLYRHKLPMGSPFTKMARVIVASLRKAREPMSSDSTRFYELPPMEYASKRAFPIHSTSSLRFLNRASLKTGSTHKWRLCTITEVEETKQMLKMLPVLFVTFVPSMMLAQIMTLFIKQGTTLDRRLTNNFSIPPASLLGFTTFSMLVSIVIYDRVFVKFMRKLTGNPRGITLLQRMGIGMILHILIMIIASITERYRLKVAAEHGLTHQTAVPIPLSIFTLLPQYVLMGLADAFIEIAKLEFFYDQAPESMKSLGTSYTSTSMAVGYFMSSILLSSVSQITKKQGRGWIQNNLNESRLDNYYMFFAVLNLLNFILFLVVIRFYEYRADVTQSANVEQKEPNMVDNYNE

SEQ ID NO: 9762 - protein, 582 aa, Arabidopsis thaliana
MTVEEVGDDYTKDGTVDLQGNPVRRSIRGRWKACSFVVVYEVFERMAYYGISSNLFIYMTTKLHQGTVKSSNNVTNWVGTSWLTPILGAYVGDALLGRYITFVISCAIYFSGMMVLTLSVTIPGIKPPECSTTNVENCEKASVLQLAVFFGALYTLAIGTGGTKPNISTIGADQFDVFDPKEKTQKLSFFNWWMFSIFFGTLFANTVLVYVQDNVGWTLGYGLPTLGLAISITIFLLGTPFYRHKLPTGSPFTKMARVIVASFRKANAPMTHDITSFHELPSLEYERKGAFPIHPTPSLRFLDRASLKTGTNHKWNLCTTTEVEETKQMLRMLPVLFITFVPSMMLAQINTLFVKQGTTLDRKVTGSFSIPPASLSGFVTLSMLISIVLYDRVFVKITRKFTGNPRGITLLQRMGIGLIFHILIMIVASVTERYRLKVAADHGLIHQTGVKLPLTIFALLPQFVLMGMADSFLEVAKLEFFYDQAPESMKSLGTSYSTTSLAIGNFMSSFLLSTVSEITKKRGRGWILNNLNESRLDYYYLFFAVLNLVNFVLFLVVVKFYVYRAEVTDSVDVKEVEMKETE

SEQ ID NO: 9763 - protein, 309 aa, Arabidopsis thaliana
MSSSAKKQTLFISTLIISWYSSNIGVLLLNKFLLSNYGFKFPIFLTMCHMSACAILSYISIVFLKLVPLQHLKSRSQFLKVATLSIVFCASVVGGNISLRYLPVSFNQAVGATTPFFTALFAYLMTFKREAWVTYGALVPVVAGVVIASGGEPGFHWFGFIMCISATAARAFKSVLQGILLSSEGEKLNSMNLMLYMSPIAVIALLPVTLFMEPDVISVTLTLAKQHQYMWILLLVNSVMAYSANLLNFLVTKHTSALTLQVLGNAKGAVAVVISILIFQNPVTVMGIGGYSITVLGVVAYGETKRRFR

SEQ ID NO: 9764 - protein, 325 aa, Arabidopsis thaliana
MDQQGMVKKRLAVLVGCNYPNTRNELHGCINDVLAMKETILSRFGFKQDDIEVLTDEPESKVKPTGANIKAALRRMVDKAQAGSGDILFFHYSGHGTRIPSVKSAHPFKQDEAIVPCDFNLITDVDFRELVNQLPKGTSFTMISDSCHSGGLIDKEKEQIGPSSVSSNISPAIETTNKTITSRALPFKAVLDHLSSLTGITTSDIGTHLLELFGRDAGLKFRLPAMDLMDLLETMTAREKHVDSGILMSGCQADETSADVGVGNGKAYGAFSNAIQRVLNENEGAMKNKQLVMMARDVLERLGFHQHPCLYCSDQNADATFLSQP

SEQ ID NO: 9765 - protein, 362 aa, Arabidopsis thaliana
MASRREVRCRCGRRMWVQPDARTVQCSTCHTVTQLYSLVDIARGANRIIHGFQQLLRQHQPQHHEQQQQQMMAQPPPRLLEPLPSPFGKKRAVLCGVNYKGKSYSLKGCISDAKSMRSLLVQQMGFPIDSILMLTEDEASPQRIPTKRNIRKAMRWLVEGNRARDSLVFHFSGHGSQQNDYNGDEIDGQDEALCPLDHETEGKIIDDEINRILVRPLVHGAKLHAVIDACNSGTVLDLPFICRMERNGSYEWEDHRSVRAYKGTDGGAAFCFSACDDDESSGYTPVFTGKNTGAMTYSFIKAVKTAGPAPTYGHLLNLMCSAIREAQSRLAFNGDYTSSDASAEPLLTSSEEFDVYATKFVL

SEQ ID NO: 9766 - protein, 404 aa, Arabidopsis thaliana
MQSLTLTRYPTPISPPRLNLYPLRQIAASVLSAPTAGINRRDMASRHQSTSFKPLAVGRNLTGDDDDGYCTLIDFAGSGGGEGKNVGEDLVVLLYHLQHACKRIASLVASPFNSSLGKLSVNSSSGSDRDAPKPLDIVSNDIVLSSLRNSGKVAVMASEENDSPTWIKDDGPYVVVVDPLDGSRNIDASIPTGTIFGIYNRLVELDHLPVEEKAELNSLQRGSRLVASGYVLYSSATIFCVTLGSGTHAFTLDHSTGEFVLTHQNIKIPTRGQIYSVNDARYFDWPEGLRKYIDTVRQGKGQNPKKYSARYICSLVADLHRTLLYGGVAMNPRDHLRLVYEGNPLAFLVEQAGGKSSDGKRGILSIQPVKLHQRLPLFLGSLEDVAELESYGDVQQTVNPGYEV

SEQ ID NO: 9767 - protein, 513 aa, Arabidopsis thaliana
MEKFSYNSYPDSTDSSPRSREIEFDNPPPPWDDQNQNQQQHSYKVKFMCSYGGKIQPRPHDNQLTYVNGETKILSVDRGIRFPVLASKLSTVCGGGDGGGGEVTFKYQLPGEDLDALISVTNDDDLEHMMHEYDRLLRLSSKPARMRLFLFPASSGFGSQSSTQSDRDRFVEALNTVPRLSESEKSVTAPPNNADFLFGSEKVAAPPPPPPAEVKLPVPVALEPPLFNDPRVIQPDHVVNPMEIQRQMQEFQRMHIRDQEQQQQQEAVYRRKSNEDGLIETGGGYFSPPYIQNPAPPPPQQTIPQTNPQAPPMTTFWQGNHNPGVVFPTTTHGLGLPEQPVYMIPSPSPSPVYHAPPPPQPQGVIRPILTGQVNQGGYYPQVQRVASDTYREPHQSPYNVAQPLQAPIGTKAAQQQQPPPPQPFTSGPPPPQYTAVPPPRQVVGLPDTSAYTQVTYTGGMGKQVYYTEAPPPQYHGVGLPVTGMSELRTGPDGKLVAMNMAPKVSSQSSDSAV

SEQ ID NO: 9768 - protein, 523 aa, Arabidopsis thaliana
MTNTTKLCSSKPIVTVNGQFPGPTIVAREGDTILIKVVNHVKYNVSIHWTGWADGPAYITQCPIQPGQNYLHNFTLTGQRGTLWWHAHILWLRATVHGAIVILPKLGVPYPFPKPYKEKTIVLSEWWKSDVEELINEASRIGTAPSASDAHTINGHSGSISNCPSQSSYGLPVRAGKTYMLRIINAALNEELFFKIAGHVLTVVEVDAVYTKPYKTDTVFIAPGQTTNVLLTANANAGSNYMVAATTFTDAHIPYDNVTATATLHYIGHTSTVSTSKKTVLASLPPQNATWVATKFTRSLRSLNSLEYPARVPTTVEHSLFFTVGLGANPCQSCNNGVRLVAGINNVTFTMPKTALLQAHFFNISGVFTDDFPAKPSNPYDYTAPVKLGVNAATMKGTKLYRLPYNATVQIVLQNTAMILSDNHPFHLHGFNFFEVGRGLGNFNPEKDPKAFNLVDPVERNTVGVPAGGWTAIRFIADNPGVWFMHCHLELHTTWGLKMAFVVDNGHGPDQSLLPPPADLPKC

SEQ ID NO: 9769 - protein, 202 aa, Arabidopsis thaliana
MAEEEPKKVTETVSEPTPTPEVPVEKPAAAADVAPQEKPVAPPPVLPSPAPAEEKQEDSKAIVPVVPKEVEEEKKEGSVNRDAVLARVETEKRMSLIKAWEEAEKCKVENKAEKKLSSIGSWENNKKAAVEAELKKMEEQLEKKKAEYVEQMKNKIAQIHKEAEEKRAMIEAKRGEEILKAEELAAKYRATGTAPKKLFGCM

SEQ ID NO: 9770 - protein, 470 aa, Arabidopsis thaliana
MAATATEKLPQLKSAVDGLTEMSENEKSGFINLVSRYLSGEAQHIEWSKIQTPTDEIVVPYDKMANVSEDASETKYLLDKLVVLKLNGGLGTTMGCTGPKSVIEVRDGLTFLDLIVIQIENLNNKYNCKVPLVLMNSFNTHDDTQKIVEKYTKSNVDIHTFNQSKYPRVVADEFVPWPSKGKTDKDGWYPPGHGDVFPSLMNSGKLDAFLSQGKEYVFIANSDNLGAIVDLKILKHLIQNKNEYCMEVTPKTLADVKGGTLISYEGKVQLLEIAQVPDEHVNEFKSIEKFKIFNTNNLWVNLKAIKKLVEADALKMEIIPNPKEVDGVKVLQLETAAGAAIRFFDNAIGVNVPRSRFLPVKATSDLLLVQSDLYTLVDGFVTRNKARTNPTNPAIELGPEFKKVASFLSRFKSIPSIVELDSLKVSGDVWFGSGVVLKGKVTVKANAGTKLEIPDNAVLENKDINGPEDL

SEQ ID NO: 9771 - protein, 502 aa, Arabidopsis thaliana
MVLSHAVSESDVSVHSTFASRYVRTSLPRFKMPENSIPKEAAYQIINDELMLDGNPRLNLASFVTTWMEPECDKLIMSSINKNYVDMDEYPVTTELQNRCVNMIAHLFNAPLEEAETAVGVGTVGSSEAIMLAGLAFKRKWQNKRKAEGKPVDKPNIVTGANVQVCWEKFARYFEVELKEVKLSEGYYVMDPQQAVDMVDENTICVAAILGSTLNGEFEDVKLLNDLLVEKNKETGWDTPIHVDAASGGFIAPFLYPELEWDFRLPLVKSINVSGHKYGLVYAGIGWVIWRNKEDLPEELIFHINYLGADQPTFTLNFSKGSSQVIAQYYQLIRLGHEGYRNVMENCRENMIVLREGLEKTERFNIVSKDEGVPLVAFSLKDSSCHTEFEISDMLRRYGWIVPAYTMPPNAQHITVLRVVIREDFSRTLAERLVIDIEKVMRELDELPSRVIHKISLGQEKSESNSDNLMVTVKKSDIDKQRDIITGWKKFVADRKKTSGIC

SEQ ID NO: 9772 - protein, 287 aa, Arabidopsis thaliana
MYRDRGTVNSRPEVVDRKRINDALERPSPSTSRQVNGKGKGTVTAATTTANLIGKQQSNNINHRDSRSASLSKNNTVSDDESDTDSEESDVSGSDGEDTSWISWFCNLRGNEFFCEVDDDYIQDDFNLCGLSSLVPYYEYALDLILDVESSQGEMFTEEQNELIESAAEMLYGLIHARYILTSKGLAAMLDKYKNYDFGRCPRVYCCGQPCLPVGQSDLPRSSTVKIYCPKCEDIYYPRSKYQGNIDGAYFGTTFPHLFLMTYGHLKPAKATQNYVQRVFGFKLHKP

SEQ ID NO: 9773 - protein, 243 aa, Arabidopsis thaliana
MYGQCNIESDYALLESITRHLLGGGGENELRLNESTPSSCFTESWGGLPLKENDSEDMLVYGLLKDAFHFDTSSSDLSCLFDFPAVKVEPTENFTAMEEKPKKAIPVTETAVKAKHYRGVRQRPWGKFAAEIRDPAKNGARVWLGTFETAEDAALAYDIAAFRMRGSRALLNFPLRVNSGEPDPVRITSKRSSSSSSSSSSSTSSSENGKLKRRRKAENLTSEVVQVKCEVGDETRVDELLVS

SEQ ID NO: 9774 - protein, 176 aa, Arabidopsis thaliana
MGYPVGYTELLLPRIFLHLLSLLGLIRTLIDTGFRILGLPDFLESDPVSSSSSWLEPPYMSTAAHHHQESSFFFPVAARLAGEILPVIRFSELTRPGFGSGSDCCAVCLHEFENDDEIRRLTNCQHIFHRSCLDRWMMGYNQMTCPLCRTPFISDELQVAFNQRVWSESELLAESN

SEQ ID NO: 9775 - protein, 283 aa, Arabidopsis thaliana
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVGGPSSSNHHHNHRPVSINPWVACAGQVAHGLNFEALRPRS

SEQ ID NO: 9776 - protein, 364 aa, Arabidopsis thaliana
MQFFCVNLYRSVLNLLEERMKTEMIEEMVIVGGLVMVQFVYAGNSLLMSYLMSLGLGPFTIVIFSTFATFIILSPFAILFERKQWPNELSLRLIGKLVLISFAGVTLFQSLFLEGIRLTSPAMATAMPNLAPGLIFFIAWIVGLEKMNLKCVYSKLKILGTLLCVFGALAMSVMHSTSISHKEEDDTPIFVFDRDKVVGCIYLLGAVFVLSTNVVLQASTLAEFPAPISLSAITALLGVLITTVVLLLQNRKTKVLASSLISFGNLVGYSVLAGAVSGACVSFNGWAMKKRGPVFVSMFSPFATVISVAFAVLTLGESVSLGSVGGMVLMFVGLYLVLWAKGKEGFSEIESFESEFDSKKPLLS

SEQ ID NO: 9777 - protein, 166 aa, Arabidopsis thaliana
MRLLVAEAASPLSSAATPTCNSHTCRWKPYSNSTDFTANASVLLILVISALICALSLYAAIRCFLRPTLETEDDHKPDPEAAASSTPTTPTLVYSSDLELAGAEAECAICLSEFEQGESIQVLEKCQHGFHVKCIHKWLSTRSSCPTCRTSIFSQHSETPSSHINA

SEQ ID NO: 9778 - protein, 190 aa, Arabidopsis thaliana
MGDSDRDSGGGQNGNNQNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTGGEVGEHQRDAVGDGGGFYGGGGGMQYHQHHQFLHQQNHMYGATGGGSDSGGGAASGRTRT

SEQ ID NO: 9779 - protein, 464 aa, Arabidopsis thaliana
MSIMRNFLSMIIMLCVCLNWCFAEGAEKSDSGKVLDSYTIQVSSLFPSSSSCVPSSKASNTKSSLRVVHMHGACSHLSSDARVDHDEIIRRDQARVESIYSKLSKNSANEVSEAKSTELPAKSGITLGSGNYIVTIGIGTPKHDLSLVFDTGSDLTWTQCEPCLGSCYSQKEPKFNPSSSSTYQNVSCSSPMCEDAESCSASNCVYSIVYGDKSFTQGFLAKEKFTLTNSDVLEDVYFGCGENNQGLFDGVAGLLGLGPGKLSLPAQTTTTYNNIFSYCLPSFTSNSTGHLTFGSAGISESVKFTPISSFPSAFNYGIDIIGISVGDKELAITPNSFSTEGAIIDSGTVFTRLPTKVYAELRSVFKEKMSSYKSTSGYGLFDTCYDFTGLDTVTYPTIAFSFAGSTVVELDGSGISLPIKISQVCLAFAGNDDLPAIFGNVQQTTLDVVYDVAGGRVGFAPNGC

SEQ ID NO: 9780 - protein, 159 aa, Arabidopsis thaliana
MGLNLLRLLVQNRIAEFHTELGLLSSATLENPCIKHAVELEQSFMEGAYNRVLSARQTAPDETYVYFMDLLAKTIRDEIAGCSEKAYDHLSISEGCKMLLFSSDQQLLTYVNEEHPEWEVKDGLVVFQKTRETAPCKEIPSLQLINQTLSYTRELERIL

SEQ ID NO: 9781 - protein, 390 aa, Arabidopsis thaliana
MENGNSSSDNKSSHKPIRCKAAVSRKAGEPLVMEEIMVAPPQPFEVRIRIICTALCHSDVTFWKLQVPPACFPRILGHEAIGVVESVGENVKEVVEGDTVLPTFMPDCGDCVDCKSHKSNLCSKFPFKVSPWMPRYDNSSRFTDLNGETLFHFLNVSSFSEYTVLDVANVVKIDSSIPPSRACLLSCGVSTGVGAAWETAKVEKGSTVVIFGLGSIGLAVAEGARLCGASRIIGVDINPTKFQVGQKFGVTEFVNSMTCEKNRVSEVINEMTDGGADYCFECVGSSSLVQEAYACCRQGWGKTITLGVDKPGSQICLDSFDVLHHGKILMGSLFGGLKAKTHIPILLKRYLSNELELDKFVTHEMKFEEINDAFQLLLEGKCIRCVLWMG

SEQ ID NO: 9782 - protein, 320 aa, Arabidopsis thaliana
MACQNNLVVKQIIDLYDQISKLKSLKPSKNVDTLFGQLVSTCLPTDTNIDVTNMCEEVKDMRANLIKLCGEAEGYLEQHFSTILGSLQEDQNPLDHLHIFPYYSNYLKLGKLEFDLLSQHSSHVPTKIAFVGSGPMPLTSIVLAKFHLPNTTFHNFDIDSHANTLASNLVSRDPDLSKRMIFHTTDVLNATEGLDQYDVVFLAALVGMDKESKVKAIEHLEKHMAPGAVLMLRSAHALRAFLYPIVDSSDLKGFQLLTIYHPTDDVVNSVVIARKLGGPTTPGVNGTRGCMFMPCNCSKIHAIMNNRGKKNMIEEFSAIE

SEQ ID NO: 9783 - protein, 312 aa, Arabidopsis thaliana
MKRSRGSSDSLSGFLPIRHSTTDKQISPRPTTTGFLYSGAGDYSQMFDALEDDGSLEDLGGVGHASSTAAEKKRRLGVEQVKALEKNFEIDNKLEPERKVKLAQELGLQPRQVAIWFQNRRARWKTKQLERDYGVLKSNFDALKRNRDSLQRDNDSLLGQIKELKAKLNVEGVKGIEENGALKAVEANQSVMANNEVLELSHRSPSPPPHIPTDAPTSELAFEMFSIFPRTENFRDDPADSSDSSAVLNEEYSPNTVEAAGAVAATTVEMSTMGCFSQFVKMEEHEDLFSGEEACKLFADNEQWYCSDQWNS

SEQ ID NO: 9784 - protein, 308 aa, Arabidopsis thaliana
MAEENLELSLLCTESNVDDEGMIVDETPIEISIPQMGFSQSESEEIIMEMVEKEKQHLPSDDYIKRLRSGDLDLNVGRRDALNWIWKACEVHQFGPLCFCLAMNYLDRFLSVHDLPSGKGWILQLLAVACLSLAAKIEETEVPMLIDLQVGDPQFVFEAKSVQRMELLVLNKLKWRLRAITPCSYIRYFLRKMSKCDQEPSNTLISRSLQVIASTTKGIDFLEFRPSEVAAAVALSVSGELQRVHFDNSSFSPLFSLLQKERVKKIGEMIESDGSDLCSQTPNGVLEVSACCFSFKTHDSSSSYTHLS

SEQ ID NO: 9785 - protein, 298 aa, Arabidopsis thaliana; identical to SEQ ID NO: 828

SEQ ID NO: 9786 - protein, 652 aa, Arabidopsis thaliana
MENERVEREQSQFQEDEFIDSRKPPPWRKQITVRAIVASLLIGIVYSVICLKLNLTTGLVPNLNISSALLAFVFLKSWTKVLQKAGIATTPFTRQENTIAQTCAVACYSISLAGGFASYLLGLNRRTYEETGVNTEGNNPRGIKEPGVGWMTSFLFVTSFIGLVVLVPLRKVMIIDYKLTYPSGTATAVLINGFHTSKGDKTAKKQIRGFIKSFGLSFFWAFFGWFYSGGEKCGFSQFPTFGLQALDKTMTYVGAGMICSHLVNLSLLFGAILSWGIMWPLIARLKGEWFPATLKDNSMQGLNGYKVFICIALILGDGLYNFVKILFFTGRSFHSRLSKTNSISTYSTKESDNLKRENEVFVRESIPLWMACVGYLFFSLVSIIAIPLMFPQLKWYFVLVAYLLAPSLSFCNAYGAGLTDMNMAYNYGKAALFVMAALAGKNDGVVAGMVACGLIKSIVSVSADLMHDFKTGHLTQTSPRSMLVAQAIGTAIGCVVAPLTFFLFYKAFDVGNQNGEYKAPYAMIYRNMAIIGVQGPSALPKHCLELCYGFFAFAVAANLARDLLPDKPGKWIPLPMAMAVPFLVGGSFAIDMCIGSLVVYVWKKVNRKKADVMVPAVASGLICGDGLWILPSSLLALAKVRPPICMNFTAAH

SEQ ID NO: 9787 - protein, 341 aa, Arabidopsis thaliana
MDNSAPDSLSRSETAVTYDSPYPLYAMAFSSLRSSSGHRIAVGSFLEDYNNRIDILSFDSDSMTVKPLPNLSFEHPYPPTKLMFSPPSLRRPSSGDLLASSGDFLRLWEINEDSSTVEPISVLNNSKTSEFCAPLTSFDWNDVEPKRLGTCSIDTTCTIWDIEKSVVETQLIAHDKEVHDIAWGEARVFASVSADGSVRIFDLRDKEHSTIIYESPQPDTPLLRLAWNKQDLRYMATILMDSNKVVILDIRSPTMPVAELERHQASVNAIAWAPQSCKHICSGGDDTQALIWELPTVAGPNGIDPMSVYSAGSEINQLQWSSSQPDWIGIAFANKMQLLRV

SEQ ID NO: 9788 - protein, 577 aa, Arabidopsis thaliana
MALQLLLAVFSCVLLLPQPAFGITRHYTLEIKMQNVTRLCHTKSLVSVNGQFPGPKLIAREGDQVLIKVVNQVPNNISLHWHGIRQLRSGWADGPAYITQCPIQTGQSYVYNYTIVGQRGTLWYHAHISWLRSTVYGPLIILPKRGVPYPFAKPHKEVPMIFGEWFNADTEAIIRQATQTGGGPNVSDAYTINGLPGPLYNCSAKDTFRLRVKPGKTYLLRLINAALNDELFFSIANHTVTVVEADAIYVKPFETETILIAPGQTTNVLLKTKSSYPSASFFMTARPYVTGQGTFDNSTVAGILEYEPPKQTKGAHSRTSIKNLQLFKPILPALNDTNFATKFSNKLRSLNSKNFPANVPLNVDRKFFFTVGLGTNPCNHKNNQTCQGPTNTTMFAASISNISFTMPTKALLQSHYSGQSHGVYSPKFPWSPIVPFNYTGTPPNNTMVSNGTNLMVLPYNTSVELVMQDTSILGAESHPLHLHGFNFFVVGQGFGNFDPNKDPRNFNLVDPIERNTVGVPSGGWAAIRFLADNPGVWFMHCHLEVHTSWGLRMAWLVLDGDKPDQKLLPPPADLPKC

SEQ ID NO: 9789 - protein, 110 aa, Arabidopsis thaliana
MSGVWVFKNGVIRLVENPNQSGSDTQNRRKVMVYLPTGEVVSSYSTLEQILQSLGWERYFGGGDTDLLQFHKRSSIDLISLPRDFTKFNSVYMYDIVVKNPNYFHVRDSH

SEQ ID NO: 9790 - protein, 669 aa, Arabidopsis thaliana
MRSMMMEREGRNEIEREVIDDLEETQNEGDDFKSIPPWKEQITFRGIVASLIIGIIYSVIVMKLNLTTGLVPNLNVSAALLAFVFLRSWTKLLTKAGIVTKPFTKQENTVVQTCAVACYSIAVGGGFGSYLLGLNRITYEQSGGTHTDGNYPEGTKEPGIGWMTAFLFFTCFVGLLALVPLRKIMIIDYKLTYPSGTATAVLINGFHTPKGNKMAKKQVFGFVKYFSFSFIWAFFQWFFSGGTECGFIQFPTFGLEALKNTMTYVGAGMICPHIVNISLLFGAVLSWGIMWPLIKGLKGDWFPSTLPENSMKSLNGYKVFISISLILGDGLYQFIKILFKTGINMYVKLNNRNSGKSNSEKDKQSIADLKRDEIFVRDSIPLWVAAVGYAAFSVVSIIAIPIMFPELKWYFIVVAYMLAPSLGFSNAYGAGLTDMNMAYNYGKVALFILAAMAGKQNGVVAGLVGCGLIKSIVSISSDLMHDFKTGHLTLTSPRSMLVSQAIGTAIGCVVAPLTFFLFYKAFDVGNQEGEYKAPYALVYRNMAILGVEGFSALPQHCLQLCYGFFAFAVAANLVRDRLPDKIGNWVPLPMAMAVPFLVGGYFAIDMCVGSLIVFAWNMRDRVKAGLMVPAVASGLICGDGLWILPSSVLALAGVRPPICMGFMPSKYSS

SEQ ID NO: 9791 - protein, 370 aa, Arabidopsis thaliana
MSAIMKSLCFSFLILASFATFFSVADAWRFNVGGNGAWVTNPQENYNTWAERNRFQVNDSLYFKYAKGSDSVQQVMKADFDGCNVRNPIKNFENGESVVTLDRSGAFYFISGNQDHCQKGQKLIVVVLAVRNQPSAPAHSPVPSVSPTQPPKSHSPVSPVAPASAPSKSQPPRSSVSPAQPPKSSSPISHTPALSPSHATSHSPATPSPSPKSPSPVSHSPSHSPAHTPSHSPAHTPSHSPAHAPSHSPAHAPSHSPAHAPSHSPAHSPSHSPATPKSPSPSSSPAQSPATPSPMTPQSPSPVSSPSPDQSAAPSDQSTPLAPSPSETTPTADNITAPAPSPRTNSASGLAVTSVMSTLFSATFTFLMFA

SEQ ID NO: 9792 - protein, 267 aa, Arabidopsis thaliana
MEASPNDRLHFGKMGFGCKHYKRRCQIRAPCCNEVFDCRHCHNESTSTLRNIYDRHDLVRQDVKQVICSVCDTEQPAAQVCSNCGVNMGEYFCSICIFYDDDTEKQQFHCDDCGICRVGGRENFFHCKKCGSCYAVGLRNNHRCVENSMRHHCPICYEYLFDSLKDTNVMKCGHTMHVECYNEMIKRDKFCCPICSRSVIDMSKTWQRLDEEIEATAMPSDYRDKKVWILCNDCNDTTEVHFHIIGQKCGHCRSYNTRAIAPPVLPQ

SEQ ID NO: 9793 - protein, 490 aa, Arabidopsis thaliana
MYKQPRQELEAYYFEPNSVEKLRYLPVNNSRKRFCTLEPFPDSPPYNALSTATYDDTCGSCVTDELNDFKHKIREIETVMMGPDSLDLLVDCTDSFDSTASQEINGWRSTLEAISRRDLRADLVSCAKAMSENDLMMAHSMMEKLRQMVSVSGEPIQRLGAYLLEGLVAQLASSGSSIYKALNRCPEPASTELLSYMHILYEVCPYFKFGYMSANGAIAEAMKEENRVHIIDFQIGQGSQWVTLIQAFAARPGGPPRIRITGIDDMTSAYARGGGLSIVGNRLAKLAKQFNVPFEFNSVSVSVSEVKPKNLGVRPGEALAVNFAFVLHHMPDESVSTENHRDRLLRMVKSLSPKVVTLVEQESNTNTAAFFPRFMETMNYYAAMFESIDVTLPRDHKQRINVEQHCLARDVVNIIACEGADRVERHELLGKWRSRFGMAGFTPYPLSPLVNSTIKSLLRNYSDKYRLEERDGALYLGWMHRDLVASCAWK

SEQ ID NO: 9794 - protein, 373 aa, Arabidopsis thaliana
MGYMCDFCGEQRSMVYCRSDAACLCLSCDRNVHSANALSKRHSRTLVCERCNAQPASVRCSDERVSLCQNCDWSGHDGKNSTTTSHHKRQTINCYSGCPSSAELSSIWSFCMDLNISSAEESACEQGMGLMTIDEDGTGEKSGVQKINVEQPETSSAAQGMDHSSVPENSSMAKELGVCEDDFNGNLISDEVDLALENYEELFGSAFNSSRYLFEHGGIGSLFEKDEAHEGSMQQPALSNNASADSFMTCRTEPIICYSSKPAHSNISFSGITGESNAGDFQDCGASSMKQLSREPQPWCHPTAQDIIASSHATTRNNAVMRYKEKKKARKFDKRVRYVSRKERADVRRRVKGRFVKSGEAYDYDPMSPTRSY

SEQ ID NO: 9795 - protein, 350 aa, Arabidopsis thaliana
MAAENERKSPSAVSDMGAWAMNVISSVGIIMANKQLMSSSGFAFSFATTLTGFHFALTALVGMVSNATGFSASKHVPMWELIWFSIVANVSIAAMNFSLMLNSVGFYQISKLSMIPVVCVMEWILHSKRYSREVKISVVVVVVGVGICTVTDVKVNAKGFICACVAIFSSSLQQILIGSLQKKYSIGSFELLSKTAPIQAFSLLVVGPLVDYLLSGKFIMKYNMSSGCFLFILLSCGLAVFCNISQYLCIGRFSAVSFQVIGHMKTVCILTLGWLLFDSAMTFKNVAGMIVAIVGMVIYSWAMELEKQSIIAAKALNSVKHSLTEEEFELLKEGVETTQSKDVELGRTKD

SEQ ID NO: 9796 - protein, 351 aa, Arabidopsis thaliana
MGKGGALSESVIKNIVLSYSYVAIWIFLSFTVIVYNKYILDKKMYNWPFPISLTMIHMSFCSTLAFLIIKVFKFVEPVKMTRETYLRSVVPIGALYALSLWLSNSAYIYLSVSFIQMLKALMPVAVYSIGVLFKKEGFKSDTMMNMLSISFGVAIAAYGEARFDVWGVILQLGAVAFEATRLVLIQILLGDKGIKLNPITSLYYVAPCCLAFLFIPWIYVEFPVLRDTSSFHLDYAIFGANSFCAFALNLAVFLLVGKTSALTMNVAGVVKDWLLIAFSWSVIKDTVTPINLFGYGIAFLGVAYYNHAKLQALKAKEEEKKKIQQADEESGRLLEEREGDVEGKKNDQSGN

SEQ ID NO: 9797 - protein, 700 aa, Arabidopsis thaliana
MGSASIGYQFGISARFYGNFNLSSDITVSSLPCKLDVSIKSLFSAPSSTHKEYSNRARVCSLPNTDGYCDEKFETPILDSIETPLQLKNLSVKELKLLADEIRTELHSVLWKKTQKSMNPSFAAIELTLALHYVFRAPVDNILWDAVEQTYAHKVLTRRWSAIPSRQNSGISGVTSRLESEYDSFGTGHGCNSISAGLGLAVARDMKGKRDRVVAVIDNVTITAGQAYEAMSNAGYLDSNMIVILNDSRHSLHPNMEEGSKASISALSSIMSKIQSSKVFRKFRELAKAMTKRIGKGMYEWAAKVDEYARGMVGPTGSTLFEELGLYYIGPVDGHNIEDLVCVLREVSSLDSMGPVLVHVITEGNRDAETVKNIMVKDRRTYSDCFVEALVMEAEKDRDIVVVHAGMEMDPSLLTFQERFPDRFFNVGMAEQHAVTFSAGLSSGGLKPFCIIPSAFLQRAYDQVVHDVDRQRKAVRFVITSAGLVGSDGPVQCGAFDIAFMSSLPNMIAMAPADEDELVNMVATAAYVTDRPVCFRFPRGSIVNMNYLVPTGLPIEIGRGRVLVEGQDVALLGYGAMVQNCLHAHSLLSKLGLNVTVADARFCKPLDIKLVRDLCQNHKFLITVEEGCVGGFGSHVAQFIALDGQLDGNIKWRPIVLPDGYIEEASPREQLALAGLTGHHIAATALSLLGRTREALLLMS

SEQ ID NO: 9798 - protein, 496 aa, Arabidopsis thaliana
MAARIRLDAVISTIVTVHPHELPALLHSSSCFFFILSAYFVVLPLRDEGAISLGLSKLPGLFVGSLFLTLIAAPLSTFIFSLPNLSKSKALVIIHRFFSLSLVLCFLLWMASPTESNSKDAVEAASGLTNDGANAATGWDNHGWFYISVRVGFFLWVALLNLVAISSTWARIIDVMDIQSGARLFGFVGAGATLGQLFGSVFAAATAWMGPYLLLFAALLMEFAAQSSKGITNDISQSSEELSPLRGTDNDHQRERKQEATSPKVGSPKVASPKSPISTTRPQFWAILDGMRLILASPYLLLVSLFLWLGAVISSFFYFQKVNIIATTIKSSIGRRRLFAQINSFVAVFILIGQLTLTGRILTVAGVTVAISASPFVALGNLVAIAIWPTWVTVAVSETLRKVTTYVVTRPGRELLFTVVSQDEKYKAKVCIDVIVQRLGDAAAAGLFEVLTIALGGQTSTASLYALPVCLIWIVTAFFLGRRQEQLAKLQVGSSS

SEQ ID NO: 9799 - protein, 565 aa, Arabidopsis thaliana
MTTVHTFSILLFFCSLFSASLIIAKVQHHDFVIQETPVKRLCKTRNAITVNGMFPGPTLEVNNGDTLEVKVHNRARYNITIHWHGVRQIRTGWADGPEFVTQCPIRPGKSYTYRFTIQGQEGTLWWHAHSSWLRATVYGALIIHPTPGSSFPFPKPDRQTALMLGEWWNANPVDVINQATRTGAAPNISDAYTINGQPGDLYNCSTKETVVVPINSGETSLLRVINAALNQPLFFTVANHKLTVVGADASYLKPFTTKVLMLGPGQTTDVLLTADQPPKRYYIAARAYQSAQNAPFDNTTTTAILQYKKTTTTSKPIMPVLPAFNDTNTVTSFSRKFKSLRNVVVPKTIDDNLFFTIGLGLDNCPKKFPKSRCQGLNGTRFTASMNNVSFVLPSNFSLLQAHSNGIPGVFTTDFPSKPPVKFDYTGNNISRALFQPVKGTKLYKLKYGSRVQVVLQDTNIVTSENHPIHLHGYDFYIVGEGFGNFNPKKDTSKFNLVDPPLRNTVAVPVNGWAVIRFVADNPGVWLMHCHLDVHIKWGLAMAFLVDNGVGELETLEAPPHDLPIC

SEQ ID NO: 9800 - protein, 691 aa, Arabidopsis thaliana
MQGERASLGYLSEALNFEHGSSSSNGVIDHWENIHSLGDNDLQDYMIANSESNTSLANSVYHEQQGLRRFSLGEASSSGTKDEASSHNEQRMETRCFDGRGNEIIDLDPVFAQPSGTNQPVQNVNLNAEYIEIHEDINPYRGRSGFIEANGPGTRVSQPGRSFEENGVGTGSSVEGRRASCKRKALEGSISQSSSGGYHDFQRGESSSWTPGSTVFRPGNGLNISGSLDNGPRGMVSGTVPNFPVSAPNFPVSAIAESSSRNICVRSNPSDHQETVNPSTFAAGTVVRRPVPPSQLNLSRHLPADQHSLDLRPGQSFVVSRNPNSTPVSIPPGSRTMLPPFRWTGSSLVGGTSNSTAPVERNLHLDETRSRSIPGNTLEIPMFAAPEVGNFARSQSSRNVTNGNLNSASSVSRTGSTTSVPPPPPPSSNLAWTSYQNSPHYQRRRTERSELARRSLLSSLAADATNQRSGDHPTLRSLAPPASSDGLVLQPGGDNSQMHNRAYSRAGPLFDRQGDSVVGIPHPLRALAAASRGRSRLMVSQMQNVLDVMRRDANNNNLRLEDVMLLNHSVLFDGATGHDRYRDMRLDVDNMSYEELLALEERIGDVCTGVNEETISNRLKQRKYKSNTKSPQDAEPCCVCQEEYTEGEDMGTLECGHEFHSQCIKEWLKQKNLCPICKTTGLNTAKKRRIA

SEQ ID NO: 9801 - protein, 221 aa, Arabidopsis thaliana
MDGYYSLSPISVLHRIKDSFHFAVSALLANLFSALFTFFFALVGTLLGALTGALIGQETESGFIRGAAVGAISGAVFSIEVFESSLLLWQSDESGIGCLLYLIDVIASLLSGRLVRERIGPAMLSAVQSQMGAVESQFQDHTDIFDTAISKGLTGDSLNRIPKVRITDTSPEIVSCSVCLQDFQVGETVRSLPHCHHMFHLPCIDKWLRRHASCPLCRRHL

SEQ ID NO: 9802 - protein, 310 aa, Arabidopsis thaliana
MRLVVSSCLLVAAPFLSSLLRVSLATVVLNSISASFADLPAKFDGSVTKNGICGALYVADPLDGCSPLLHAAASNWTQHRTTKFALIIRGECSFEDKLLNAQNSGFQAVIVYDNIDNEDLIVMKVNPQDITVDAVFVSNVAGEILRKYARGRDGECCLNPPDRGSAWTVLAISFFSLLLIVTFLLIAFFAPRHWTQWRGRHTRTIRLDAKLVHTLPCFTFTDSAHHKAGETCAICLEDYRFGESLRLLPCQHAFHLNCIDSWLTKWGTSCPVCKHDIRTETMSSEVHKRESPRTDTSTSRFAFAQSSQSR

SEQ ID NO: 9803 - protein, 264 aa, Arabidopsis thaliana
METDKRWSLAGKTALVTGGTRGIGRAVVEELAKFGAKVHTCSRNQEELNACLNDWKANGLVVSGSVCDASVRDQREKLIQEASSAFSGKLNILINNVGTNVRKPTVEYSSEEYAKIMSTNLESAFHLSQIAHPLLKASGVGSIVFISSVAGLVHLSSGSIYGATKGALNQLTRNLACEWASDNIRTNCVAPWYIKTSLVETLLEKKEFVEAVVSRTPLGRVGEPEEVSSLVAFLCLPASSYITGQVISVDGGFTVNGFSYAMKP

SEQ ID NO: 9804 - protein, 527 aa, Arabidopsis thaliana [sequence omitted]

SEQ ID NO: 9805 - protein, 539 aa, Arabidopsis thaliana
MTHNHSNEEGSIGTSLHGVTAREQVFSFSVDASSQTVQSDDPTAKFALPVDSEHRAKVFNPLSFAKPHMRAFHLGWLSFFTCFISTFAAAPLVPIIRDNLDLTKTDIGNAGVASVSGAIFSRLAMGAVCDLLGARYGTAFSLMLTAPTVFSMSFVGGPSGYLGVRFMIGFCLATFVSCQYWTSVMFNGKIIGLVNGCAGGWGDMGGGVTQLLMPMVFHVIKLAGATPFMAWRIAFFVPGFLQVVMGILVLSLGQDLPDGNLSTLQKSGQVSKDKFSKVFWFAVKNYRTWILFVLYGSSMGIELTINNVISGYFYDRFNLKLQTAGIVAASFGMANFIARPFGGYASDVAARVFGMRGRLWTLWIFQTVGALFCIWLGRASSLPIAILAMMLFSIGTQAACGALFGVAPFVSRRSLGLISGLTGAGGNFGSGLTQLLFFSSARFSTAEGLSLMGVMAVLCTLPVAFIHFPQWGSMFLRPSTDGERSQEEYYYGSEWTENEKQQGLHEGSIKFAENSRSERGRKVALANIPTPENGTPSHV

SEQ ID NO: 9806 - protein, 309 aa, Arabidopsis thaliana
MAFLSKFGNILKQTTNKQLNAQVSLSSPSLFQAIRCMSSSKLFIGGMAYSMDEDSLREAFTKYGEVVDTRVILDRETGRSRGFGFVTFTSSEAASSAIQALDGRDLHGRVVKVNYANDRTSGGGFGGGGYGGGGGGYGGSGGYGGGAGGYGGSGGYGGGAGGYGGNSGGGYGGNAAGGYGGSGAGGYGGDATGHGGAGGGYGSSGGFGSSGNTYGEGSSASAGAVGDYNGSSGYGSANTYGSSNGGFAGDSQFGGSPVGNSSQFGGDNTQFTAGGQFGGEDQFGSMEKSETKMEDGPIGGEFEDVAKRA

SEQ ID NO: 9807 - protein, 612 aa, Arabidopsis thaliana
MPEAPKIAALEVSDESLAEKNKNKLQFIEDVTTNADDVQRRVLEEILSRNADVEYLKRHGLEGRTDRETFKHIMPVVTYEDIQPEINRIANGDKSQVLCSNPISEFLTSSGTSGGERKLMPTIEEELDRRSLLYSLLMPVMDQFVPGLDKGKGMYFLFIKSESKTPGGLPARPVLTSYYKSSHFKNRPYDPYTNYTSPNQTILCSDSYQSMYSQMLCGLCQHKEVLRVGAVFASGFIRAIKFLEKHWPELARDIRTGTLSSEITDSSVREAVGEILKPDPKLADFVESECRKTSWQGIITRLWPNTKYVDVIVTGTMSQYIPTLDYYSNGLPLVCTMYASSECYFGVNLRPLCKPSEVSYTLIPNMAYFEFLPVHRNSGVTSSISLPKALTEKEQQELVDLVDVKLGQEYELVVTTYAGLYRYRVGDVLSVAGFKNNAPQFSFICRKNVVLSIDSDKTDEVELQNAVKNAVTHLVPFDASLSEYTSYADTSSIPGHYVLFWELCLNGNTPIPPSVFEDCCLTIEESLNSVYRQGRVSDKSIGPLEIKMVESGTFDKLMDYAISLGASINQYKTPRCVKFAPIIELLNSRVVDSYFSPKCPKWSPGHKQWGSN

SEQ ID NO: 9808 - protein, 253 aa, Arabidopsis thaliana
MASNFWTSTHYKELKDPEEVNVVHPLDAQRGISVEDFRLIKLHMSNYISKLAQHIKIRQRVVATAVTYMRRVYTRKSLTEYEPRLVAPTCLYLACKAEESVVHAKLLVFYMKKLYADEKFRYEIKDILEMEMKVLEALNFYLVVFHPYRSLPEFLQDSGINDTSMTHLTWGLVNDTYRMDLILIHPPFLITLACIYIASVHKEKDIKTWFEELSVDMNIVKNIAMEILDFYENHRLFTEERVHAAFNKLATNP

SEQ ID NO: 9809 - protein, 259 aa, Arabidopsis thaliana
MAANFWNSSHYKQLLDPEEVDVVHDLDKERGISIDDFKLIKFHMSNHIMKLAQHIKVRQRVVATAITYMRRVYIRKSMVEFEPRLVALTCLYLASKAEESIVQARNLVFYIKRLCNIFFFYPDEYNKYELKDILGMEMKVLEALDYYLVVFHPYRSLSEFLQDAALNDVNMNQITWGIVNDTYKMDLILVHPPYRIALACIYIASVHREKDITAWFEDLHEDMNLVKNIAMEILDFYENYRTITEEKVNSAFSKLALKL

SEQ ID NO: 9810 - protein, 807 aa, Arabidopsis thaliana
MPTGRFETMREWVYDAISAQRNELLSLFSRYVAQGKGILQSHQLIDEFLKTVKVDGTLEDLNKSPFMKVLQSAEEAIVLPPFVALAIRPRPGVREYVRVNVYELSVDHLTVSEYLRFKEELVNGHANGDYLLELDFEPFNATLPRPTRSSSIGNGVQFLNRHLSSIMFRNKESMEPLLEFLRTHKHDGRPMMLNDRIQNIPILQGALARAEEFLSKLPLATPYSEFEFELQGMGFERGWGDTAQKVSEMVHLLLDILQAPDPSVLETFLGRIPMVFNVVILSPHGYFGQANVLGLPDTGGQVVYILDQVRALENEMLLRIQKQGLEVIPKILIVTRLLPEAKGTTCNQRLERVSGTEHAHILRIPFRTEKGILRKWISRFDVWPYLETFAEDASNEISAELQGVPNLIIGNYSDGNLVASLLASKLGVIQCNIAHALEKTKYPESDIYWRNHEDKYHFSSQFTADLIAMNNADFIITSTYQEIAGSKNNVGQYESHTAFTMPGLYRVVHGIDVFDPKFNIVSPGADMTIYFPYSDKERRLTALHESIEELLFSAEQNDEHVGLLSDQSKPIIFSMARLDRVKNLTGLVECYAKNSKLRELANLVIVGGYIDENQSRDREEMAEIQKMHSLIEQYDLHGEFRWIAAQMNRARNGELYRYIADTKGVFVQPAFYEAFGLTVVESMTCALPTFATCHGGPAEIIENGVSGFHIDPYHPDQVAATLVSFFETCNTNPNHWVKISEGGLKRIYERYTWKKYSERLLTLAGVYAFWKHVSKLERRETRRYLEMFYSLKFRDLANSIPLATDEN

SEQ ID NO: 9811 - protein, 131 aa, Arabidopsis thaliana; identical to SEQ ID NO: 883

SEQ ID NO: 9812 - protein, 509 aa, Drosophila melanogaster
MATTTTTTTTTGATNAKDGVTMREKKGGALQKLKKRLSHSFGRLTISREDGDESTHHHHHHHHHRGGHGGHHNHGNKVPYNGYNSEEYLDRLEPNGNIPADKTNCRYGDWRSTDSTDHHDRVQRQLSVSSDSKLLDEDIREEMKYHSHVVMRPKKPPRPKSEVFLNKQETHPRRKRFSAFGGDSPFGKQEAYVKLEPLGEGSYATVYKGFSKLTYQRVALKEIRLQEEEGAPFTAIREASLLKELKHSNIVTLHDIVHTRETLTFVFEYCDTDLSQYMEKHPGGLDHRNVRLFLFQLLRGLSYCHKRRVLHRDVKPQNLLISDCGELKLADFGLARAKSVPSHTYSHEVVTLWYRPPDVLLGSTEYSTSLDMWGVGCIFVEMVTGMPTFPGIRDTYDQLDKIFKLLGTPTEDTWPGVTHFPGYKPHKLGFYRPRKLGHNFPRLYDIIEGETIANGFLQLNPEQRLGADDALQHPYFAQLPKKLYELPDETSIFTVEGVQLYTEPNRQNK

SEQ ID NO: 9813 - protein, 379 aa, Arabidopsis thaliana
MATQGQVITCKAAVAYEPNKPLVIEDVQVAPPQAGEVRIKILYTALCHTDAYTWSGKDPEGLFPCILGHEAAGIVESVGEGVTEVQAGDHVIPCYQAECRECKFCKSGKTNLCGKVRSATGVGIMMNDRKSRFSVNGKPIYHFMGTSTFSQYTVVHDVSVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNLTLGEINKAFDLLHEGTCLRCVLDTSK

SEQ ID NO: 9814 - protein, 843 aa, Arabidopsis thaliana
MEMTSGSLGNGIPEAMGQNRGNIKRCLEKYIENGRRVMKLNELMDEMEIVINDVTQRRRVMEGDLGKILCFTQAVVIPPNVAFAVRGTPGNWQYVKVNSSNLSVEALSSTQYLKLKEFLFDENWANDENALEVDFGALDFTLPWLSLSSSIGNGLSFVSSKLGGRLNDNPQSLVDYLLSLEHQGEKLMMNETLNTARKLEMSLILADVFLSELPKDTPFQAFELRFKECGFEKGWGESAGRVKETMRILSEILQAPDPQNIDRFFARVPRIFNVVIFSVHGYFGQTDVLGLPDTGGQVVYILDQVKALEDELLQRINSQGLNFKPQILVVTRLIPDAKKTKCNQELEPIFGTKYSNILRIPFVTENGILRRWVSRFDIYPYLERFTKVKSYIRMDATTKILDILEGKPDLIIGNYTDGNLVASLMANKLGITQATIAHALEKTKYEDSDIKWKEFDPKYHFSSQFTADLISMNSADFIIASTYQEIAGSKERAGQYESHMSFTVPGLYRVVSGINVFDPRFNIAAPGADDSIYFPFTAQDRRFTKFYTSIDELLYSQSENDEHIGYLVDKKKPIIFSMARLDVVKNLTGLTEWYAKNKRLRDLVNLVIVGGFFDASKSKDREEISEIKKMHSLIEKYQLKGQFRWITAQTDRTRNGELYRSIADTRGAFVQPAHYEAFGLTVIEAMSCGLVTFATNQGGPAEIIVDGVSGFHIDPSNGEESSDKIADFFEKSGMDPDYWNMFSNEGLQRINECYTWKIYANKVINMGSTYSYWRHLNKDQKLAKQRYIHSFYNLQYRNLVKTIPILSDIPEPPPLPPKPLVKPSASKGSKRTQPRLSFRLFGA

SEQ ID NO: 9815 - protein, 240 aa, Arabidopsis thaliana
MDARKRGRPEAAASHNSNGGFKRSKQEMESISTGLGSKSKPCTKFFSTSGCPFGDNCHFLHYVPGGYNAAAQMTNLRPPVSQVSRNMQGSGGPGGRFSGRGDPGSGPVSIFGASTSKISVDASLAGAIIGKGGIHSKQICRETGAKLSIKDHERDPNLKIIELEGTFEQINVASGMVRELIGRLGSVKKPQGIGGPEGKPHPGSNYKTKICDRYSKGNCTYGDRCHFAHGESELRRSGIA

SEQ ID NO: 9816 - protein, 607 aa, Arabidopsis thaliana
MEESMNIQLKGREILVSESHEELAMIVDHLFKSDEDSEEYKTSQALYNYCVSFNPGCLAVKLLKLYQSSSDGVLRFRSIYQLSETLTGLRNRKLSLDCLYEIKTLLIACLTMQETKECDIKILRRIVSCVAYNVMDLHKYKWDELGDCILSLVNSNDPVKGFHVFIDLPQVYEEFIQKFMKIMFKKATDVLVNPEESGVEDWSLALQIVVKLGIQFFDTRMKRNVIKKLMSFQLLNILESAKKLVDMGNETFLVRVLRDFERFVSRDMNLYKYSELHCYFVSKFVSKIGKVRGVGTQTKELVTKINMLFTKQYHGKESLRGWYDHLKSLSLLEVLKIFASTDLEDRARDMAIRQLNVLLSDHTSKRVEIEIAEMRQLQPLLMSCLKEQGVSYSMFKVLGEVVNHVAYEMLVCQEKRWDDLRDYVASQSETEFQRAVYVFQCLTMQLIDDGFLDPEIAHKMIDSIRELVEREMEVGIVRRAFRDVETIVKKQLEWYSTSQYRFVKGLLWRLYAIKGMKWGSKMVLWRINFIVERGVKEEEKQLPETEFDWLNLHDDDGDDGDDDDGDDDDDDGDDDGDDDDDDGDDGDDDDDDDGDDGDDDDDDDDGG

SEQ ID NO: 9817 - protein, 435 aa, Arabidopsis thaliana
MGFLWRTRSNEKKITPVLSWPESEPESEITIPPEFQCPISIDLMKDPVIISTGITYDRVSIETWINSGNKTCPVTNTVLTTFDQIPNHTIRKMIQGWCVEKGSPLIQRIPTPRVPLMPCEVYEISRKLSSATRRGDYEKCGVIIEKIKKLGDESEKNRKCVNENSVGWVLCDCFDKFSGDEKLTFMLNEILSLLTWMFPIGLEGISKLASATSFRCVAGLLKSTDDSVRQNAAFIMKEILSLDETRVHSFAVENGVAEALVKLIRDSVSSSSTKSSLIAIYQMVLQKPEIASEFLEIGLVSITVEMIVDAENSVCEKALAVLDAICETEHGREEVRKNALVMPLLVKKIAKVSELATRSSMSMILKLWKTGNTVAVEDAVRLGAFQKVLLVLQVGYGEETKEKATELLKMMNTQMKLMSDCVDSLKEFKYIKKPF

SEQ ID NO: 9818 - protein, 420 aa, Arabidopsis thaliana
MDPEGFTSGLFRWNPTRALVQAPPPVPPPLQQQPVTPQTAAFGMRLGGLEGLFGPYGIRFYTAAKIAELGFTASTLVGMKDEELEEMMNSLSHIFRWELLVGERYGIKAAVRAERRRLQEEEEEESSRRRHLLLSAAGDSGTHHALDALSQEGLSEEPVQQQDQTDAAGNNGGGGSGYWDAGQGKMKKQQQQRRRKKPMLTSVETDEDVNEGEDDDGMDNGNGGSGLGTERQREHPFIVTEPGEVARGKKNGLDYLFHLYEQCREFLLQVQTIAKDRGEKCPTKVTNQVFRYAKKSGASYINKPKMRHYVHCYALHCLDEEASNALRRAFKERGENVGSWRQACYKPLVNIACRHGWDIDAVFNAHPRLSIWYVPTKLRQLCHLERNNAVAAAAALVGGISCTGSSTSGRGGCGGDDLRF

SEQ ID NO: 9819 - protein, 538 aa, Arabidopsis thaliana
MLDSLVSKLPSLSTSDHASVVALNLFVALLCACIVLGHLLEENRWMNESITALLIGLGTGVTILLISKGKSSHLLVFSEDLFFIYLLPPIIFNAGFQVKKKQFFRNFVTIMLFGAVGTIISCTIISLGVTQFFKKLDIGTFDLGDYLAIGAIFAATDSVCTLQVLNQDETPLLYSLVFGEGVVNDATSVVVFNAIQSFDLTHLNHEAAFHLLGNFLYLFLLSTLLGAATGLISAYVIKKLYFGRHSTDREVALMMLMAYLSYMLAELFDLSGILTVFFCGIVMSHYTWHNVTESSRITTKHTFATLSFLAETFIFLYVGMDALDIDKWRSVSDTPGTSIAVSSILMGLVMVGRAAFVFPLSFLSNLAKKNQSEKINFNMQVVIWWSGLMRGAVSMALAYNKFTRAGHTDVRGNAIMITSTITVCLFSTVVFGMLTKPLISYLLPHQNATTSMLSDDNTPKSIHIPLLDQDSFIEPSGNHNVPRPDSIRGFLTRPTRTVHYYWRQFDDSFMRPVFGGRGFVPFVPGSPTERNPPDLSKA

SEQ ID NO: 9820 - protein, 431 aa, Arabidopsis thaliana
MLLKIKRVPTVVSNYQKDETVEEGGCGRNCLSKCCINGARLPLYTCKNLDKSVGENTESPVTFLESLVIGEWEDRFQRGLFRYDVTACETKVIPGKYGFIAQLNEGRHLKKRPTEFRVDKVLQPFDGNKFNFTKVGQEELLFQFKASTNDDDSEIQFLASMPLDADNSPSVVAINVSPIEYGHVLLIPRVLDCLPQRIDHKSLLLALQMAAEADNPYFRLGYNSLGAFATINHLHFQAYYLAMQFPIEKASSLKITTTNNGVKISKLLNYPVRGLLVEGGNTIKDLADTVSDASVCLQNNNIPFNILISDSGKRIFLLPQCYAEKQALGEVSSTLLDTQVNPAVWEMSGHMVLKRKEDYEGASEEKAWRLLAEVSLSEERFREVNTMIFDAIGFSSHEEEEEEELEEQNSMNGGSFTIVHCPSVKEEAVSN

SEQ ID NO: 9821 - protein, 529 aa, Arabidopsis thaliana
MSIGLTEFVTNKLAAEHPQVIPISVFIAILCLCLVIGHLLEENRWVNESITAILVGAASGTVILLISKGKSSHILVFDEELFFIYLLPPIIFNAGFQVKKKKFFHNFLTIMSFGVIGVFISTVIISFGTWWLFPKLGFKGLSARDYLAIGTIFSSTDTVCTLQILHQDETPLLYSLVFGEGVVNDATSVVLFNAVQKIQFESLTGWTALQVFGNFLYLFSTSTLLGIGVGLITSFVLKTLYFGRHSTTRELAIMVLMAYLSYMLAELFSLSGILTVFFCGVLMSHYASYNVTESSRITSRHVFAMLSFIAETFIFLYVGTDALDFTKWKTSSLSFGGTLGVSGVITALVLLGRAAFVFPLSVLTNFMNRHTERNESITFKHQVIIWWAGLMRGAVSIALAFKQFTYSGVTLDPVNAAMVTNTTIVVLFTTLVFGFLTKPLVNYLLPQDASHNTGNRGKRTEPGSPKEDATLPLLSFDESASTNFNRAKDSISLLMEQPVYTIHRYWRKFDDTYMRPIFGGPRRENQPEC

SEQ ID NO: 9822 - protein, 385 aa, Arabidopsis thaliana
MVEQTQHPTILQKVSGQLLSSSVSQDIRGYASASKRPATYQKHAAYGNYSNAAFQYPLVAASQIATTTSPVFVQAPGEKGFTNFAIDFMMGGVSAAVSKTAAAPIERVKLLIQNQDEMLKAGRLTEPYKGIRDCFGRTIRDEGIGSLWRGNTANVIRYFPTQALNFAFKDYFKRLFNFKKDKDGYWKWFAGNLASGGAAGASSLLFVYSLDYARTRLANDSKSAKKGGGERQFNGLVDVYKKTLKSDGIAGLYRGFNISCAGIIVYRGLYFGLYDSVKPVLLTGDLQDSFFASFALGWLITNGAGLASYPIDTVRRRMMMTSGEAVKYKSSFDAFSQIVKKEGAKSLFKGAGANILRAVAGAGVLAGYDKLQLIVFGKKYGSGGA

SEQ ID NO: 9823 - protein, 402 aa, Arabidopsis thaliana
MSMEEISSCESFLTSSKPYFAMISLQFGYAGMNIITKISLNTGMSHYVLVVYRHAIATAVIAPFAFFFERKAQPKITFSIFMQLFILGLLGPVIDQNFYYMGLKYTSPTFSCAMSNMLPAMTFILAVLFRMEMLDLKKLWCQAKIAGTVVTVAGAMLMTIYKGPIVELFWTKYMHIQDSSHANTTSSKNSSSDKEFLKGSILLIFATLAWASLFVLQAKILKTYAKHQLSLTTLICFIGTLQAVAVTFVMEHNPSAWRIGWDMNLLAAAYSGIVASSISYYVQGIVMKKRGPVFATAFSPLMMVIVAVMGSFVLAEKIFLGGVIGAVLIVIGLYAVLWGKQKENQVTICELAKIDSNSKVTEDVEANGSKMKISEGDNSMLSTIVISVPLSETHLKKTIQEP

SEQ ID NO: 9824 - protein, 569 aa, Arabidopsis thaliana
MEQLRPFFLLLAIFVASLVNAEVHFHEFVIQETPVKRLCRVHNSITVNGQFPGPTLEVRNGDSLVITAINKARYNISLHWHGIRQMRNPWADGPEYITQCPIQPGGSYTYRFTMEDQEGTLWWHAHSRWLRATVYGALIIRPPLSSPHYPFPVIPKREITLLLGEWWDRNPMDVLNLAQFTGAAPNISDAFTINGQPGDLYRCSSQETLRFLVGSGEIVLLRVINSALNQELFFGVANHKLTVVAADASYTKPFSTNVIMLGPGQTTDVLLTADQPPAHYYMAAHAYNSANAAFDNTTTTAILKYKDASCVTLQAKSQARAIPAQLPGFNDTATAAAFTAQMKSPSKVKVPLEIDENLFFTVGLGLFNCPTPNTQRCQGPNGTRFTASINNVSFVFPKQNSIMQAYYQGTPTGVFTTDFPPTPPVTFDYTGNVSRGLWQPTRGTKAYKLKFNSQVQIILQDTSIVTTENHPMHLHGYEFYVVGTGVGNFNPNTDTSSFNLIDPPRRNTIGTPPGGWVAIRFVANNPGAWLMHCHIDSHIFWGLAMVFLVENGEGHLQSVQSPPLDLPQC

SEQ ID NO: 9825 - protein, 305 aa, Arabidopsis thaliana
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAVVLPLPIETSSSSDDPPTSLSLSLPGADVSEESNRSHESTNINNTTSSRHNHNNTVSFMPFSGGFRGAIEEMGKSFPGNGGEFMAVVQEMIKAEVRSYMTEMQRNNGGGFVGGFIDNGMIPMSQIGVGRIE

SEQ ID NO: 9826 - protein, 542 aa, Arabidopsis thaliana
MLDIAFELIGDATSNSLLMFCFCNLIIVMIFTGSLKPGLKDSQDSTFVTSVSYDMGNISSDDHYCGDDDENMKIAAAIPSSQDDPLIDDSSSDEEDDSESTHCYAADDDADDTDDDEDDDDDDDDDDDDDDDDDDDDDDDDDDESKDSEVEEEEGDDDLRMRKIDPETMDIFAEDFSLEKFDIDFEFDIDFEFDAPRFYDFSKPELDSETEETELWFQSAGNYPPSPFSIHLRYEEKHLEIPKPVSDQYNAPKDVPKATHKSKTKTYLRKNSTLTRPTASLLARQNKPLDIYSVRLLTSVMTSSHLTYIQCLKPKITKGKNSKPASCARCCSQTSSKLTALNTFCFGANLKKLFEGSKVTVPREPNLKTAQRAARNRFKANSAPEQIAKFISNMNKTVQGTTSPSLPKKNTPHHPQDLQAFHLRTSLRARERSSSAKIAPTDDSKHSLTSKSVGSMKGMKVKASRSSNSNCQVYGPKICPLDSKVMQTSSKCGEAIDIKHENNLLREFEAPMNTNFRDEPFIESLRKLCLTSDTDPVGVLID

SEQ ID NO: 9827 - protein, 1192 aa, Arabidopsis thaliana
MAFLTALFLFLFFSFSSSAIVDLSSETTSLISFKRSLENPSLLSSWNVSSSASHCDWVGVTCLLGRVNSLSLPSLSLRGQIPKEISSLKNLRELCLAGNQFSGKIPPEIWNLKHLQTLDLSGNSLTGLLPRLLSELPQLLYLDLSDNHFSGSLPPSFFISLPALSSLDVSNNSLSGEIPPEIGKLSNLSNLYMGLNSFSGQIPSEIGNISLLKNFAAPSCFFNGPLPKEISKLKHLAKLDLSYNPLKCSIPKSFGELHNLSILNLVSAELIGLIPPELGNCKSLKSLMLSFNSLSGPLPLELSEIPLLTFSAERNQLSGSLPSWMGKWKVLDSLLLANNRFSGEIPHEIEDCPMLKHLSLASNLLSGSIPRELCGSGSLEAIDLSGNLLSGTIEEVFDGCSSLGELLLTNNQINGSIPEDLWKLPLMALDLDSNNFTGEIPKSLWKSTNLMEFTASYNRLEGYLPAEIGNAASLKRLVLSDNQLTGEIPREIGKLTSLSVLNLNANMFQGKIPVELGDCTSLTTLDLGSNNLQGQIPDKITALAQLQCLVLSYNNLSGSIPSKPSAYFHQIEMPDLSFLQHHGIFDLSYNRLSGPIPEELGECLVLVEISLSNNHLSGEIPASLSRLTNLTILDLSGNALTGSIPKEMGNSLKLQGLNLANNQLNGHIPESFGLLGSLVKLNLTKNKLDGPVPASLGNLKELTHMDLSFNNLSGELSSELSTMEKLVGLYIEQNKFTGEIPSELGNLTQLEYLDVSENLLSGEIPTKICGLPNLEFLNLAKNNLRGEVPSDGVCQDPSKALLSGNKELCGRVVGSDCKIEGTKLRSAWGIAGLMLGFTIIVFVFVFSLRRWAMTKRVKQRDDPERMEESRLKGFVDQNLYFLSGSRSREPLSINIAMFEQPLLKVRLGDIVEATDHFSKKNIIGDGGFGTVYKACLPGEKTVAVKKLSEAKTQGNREFMAEMETLGKVKHPNLVSLLGYCSFSEEKLLVYEYMVNGSLDHWLRNQTGMLEVLDWSKRLKIAVGAARGLAFLHHGFIPHIIHRDIKASNILLDGDFEPKVADFGLARLISACESHVSTVIAGTFGYIPPEYGQSARATTKGDVYSFGVILLELVTGKEPTGPDFKESEGGNLVGWAIQKINQGKAVDVIDPLLVSVALKNSQLRLLQIAMLCLAETPAKRPNMLDVLKALKEI

SEQ ID NO: 9828 - protein, 299 aa, Arabidopsis thaliana
MGAPKQKWTPEEEAALKAGVLKHGTGKWRTILSDTEFSLILKSRSNVDLKDKWRNISVTALWGSRKKAKLALKRTPPGTKQDDNNTALTIVALTNDDERAKPTSPGGSGGGSPRTCASKRSITSLDKIIFEAITNLRELRGSDRTSIFLYIEENFKTPPNMKRHVAVRLKHLSSNGTLVKIKHKYRFSSNFIPAGARQKAPQLFLEGNNKKDPTKPEENGANSLTKFRVDGELYMIKGMTAQEAAEAAARAVAEAEFAITEAEQAAKEAERAEAEAEAAQIFAKAAMKALKFRIRNHPW

SEQ ID NO: 9829 - protein, 584 aa, Arabidopsis thaliana
MPRLHHYLSNQAFLVLLLFSSIASAAVVEHVLHIQDVVVKPLCKEQIIPAANGSLPGPTINVREGDTLVVNVINNSTYNVTIHWHGVFQLKSVWMDGANMITQCPIQPGYNFTYQFDITGQEGTLLWHAHVVNLRATLHGALVIRPRSGRPYPFPKPYKEVPIVFQQWWDTDVRLLQLRPAPVSDAYLINGLAGDSYPCSENRMFNLKVVQGKTYLLRIVNAALNTHLFFKIANHNVTVVAVDAVYSTPYLTDVMILTPGQTVDALLTADQAIGKYYMATLPYISAIGIPTPDIKPTRGLIVYQGATSSSSPAEPLMPVPNDMSTAHRFTSNITSLVGGPHWTPVPRHVDEKMFITMGLGLDPCPAGTKCIGPLGQRYAGSLNNRTFMIPERISMQEAYFYNISGIYTDDFPNQPPLKFDYTKFEQRTNNDMKMMFPERKTSVKKIRFNSTVEIVLQNTAIISPESHPMHLHGFNFYVLGYGFGNYDPIRDARKLNLFNPQMHNTVGVPPGGWVVLRFIANNPGVWLFHCHMDAHLPYGIMSAFIVQNGPTPETSLPSPPSNLPQCTRDPTIYDSRTTNIDLSY

SEQ ID NO: 9830 - protein, 586 aa, Arabidopsis thaliana
MPRVHHSLSNQAFLVLLLFSSIASAAIVEHVLHVKDVVVTPLCKEQMIPIVNGSLPGPTINVREGDTLVVHVINKSTYNVTIHWHGVFQLKSVWMDGANMITQCPIQPSNNFTYQFDITGQEGTLLWHAHVVNLRATIHGALIIRPRSGRPYPFPKPYKEVPLIFQQWWDTDVRLLELRPAPVSDAYLINGLAGDSYPCSKNRMFNLKVVQGKTYLLRIINAALNTHLFFKIANHNVTVVAVDAVYTTPYLTDVMILTPGQTIDAILTADQPIGTYYMAIIPYFSAIGVPASPDTKPTRGLIVYEGATSSSSPTKPWMPPANDIPTAHRFSSNITSLVGGPHWTPVPRHVDEKMFITMGLGLDPCPSNAKCVGPLDQRLAGSLNNRTFMIPERISMQEAYFYNITGVYTDDFPDQPPLKFDFTKFEQHPTNSDMEMMFPERKTSVKTIRFNSTVEIVLQNTGILTPESHPMHLHGFNFYVLGYGFGNYDPIRDARKLNLFNPQMHNTVGVPPGGWVVLRFIANNPGIWLFHCHMDAHLPLGIMMAFIVQNGPTRETSLPSPPSNLPQCTRDPTIYDSRTTNVDMSY

SEQ ID NO: 9831 - protein, 570 aa, Arabidopsis thaliana
MEDDKDIYTKDGTLDIHKKPANKNKTGTWKACRFILGTECCERLAYYGMSTNLINYLEKQMNMENVSASKSVSNWSGTCYATPLIGAFIADAYLGRYWTIASFVVIYIAGMTLLTISASVPGLTPTCSGETCHATAGQTAITFIALYLIALGTGGIKPCVSSFGADQFDDTDEKEKESKSSFFNWFYFVINVGAMIASSVLVWIQMNVGWGWGLGVPTVAMAIAVVFFFAGSNFYRLQKPGGSPLTRMLQVIVASCRKSKVKIPEDESLLYENQDAESSIIGSRKLEHTKILTFFDKAAVETESDNKGAAKSSSWKLCTVTQVEELKALIRLLPIWATGIVFASVYSQMGTVFVLQGNTLDQHMGPNFKIPSASLSLFDTLSVLFWAPVYDKLIVPFARKYTGHERGFTQLQRIGIGLVISIFSMVSAGILEVARLNYVQTHNLYNEETIPMTIFWQVPQYFLVGCAEVFTFIGQLEFFYDQAPDAMRSLCSALSLTAIAFGNYLSTFLVTLVTKVTRSGGRPGWIAKNLNNGHLDYFFWLLAGLSFLNFLVYLWIAKWYTYKKTTGHAL

SEQ ID NO: 9832 - protein, 553 aa, Arabidopsis thaliana
MVFPIRILVLFALLAFPACVHGAIRKYTFNVVTKQVTRICSTKQIVTVNGKFPGPTIYANEDDTILVNVVNNVKYNVSIHWHGIRQLRTGWADGPAYITQCPIKPGHSYVYNFTVTGQRGTLWWHAHVLWLRATVHGAIVILPKLGLPYPFPKPHREEVIILGEWWKSDTETVVNEALKSGLAPNVSDAHVINGHPGFVPNCPSQAVESGKTYMLRLINAALNEELFFKIAGHRFTVVEVDAVYVKPFNTDTILIAPGQTTTALVSAARPSGQYLIAAAPFQDSAVVAVDNRTATATVHYSGTLSATPTKTTSPPPQNATSVANTFVNSLRSLNSKTYPANVPITVDHDLLFTVGLGINRCHSCKAGNFSRVVAAINNITFKMPKTALLQAHYFNLTGIYTTDFPAKPRRVFDFTGKPPSNLATMKATKLYKLPYNSTVQVVLQDTGNVAPENHPIHLHGFNFFVVGLGTGNYNSKKDSNKFNLVDPVERNTVGVPSGGWAAIRFRADNPGVWFMHCHLEVHTTWGLKMAFLVENGKGPNQSIRPPPSDLPKC

SEQ ID NO: 9833 - protein, 242 aa, Arabidopsis thaliana
MRKSFKDSLKALEADIQFANTLASEYPEEYDGGYVQMRLSYSPAAHLFLFLLQWTDCHFAGALGLLRILIYKAYVDGKTTMSLHERKTSIREFYDVLFPSLLQLHGGITDVEERKQKEICDKRYRKKDRTDKGKMSEIDLEREEECGICLEIRNKVVLPTCNHSMCINCYRNWRARSQSCPFCRGSLKRVNSGDLWIYTCSAEIADLPAIYKENLKRLLIYIDKLPLVTSDPNLVPYAPLPR

SEQ ID NO: 9834 - protein, 398 aa, Arabidopsis thaliana
MGLVDSLLGKDARKFLKRKDSDAAEAGRALEELRSSLYNELKTSEGAKRQQQRFCGPVVAMSFNFVVAVGIILANKLVMGRVGFNFPIFLTLIHYTVAWILLAFFKSLSLLPMSPPSKTTPFSSLFSLGAVMAFASGLANTSLKHNSVGFYQMAKIAVTPTIVLAEFVLFKKTISSTKVMALAVVSLGVAIATVTDLEFNLFGALVAVAWIIPSAINKILWSNLQQQANWTALALMWKTTPFTVFFLLALMPWLDPPGVLLFKWDLTNSSAILISALLGFLLQWSGALALGATSATSHVVLGQFKTCVILLGGYVIFGSDPGFISICGAIAALGGMSVYTWLNLPGKSIDHMSNKQLPKQNVTVSKPKAEADDGGGETGVTVVSVDPLLSKTITANIV

SEQ ID NO: 9835 - protein, 320 aa, Arabidopsis thaliana
MACENNLVVKQIMDLYNQISNLESLKPSKNVDTLFRQLVSTCLPTDTNIDVTEIHDEKVKDMRSHLIKLCGEAEGYLEQHFSAILGSFEDNPLNHLHIFPYYNNYLKLGKLEFDLLSQHTTHVPTKVAFIGSGPMPLTSIVLAKFHLPNTTFHNFDIDSHANTLASNLVSRDSDLSKRMIFHTTDVLNAKEGLDQYDVVFLAALVGMDKESKVKAIEHLEKHMAPGAVVMLRSAHGLRAFLYPIVDSCDLKGFEVLTIYHPSDDVVNSVVIARKLGGSNGARGSQIGRCVVMPCNCSKVHAILNNRGMEKNLIEEYSAIE

SEQ ID NO: 9836 - protein, 396 aa, Arabidopsis thaliana
MEETMAARYWCHMCSQMVNPVMESEIKCPFCQSGFIEEMSGNGGGGGGRGIRDVQDSETDFGTDRALSLWAPILLGMMSSPRRRRRFRRSEFGEENDDNGDDLTTNADGNGNDSNNSNNNVYRHHRARRHGGEIDLDREFESILRRRRRSSGNILQLLQGIRAGIASEYESSDNNWDNSRERDRVIMINPYNQSLVVPSDQNQNHPSLTSLGDYFIGPGLDLLLQHLAENDPNRQGTPPARKEAVEALPTVKIMEPLQCSVCLDDFEKGTEAKEMPCKHKFHVRCIVPWLELHSSCPVCRFELPSSADDDDETKTDSERVLRTRNVRETSNGNVVENVGNADRGREDEVRSGNGRRFSFPWPFSGLFSSSSSSSSSTSGSQSGENNFFSRSSGSSR

SEQ ID NO: 9837 - protein, 330 aa, Arabidopsis thaliana
MCISKEDEEDPSRNRRNQSPLSLPQTLKHFQKDLLAGAVMGGVVHTIVAPIERAKLLLQTQESNIAIVGDEGHAGKRRFKGMFDFIFRTVREEGVLSLWRGNGSSVLRYYPSVALNFSLKDLYRSILRNSSSQENHIFSGALANFMAGSAAGCTALIVVYPLDIAHTRLAADIGKPEARQFRGIHHFLSTIHKKDGVRGIYRGLPASLHGVIIHRGLYFGGFDTVKEIFSEDTKPELALWKRWGLAQAVTTSAGLASYPLDTVRRRIMMQSGMEHPMYRSTLDCWKKIYRSEGLASFYRGALSNMFRSTGSAAILVFYDEVKRFLNWGGI

SEQ ID NO: 9838 - protein, 363 aa, Arabidopsis thaliana
MLGILRQRAIDGASTLRRTRFALVSARSYAAGAKEMTVRDALNSAIDEEMSADPKVFVMGEEVGQYQGAYKITKGLLEKYGPERVYDTPITEAGFTGIGVGAAYAGLKPVVEFMTFNFSMQAIDHIINSAAKSNYMSAGQINVPIVFRGPNGAAAGVGAQHSQCYAAWYASVPGLKVLAPYSAEDARGLLKAAIRDPDPVVFLENELLYGESFPISEEALDSSFCLPIGKAKIEREGKDVTIVTFSKMVGFALKAAEKLAEEGISAEVINLRSIRPLDRATINASVRKTSRLVTVEEGFPQHGVCAEICASVVEESFSYLDAPVERIAGADVPMPYAANLERLALPQIEDIVRASKRACYRSK

SEQ ID NO: 9839 - protein, 208 aa, Arabidopsis thaliana
MGRGKIEIKRIENANNRVVTFSKRRNGLVKKAKEITVLCDAKVALIIFASNGKMIDYCCPSMDLGAMLDQYQKLSGKKLWDAKHENLSNEIDRIKKENDSLQLELRHLKGEDIQSLNLKNLMAVEHAIEHGLDKVRDHQMEILISKRRNEKMMAEEQRQLTFQLQQQEMAIASNARGMMMRDHDGQFGYRVQPIQPNLQEKIMSLVID

SEQ ID NO: 9840 - protein, 1043 aa, Arabidopsis thaliana
MAGNDWVNSYLEAILDVGQGLDDARSSPSLLLRERGRFTPSRYFVEEVITGYDETDLHRSWVKAVATRSPQERNTRLENMCWRIWNLARQKKQHEEKEAQRLAKRRLEREKGRREATADMSEEFSEGEKGDIISDISTHGESTKPRLPRINSAESMELWASQQKGNKLYLVLISLHGLIRGENMELGRDSDTGGQVKYVVELARALGSMPGVYRVDLLTRQVSSPDVDYSYGEPTEMLTPRDSEDFSDEMGESSGAYIVRIPFGPKDKYIPKELLWPHIPEFVDGAMSHIMQMSNVLGEQVGVGKPIWPSAIHGHYADAGDATALLSGALNVPMLLTGHSLGRDKLEQLLRQGRLSKEEINSTYKIMRRIEGEELSLDVSEMVITSTRQEIDEQWRLYDGFDPILERKLRARIKRNVSCYGRFMPRMVKIPPGMEFNHIVPHGGDMEDTDGNEEHPTSPDPPIWAEIMRFFSNSRKPMILALARPDPKKNITTLVKAFGECRPLRELANLALIMGNRDGIDEMSSTSSSVLLSVLKLIDKYDLYGQVAYPKHHKQSDVPDIYRLAAKSKGVFINPAIIEPFGLTLIEAAAHGLPMVATKNGGPVDIHRVLDNGLLVDPHDQQSISEALLKLVADKHLWAKCRQNGLKNIHQFSWPEHCKTYLSRITSFKPRHPQWQSDDGGDNSEPESPSDSLRDIQDISLNLKFSFDGSGNDNYMNQEGSSMDRKSKIEAAVQNWSKGKDSRKMGSLERSEVNSGKFPAVRRRKFIVVIALDFDGEEDTLEATKRILDAVEKERAEGSVGFILSTSLTISEVQSFLVSGGLNPNDFDAFICNSGSDLHYTSLNNEDGPFVVDFYYHSHIEYRWGGEGLRKTLIRWASSLNEKKADNDEQIVTLAEHLSTDYCYTFTVKKPAAVPPVRELRKLLRIQALRCHVVYSQNGTRINVIPVLASRIQALRYLFVRWGIDMAKMAVFVGESGDTDYEGLLGGLHKSVVLKGVSCSACLHANRSYPLTDVISFESNNVVHASPDSDVRDALKKLELLKD

SEQ ID NO: 9841 - protein, 135 aa, Arabidopsis thaliana
MTMFRSISMVMLLVALVTFISMVSSAASSPEADFVKKTISSHKIVIFSKSYCPYCKKAKSVFRELDQVPYVVELDEREDGWSIQTALGEIVGRRTVPQVFINGKHLGGSDDTVDAYESGELAKLLGVSGNKEAEL

SEQ ID NO: 9842 - protein, 468 aa, Arabidopsis thaliana
MGTGNSKENWRQSSFRSTSASSASPSSSSWASQQSYPQYGAESYNYPPPPSYAQPPEYTQPPPPLYSTQPYSAPSYSAPPSQSYGSDNKKRLERKYSKISDDYSSLEQVTEALARAGLESSNLIVGIDFTKSNEWTGARSFNRKSLHFIGSSPNPYEQAITIIGRTLAAFDEDNLIPCYGFGDASTHDQDVFSFNSEDRFCNGFEEVLSRYKEIVPQLKLAGPTSFAPIIDMAMTIVEQSGGQYHVLVIIADGQVTRSVDTENGQLSPQEQKTVDAIVQASKLPLSIVLVGVGDGPWDMMREFDDNIPARAFDNFQFVNFTEIMAKNKAQSLKETEFALSALMEIPQQYKATIELNLLGRRNGYIPERFPLPPPMRGGSSSYNSPKPSRLPSFKPSVPPHPTEGYHVRSSPVPPPTSSASDNQLCPICLSNPKDMAFGCGHQTCCECGPDLQMCPICRAPIQTRIKLY

SEQ ID NO: 9843 - protein, 590 aa, Arabidopsis thaliana
MPKHYRPTGKKKEGNAARYMTRSQALKHLQVNLNLFRRLCIVKGIFPREPKKKIKGNHHTYYHVKDIAFLMHEPLLEKFREIKTYQKKVKKAKAKKNEELARLLLTRQPTYKLDRLIRERYPTFIDALRDLDDCLTMVHLFAVLPASDRENLEVKRVHNCRRLTHEWQAYISRSHALRKVFVSVKGIYYQAEIEGQKITWLTPHAIQQVFTNDVDFGVLLTFLEFYETLLAFINFKLYHSLNVKYPPILDSRLEALAADLYALSRYIDASSRGMAVEPKVDASFSSQSNDREESELRLAQLQHQLPSSEPGALMHLVADNNKEVEEDEETRVCKSLFKDLKFFLSREVPRESLQLVITAFGGMVSWEGEGAPFKEDDESITHHIIDKPSAGHLYLSRVYVQPQWIYDCVNARIILPTEKYLVGRIPPPHLSPFVDNEAEGYVPDYAETIKRLQAAARNEVLPLPGVGKEDLEDPQNLLYAGVMSRAEEAEAAKNKKKMAAQEKQYHEELKMEINGSKDVVAPVLAEGEGEESVPDAMQIAQEDADMPKVLMSRKKRKLYDAMKISQSRKRSGVEIIEQRKKRLNDTQPSS

SEQ ID NO: 9844 - protein, 257 aa, Arabidopsis thaliana
MASLFKEQAKLSAYRDRRFSGTQEEFDEALRASTTVYIGNVSFYTTEEQLYELFSRAGEIKKIIMGLDKNTKTPCGFCFVLFYSREDTEDAVKYISGTILDDRPIRVDFDWGFQEGRQWGRGRSGGQVRDEYRTDYDPARGGYGKLVQKELEAQRQLVDYGTGSLGAYPQAAPTNYGNGRRGGGNYGQGGQNRHGRGDYHRKRQRDDDRYGRDNSRRNTDHESRRDTDSDMRPEKNPRFRESGDSDDDGEDDRKRRS

SEQ ID NO: 9845 - protein, 493 aa, Arabidopsis thaliana
MEPSQRNTKPPSFSDSTIPVDSDGRATVFRPFSLSSPHSRAFHLAWLSLFSCFFSTFSIPPLVPVISSDLNLSASTVSAAGIASFAGSIFSRLAMGPLCDLIGPRTSSAILSFLTAPVILSASLVSSPTSFILVRFFVGFSLANFVANQYWMSSMFSGNVIGLANGVSAGWANVGAGISQLLMPLIYSTIAEFLPRAVAWRVSFVFPAIFQVTTAVLVLLYGQDTPHGNRKNSNQNKLTIPEEEEVLVVEEDERSSFVEILIGGLGNYRAWILALLYGYSYGVELTTDNVIAGYFYERFGVNLEAAGTIAASFGISNIASRPAGGMISDALGKRFGMRGRLWGLWIVQSVAGLLCVLLGRVNSLWGSILVMWVFSVFVQAASGLVFGVVPFVSTRSLGVVAGITGSGGTVGAVVTQFLLFSGDDVRKQRSISLMGLMTFVFALSVTSIYFPQWGGMCCGPSSSSEEEDISRGLLVEDEDEEGKVVSGSLRPVC

SEQ ID NO: 9846 - protein, 728 aa, Arabidopsis thaliana
MDDDGELGMFFPSWTSKNPIDTVESRGLMFSCFVAALVGILTIAYTAFQWRRNINLSWTKAIARSKKNPKARHKVPVAPHSWELDPIARAKNLNCCVCLKSMSPSQAIVASESFFHRCTICGAAAHFNCSSSAPKDCKCVSMVGFEHVVHQWAVRWTEGADQTDDSSFCSYCDESCSSSFLGGSPIWCCLWCQRLVHVDCHSNMSNETGDICDLGPLRRLILCPLYVKELTRNPSGGFLSSITHGANELASTALASIRIQSKKYKQTNETSADTGNSGSNCDESTESTADTGPTVNGAHAVLENSISVMNGDSSNGDSDSNGKLEKKPSVKRTGSFGQKEYHALRSKLKYELADLPSDARPLLVFINKKSGAQRGDSLRQRLHLHLNPVQVFELSSVQGPEVGLFLFRKVPHFRVLVCGGDGTAGWVLDAIEKQNFISPPAVAILPAGTGNDLSRVLNWGGGLGSVERQGGLSTVLQNIEHAAVTVLDRWKVSILNQQGKQLQPPKYMNNYIGVGCDAKVALEIHNLREENPERFYSQFMNKVLYAREGARSIMDRTFEDFPWQVRVEVDGVDIEVPEDAEGILVANIGSYMGGVDLWQNEDETYENFDPQSMHDKIVEVVSISGTWHLGKLQVGLSRARRLAQGSAVKIQLCAPLPVQIDGEPWNQQPCTLTISHHGQAFMLKRAAEEPLGHAAAIITDVLENAETNQVINASQKRTLLQEMALRLT

SEQ ID NO: 9847 - protein, 331 aa, Arabidopsis thaliana
MAAMQLTRTVFFGISKAFPKSQAPRTLAVAIGRKSSRVFFASSVNHSKGRYDPVEKARDSRADLAYDSKKWREESGEYAEAGKGKAHKTKEEAKDKAYDMKERTKDYAEQTKNKVNEGASRAADKAYETKEKAKDKAYDVKEKTKDYAEEAKDKVNEGASRAADKAYETKEKAKDKAYDVKEKTKDFAEETKEKVNEGASRAADKAYDVKEKTKNYAEQTKDKVNEGASRAADKAEETKDKAKDYAEDSKEKAEDMAHGFKEKAQDIGEKTMDTVKDVWETAKSTAQKVTEAVVGSGEEADKARDDVDKGLEDLSKKAKENRNKDDDFKRF

SEQ ID NO: 9848 - protein, 155 aa, Arabidopsis thaliana
MDTLIAQLQRRFCDFTISLYHQGFLDDQFTELKKLQDECSPDFVAEVVTLFFEDCEKLISNMARALDQTGNVDFKLVGSSVHQLKGSSSSVGAKRVKGLCVTLKECCDSQNYEGCVRCLQQVDIEYKTLKAKLQDLFNLEQQIVQAGGRIPQVDI

SEQ ID NO: 9849 - protein, 1168 aa, Arabidopsis thaliana
MSTTEPSPENDRDPQPTTISTPTSTNAKLLKKIPAIPFRHSDKEGEDEQAKTDEVTTELAGEGPMSHDSPEILAPSSLGLNHIRTKSSPAPSPLRFSSATPLISPGQDDKDVAKEKPRVGVVDARADARARWPIPPHQPDQGKKVQWSQSKSQRVPANSNPGVESTHVGLAKETQSPRFQAILRVTSGRKKKAHDIKSFSHELNSKGVRPFPVWRSRAVGHMEEIMAAIRTKFDKQKEDVDADLGVFAGYLVTTLESTPESNKELRVGLEDLLVEARQCATMPASEFWLKCEGIVQKLDDKRQELPMGGLKQAHNRLLFILTRCNRLVQFRKESGYVEEHILGMHQLSDLGVYPEQMVEISRQQDLLREKEIQKINEKQNLAGKQDDQNSNSGADGVEVNTARSTDSTSSNFRMSSWKKLPSAAEKNRSLNNTPKAKGESKIQPKVYGDENAENLHSPSGQPASADRSALWGFWADHQCVTYDNSMICRICEVEIPVVHVEEHSRICTIADRCDLKGINVNLRLERVAESLEKILESWTPKSSVTPRAVADSARLSNSSRQEDLDEISQRCSDDMLDCVPRSQNTFSLDELNILNEMSMTNGTKDSSAGSLTPPSPATPRNSQVDLLLSGRKTISELENYQQINKLLDIARSVANVNVCGYSSLDFMIEQLDELKYVIQDRKADALVVETFGRRIEKLLQEKYIELCGLIDDEKVDSSNAMPDEESSADEDTVRSLRASPLNPRAKDRTSIEDFEIIKPISRGAFGRVFLAKKRATGDLFAIKVLKKADMIRKNAVESILAERNILISVRNPFVVRFFYSFTCRENLYLVMEYLNGGDLFSLLRNLGCLDEDMARIYIAEVVLALEYLHSVNIIHRDLKPDNLLINQDGHIKLTDFGLSKVGLINSTDDLSGESSLGNSGFFAEDGSKAQHSQGKDSRKKHAVVGTPDYLAPEILLGMGHGKTADWWSVGVILFEVLVGIPPFNAETPQQIFENIINRDIPWPNVPEEISYEAHDLINKLLTENPVQRLGATGAGEVKQHHFFKDINWDTLARQKAMFVPSAEPQDTSYFMSRYIWNPEDENVHGGSDFDDLTDTCSSSSFNTQEEDGDECGSLAEFGNGPNLAVKYSFSNFSFKNLSQLASINYDLVLKNAKESVEASNQSAPRPET

SEQ ID NO: 9850 - protein, 202 aa, Arabidopsis thaliana
MAKQYLFVLLSISYLLSLELTAATAASQTGASKKAINFIQSSCKTTTYPALCVHSLSVYANDIQTSPKRLAETAIAVTLSRAQSTKLFVSRLTRMKGLKKREVEAIKDCVEEMNDTVDRLTKSVQELKLCGSAKDQDQFAYHMSNAQTWTSAALTDENTCSDGFSGRVMDGRIKNSVRARIMNVGHETSNALSLINAFAKTY

SEQ ID NO: 9851 - protein, 153 aa, Arabidopsis thaliana
MDSGTKVKKGAAGRRSGGGPKKKPVSRSVKSGLQFPVGRIGRYLKKGRYSKRVGTGAPVYLAAVLEYLAAEVLELAGNAARDNKKNRIIPRHVLLAVRNDEELGTLLKGVTIAHGGVLPNINPILLPKKSEKAASTTKTPKSPSKATKSPKKS

SEQ ID NO: 9852 - protein, 309 aa, Arabidopsis thaliana
MDYVRTQVEAVFDDSEQDGSTISESGSCDSSSDRSFADELGLMELLEGDKAHDLIYRNCKSGLGDQCQILSVLRNGFRNVGSRAKLKTFQVFQEAVQMKHGGDGGAKVKYGWCSVSKHELKTIFEYGFSEPLRNDGSFGRGLYLSPDNSPLDCLKDSASESEDGMRFLLLCRVLLGKSEIVPQGSTRSCPSSPEFDSGVDDLVSTKKYIVWSTHMNTHVLPEFLVCIKAPFNLTRSPKRLRSPWMAFPVLIKALSKFLPPSQILVIQKHYKDQQNRRITRSELIQRVRSITGDKLLVHIIKACGHKVQH

SEQ ID NO: 9853 - protein, 312 aa, Arabidopsis thaliana
MPPAGELRHQSPSKEKLSSVTQSDEAEAASAAISAAAADAEAAGLWTQIKAEARRDAEAEPALASYLYSTILSHSSLERSISFHLGNKLCSSTLLSTLLYDLFLNTFSSDPSLRNATVADLRAARVRDPACISFSHCLLNYKGFLAIQAHRVSHKLWTQSRKPLALALHSRISDVFAVDIHPAAKIGKGILLDHATGVVVGETAVIGNNVSILHHVTLGGTGKACGDRHPKIGDGCLIGAGATILGNVKIGAGAKVGAGSVVLIDVPCRGTAVGNPARLVGGKEKPTIHDEECPGESMDHTSFISEWSDYII

SEQ ID NO: 9854 - protein, 477 aa, Arabidopsis thaliana
MMTLNSLSPAESKAISFLDTSRFNPIPKLSGGFSLRRRNQGRGFGKGVKCSVKVQQQQQPPPAWPGRAVPEAPRQSWDGPKPISIVGSTGSIGTQTLDIVAENPDKFRVVALAAGSNVTLLADQVRRFKPALVAVRNESLINELKEALADLDYKLEIIPGEQGVIEVARHPEAVTVVTGIVGCAGLKPTVAAIEAGKDIALANKETLIAGGPFVLPLANKHNVKILPADSEHSAIFQCIQGLPEGALRKIILTASGGAFRDWPVEKLKEVKVADALKHPNWNMGKKITVDSATLFNKGLEVIEAHYLFGAEYDDIEIVIHPQSIIHSMIETQDSSVLAQLGWPDMRLPILYTMSWPDRVPCSEVTWPRLDLCKLGSLTFKKPDNVKYPSMDLAYAAGRAGGTMTGVLSAANEKAVEMFIDEKISYLDIFKVVELTCDKHRNELVTSPSLEEIVHYDLWAREYAANVQLSSGARPVHA

SEQ ID NO: 9855 - protein, 390 aa, Arabidopsis thaliana
MLLTPKMFSSWLRQDVKKILKRKDSDAGERGKALEDLRASLFNRFRSPETPKRQQQQQHRICGPTVALTFNFVVAISIIFMNKWVLKNIGFEFPVFLTFIHYIVAYLLMALLKSFSLLPASPPSTKSSLLPLYTLGIVMSLSTGLANVSLKYNSVGFYQMAKIAVTPSIVFAEFLWYRKRVSFMKVVSLTVVSVGVAVATVTDLQFSLFGACVAFAWIIPSATNKILWSNMQQRENWTALALMWKTTPITLLFLVSMIPFLDPPGALSFNWSLTNTSAILVSALLGFFLQWSGALALGATSAITHVVLGQFKTCVLLLGNYYIFGSNSGFISVGGAFVAIMGTSLYTYLNTRGQSLKTSSSSSALSEKKSRFSDLKDDDKNLEPYGSEAV

SEQ ID NO: 9856 - protein, 808 aa, Arabidopsis thaliana
MANAERMITRVHSQRERLNETLVSERNEVLALLSRVEAKGKGILQQNQIIAEFEALPEQTRKKLEGGPFFDLLKSTQEAIVLPPWVALAVRPRPGVWEYLRVNLHALVVEELQPAEFLHFKEELVDGVKNGNFTLELDFEPFNASIPRPTLHKYIGNGVDFLNRHLSAKLFHDKESLLPLLKFLRLHSHQGKNLMLSEKIQNLNTLQHTLRKAEEYLAELKSETLYEEFEAKFEEIGLERGWGDNAERVLDMIRLLLDLLEAPDPCTLETFLGRVPMVFNVVILSPHGYFAQDNVLGYPDTGGQVVYILDQVRALEIEMLQRIKQQGLNIKPRILILTRLLPDAVGTTCGERLERVYDSEYCDILRVPFRTEKGIVRKWISRFEVWPYLETYTEDAAVELSKELNGKPDLIIGNYSDGNLVASLLAHKLGVTQCTIAHALEKTKYPDSDIYWKKLDDKYHFSCQFTADIFAMNHTDFIITSTFQEIAGSKETVGQYESHTAFTLPGLYRVVHGIDVFDPKFNIVSPGADMSIYFPYTEEKRRLTKFHSEIEELLYSDVENKEHLCVLKDKKKPILFTMARLDRVKNLSGLVEWYGKNTRLRELANLVVVGGDRRKESKDNEEKAEMKKMYDLIEEYKLNGQFRWISSQMDRVRNGELYRYICDTKGAFVQPALYEAFGLTVVEAMTCGLPTFATCKGGPAEIIVHGKSGFHIDPYHGDQAADTLADFFTKCKEDPSHWDEISKGGLQRIEEKYTWQIYSQRLLTLTGVYGFWKHVSNLDRLEARRYLEMFYALKYRPLAQAVPLAQDD

SEQ ID NO: 9857 - protein, 310 aa, Arabidopsis thaliana
MDASSSPSPSEESLKLELDDLQKQLNKKLRFEASVCSIHNLLRDHYSSSSPSLRKQFYIVVSRVATVLKTRYTATGFWVAGLSLFEEAERLVSDASEKKHLKSCVAQAKEQLSEVDNQPTESSQGYLFEGHLTVDREPPQPQWLVQQNLMSAFASIVGGESSNGPTENTIGETANLMQELINGLDMIIPDILDDGGPPRAPPASKEVVEKLPVIIFTEELLKKFGAEAECCICKENLVIGDKMQELPCKHTFHPPCLKPWLDEHNSCPICRHELPTDDQKYENWKEREKEAEEERKGAENAVRGGEYMYV

SEQ ID NO: 9858 - protein, 592 aa, Arabidopsis thaliana
MAATDFFFAFVFSFALIFGFSFAGDPYVSYDFTLSYITASPLGVPQQVIAVNGKFPGPVINATTNYNVHVNVLNHLDEPLLLTWPGVQMRRNSWQDGVLGTNCPIPPNWNFTYDFQLKDQIGSYFYSPSLNFQRASGGFGALIINNRDLVPIPFTEPDGEIIFIIGDWYTQNHTALRRILDSGKELGMPDGVLINGKGPFKYNSSVPDGIEHETVNVDPGKTYRIRVHNVGISTSLNFRIQNHKLLLIETEGRYTSQMNFTDFDVHVGQSYSFLVTMDQNATSDYYIVASARFVNETVWQRVTGVGILHYSNSKGPASGPLPVSATDVNHPWSAMNQPRAIKQNTSASGARPNPQGSFHYGQINITRTYILRSLPPTKINGKLRATLNGISFVNPSTPMRLADDHKVKGDYMLDFPDRPLDEKLPRLSSSIINATYKGFIQVIFQNNDTKIQSFHIDGYAFYVVAMDFGIWSEDRNSSYNNWDAVARSTVEVYPGAWTAVLISLDNVGVWNIRVENLDRWYLGQETYMRIINPEENGSTEMDPPENVMYCGALQAMQKEQHHSSATKSMTNGQLILIFSMMMVLLSSFSSFC

SEQ ID NO: 9859 - protein, 573 aa, Arabidopsis thaliana
MAVIVWWLLTVVVVAFHSASAAVVESTWEVEYKYWWPDCKEGIVMAINGQFPGPTIDAVAGDTVIIHVVNKLSTEGVVIHWHGIRQKGTPWADGAAGVTQCPINPGETFTYKFIVDKAGTHFYHGHYGMQRSSGLYGMLIVRSPKERLIYDGEFNLLLSDWWHQSIHAQELALSSRPMRWIGEPQSLLINGRGQFNCSQAAYFNKGGEKDVCTFKENDQCAPQTLRVEPNRVYRLRIASTTALASLNLAVQGHQLVVVEADGNYVAPFTVNDIDVYSGETYSVLLKTNALPSKKYWISVGVRGREPKTPQALTVINYVDATESRPSHPPPVTPIWNDTDRSKSFSKKIFAAKGYPKPPEKSHDQLILLNTQNLYEDYTKWSINNVSLSVPVTPYLGSIRYGLKSAYDLKSPAKKLIMDNYDIMKPPPNPNTTKGSGIYNFAFGIVVDVILQNANVLKGVISEIHPWHIHGHDFWVLGYGEGKFKPGIDEKTFNLKNPPLRNTVVLYPFGWTAIRFVTDNPGVWFFHCHIEPHLHMGMGVVFVEGVDRIGKMEIPDEALGCGLTRKWLMNRGRP

SEQ ID NO: 9860 - protein, 211 aa, Arabidopsis thaliana
MVRGKIEIKKIENVTSRQVTFSKRRSGLFKKAHELSVLCDAQVAAMIFSQKGRLYEFASSDIRNTIKRYAEYKREYFVAETHPIEQYVQGLKKEMVTMVKKIEVLEVHNRKMMGQSLDSCSVKELSEIATQIEKSLHMVRLRKAKLYEDELQKLKAKERELKDERVRLSLKKTIYTHLCQVGERPMGMPSGSKEKEDVETDLFIGFLKNRP

SEQ ID NO: 9861 - protein, 224 aa, Arabidopsis thaliana
MNPFYSTFPDSFLSISDHRSPVSDSSECSPKLASSCPKKRAGRKKFRETRHPIYRGVRQRNSGKWVCEVREPNKKSRIWLGTFPTVEMAARAHDVAALALRGRSACLNFADSAWRLRIPETTCPKEIQKAASEAAMAFQNETTTEGSKTAAEAEEAAGEGVREGERRAEEQNGGVFYMDDEALLGMPNFFENMAEGMLLPPPEVGWNHNDFDGVGDVSLWSFDE

SEQ ID NO: 9862 - protein, 326 aa, Arabidopsis thaliana
MGRSPCCDKLGLKKGPWTPEEDQKLLAYIEEHGHGSWRSLPEKAGLHRCGKSCRLRWTNYLRPDIKRGKFNLQEEQTIIQLHALLGNRWSAIATHLPKRTDNEIKNYWNTHLKKRLVKMGIDPVTHKPKNETPLSSLGLSKNAAILSHTAQWESARLEAEARLARESKLLHLQHYQTKTSSQPHHHHGFTHKSLLPNWTTKPHEDQQQLESPTSTVSFSEMKESIPAKIEFVGSSTGVTLMKEPEHDWINSTMHEFETTQMGEGIEEGFTGLLLGGDSIDRSFSGDKNETAGESSGGDCNYYEDNKNYLDSIFNFVDPSPSDSPMF

SEQ ID NO: 9863 - protein, 291 aa, Arabidopsis thaliana
MGAASSSIVRSEPFAGKLCGLEDVPENCITAMFMYMEPPEICLLARVNKSFHRASRSDAVWEDKLPSNYKFLVRRILEDQQQVGVKDKLIYRKKEIYARLCRPNLFDTGTKEAWLDKRSGKVFLAISPKAMKITGIDDRRYWEHISSDESRFGSITYLRQIWWLEAVGKIRFEFAPGKYSLLFKIQLGKPIRKCGRKTCSLDQVHGWDIKPVRFQLSTSDGQCAMSERHLDESGRWVYHHAGDFVVENQNSPVWVKFSMLQIDCTHTKGGLCLDCVIICPFEYRGKYKYSD

SEQ ID NO: 9864 - protein, 232 aa, Arabidopsis thaliana
MGCVSSCFGVDDFEDYPNPSSSVNRSCPCPRCLVNNFLNLYISLFRRGETRSLPSSLQATNVSIATSTSYDNFMSNTFHSTPRPLPYDADPRYFRSRRDSLVSRRDKGSSHSHEEAEPLRSDADVDSESFSVEGSKWANKLIISGEDSKEEFSRSSRRILQSRTMSTSNEGLYITSDDEDVCPTCLEEYISENPKIVTKCSHHFHLSCIYEWMERSENCPVCGKVMEFHETP

SEQ ID NO: 9865 - protein, 569 aa, Arabidopsis thaliana
MEFKLNIPNTIIKTLQTIVFFLFVLLAFQIAEAEIHHHTFKIKSKAYTRLCNTNKILTVNGEFPGPTLKAYRGDKLIVNVINNANYNITLHWHGARQIRNPWSDGPEYVTQCPIRPGESYVYRIDLKVEEGTIWWHAHSQWARATVHGAFIVYPKRGSSYPFPKPHREIPLILGEWWKKENIMHIPGKANKTGGEPAISDSYTINGQPGYLYPCSKPETFKITVVRGRRYLLRIINAVMDEELFFAIANHTLTVVAKDGFYLKHFKSDYLMITPGQSMDVLLHANQRPNHYFVAARAYSSAFGAGFDKTTTTAILQYKGDTLNRIKPILPYLPPYNRTEASTRFTNQFRSQRPVNVPVKINTRLLYAISVNLMNCSDDRPCTGPFGKRFSSSINNISFVNPSVDILRAYYRHIGGVFQEDFPRNPPTKFNYTGENLPFPTRFGTKVVVLDYNSSVELILQGTTVWASNIHPIHLHGYNFYVVGSGFGNFDRRKDPLRYNLVDPPEETTVGVPRNGWTAVRFVANNPGVWLLHCHIERHATWGMNTVFIVKDGPTKSSRMVKPPPDLPSC

SEQ ID NO: 9866 - protein, 531 aa, Arabidopsis thaliana; identical to SEQ ID NO: 646

SEQ ID NO: 9867 - protein, 386 aa, Arabidopsis thaliana
MDVTGTVTVRDAFDRVSKKQKLYHSVTQDVIDLVCDGIQDTLTRIQLGNDDGVEPESVLTELRRKLDALLPIIQLQKSHKETKWSLSKLVKLLEVSYHPDISLACFSVDFDINLVNKILIHHCYREGLFDVGDCLVKEAGREEETEVRSQFLEFHQIVDSLKLRNIEPAMRWIFANRGKLKQKSSKLEFKLLSLKYCDILREGKSDDALEYARTHFTQYPLHFKEIQKLITCLLWIGNFEKSPYAEIVSPSCWDKVTKELIMEYHHLLDQPINSPLKVALSAGYESLPSLLKLVHLMALTKQEWQAMKQLPVPLELGNEYKFHSAFVCPVSRDQSSEENPPMQLPCGHVISKQSMMRLSKNCAFRTFKCPYCPAETLASACRQLYF

SEQ ID NO: 9868 - protein, 301 aa, Arabidopsis thaliana
MVFVKSSKSNAYFKRYQVKFRRRRDGKTDYRARIRLINQDKNKYNTPKYRFVVRFTNKDIVAQIVSASIAGDIVKASAYAHELPQYGLTVGLTNYAAAYCTGLLLARRVLKMLEMDDEYEGNVEATGEDFSVEPTDSRRPFRALLDVGLIRTTTGNRVFGALKGALDGGLDIPHSDKRFAGFHKENKQLDAEIHRNYIYGGHVSNYMKLLGEDEPEKLQTHFSAYIKKGVEAESIEEMYKKVHAAIRAEPNHKKTEKSAPKEHKRYNLKKLTYEERKNKLIERVKALNGAGGDDDDEDDEE

SEQ ID NO: 9869 - protein, 111 aa, Arabidopsis thaliana
MAMQKAKEIVNSESVVVFSKTYCPYCVRVKELLQQLGAKFKAVELDTESDGSQIQSGLAEWTGQRTVPNVFIGGNHIGGCDATSNLHKDGKLVPLLTEAGAIAGKTATTSA

SEQ ID NO: 9870 - protein, 168 aa, Arabidopsis thaliana
MATATYPPPPPYYRLYKDYSENPNSAPEPPPPIEGTYVCFGGNYTTEDVLPSLEEQGVPQLYPKDSNLDYKNELRSLNRELQLHILELADVLVDRPSQYAKRIGEISSIFKNLHHLLNSLRPHQARATLIHIMELQIQQRKQAVEDIKRRREEAQRLLKDAYLTLDGQ

SEQ ID NO: 9871 - protein, 345 aa, Arabidopsis thaliana
MASSSNYDGILLGMGNPLLDISAVVDDEFLTKYDIKLNNAILAEDKHLPMYDEMSSKFNVEYIAGGATQNSIKVAQWMLQIPGATSYMGSIGKDKYGEAMKKDATAAGVNVHYYEDESAPTGTCGVCVVGGERSLIANLSAANCYKVDHLKKPENWALVEKAKFYYIAGFFLTVSPESIQLVSEHAAANNKVFTMNLSAPFICEFFKDVQEKFLPYMDFVFGNETEARTFSRVHGWETEDVEQIAIKISQLPKATGTYKRTTVITQGADPVVVAEDGKVKKYPVIPLPKEKLVDTNGAGDAFVGGFMSQLVKEKSIEECVKAGCYASNVVIQRSGCTYPEKPDFN

SEQ ID NO: 9872 - protein, 443 aa, Arabidopsis thaliana
MATATYPPPPPYYRLYKDFSENTDSAPEPPPPIEGTYVCFGGNYTTEDVLPSLEEQGVPQLYPKDSNLDYKKELRSLNRELQLHILELADVLVDRPSQYAKRIGEISSIFKNLHHLLNSLRPHQARATLIHIMELQIQQRKQAVEDIKRRREEAQGLLKDAFVTLDDVCNLMIQQVKPISSLFNVTREPAFSSAGYEIAAIERDWCKLSKAPGYDTRLREYTVKLVLEKHFASCGKITHIYVPRDFERGILKSVAFMCIKGEGGEEKALLLSGTDAGGWTAIVKPALWQKEIMDPWLPGMPKLETHRVRVTGYDTCVPKIDIQMALCEHFSSCGEVTQVVVLPSGSGSIYLQGERCEDKALQLNGCKMGGMNLAYELKKKKMEMEMEMEMGEKKKKKKIELMKVDKVLKKHMANKKKMDMSTKKEDGDGEFGHGSLLGEDEPL

SEQ ID NO: 9873 - protein, 226 aa, Arabidopsis thaliana
MENDQQGSYLRDEDKEEMEKRIRTVVIDSNLVLSNSTCGICRTAEDEYIKVYDDHNNDGEGDGDGDGDGDEDEDEDADADEDEDEDEDEDDDDDDDDDDDDDADDADDDEDDDDEDDDEDEDDDDDDDDENDEECDDEYDSHRLISTPYCTHKFCKTCWREYLETNFYSLEENLTVISCPDQDCGASVRLKTIEKLGVHDQDMYLSYVMRVYIENESKQLPAPDDN

SEQ ID NO: 9874 - protein, 232 aa, Petunia x hybrida
MVVKVHGSAMAACPQRVMVCLIELGVDFELIHVDLDSLEQKKPEFLVLQPFGQVPVIEDGDFRLFESRAIIRYYAAKYEVKGSKLTGTTLEEKALVDQWLEVESNNYNDLVYNMVLQLLVFPKMGQTSDLTLVTKCANKLENVFDIYEQRLSKSKYLAGEFFSLADLSHLPSLRFLMNEGGFSHLVTKRKCLHEWYLDISSRDSWKKVLDLMMKKISEIEAVSIPAKEEAKV

SEQ ID NO: 9875 - protein, 1275 aa, Schizosaccharomyces pombe
MRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLRLAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHVDSKAETDSLAASYKEESALPVASNVGLRQPNELRIDSINLPPAIVTPDTINYSVD

SEQ ID NO: 9876 - protein, 269 aa, Escherichia coli
MSQNTLKVHDLNEDAEFDENGVEVFDEKALVEYEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAK

SEQ ID NO: 9877 - protein, 245 aa, Mus musculus
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQPESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIIELLRDNLTLWTSDTQGDEAEAGEGGEN

SEQ ID NO: 9878 - protein, 246 aa, Mus musculus
MGDREQLLQRARLADEAERYDDMASAMKAVTELNEPLSNEDRNLLSVAYKNVVGARRSSWRVISSIEQKTMADGNEKKLEKVKAYREKIEKELETVCNDVLALLDKFLIKNCNDFQYESKVFYLKMKGDYYRYLAEVASGEKKNSVVEASEAAYKEAFEISKEHMQPTHPIRLGLALNFSVFYYEIQNAPEQACLLAKQAFDDAIAELDTLNEDSYKDSTLIMQLLRDNLTLWTSDQQDEEAGEGN

SEQ ID NO: 9879 - protein, 706 aa, Stigmatella aurantiaca
MPTQKPSKGSVKPKKKVDPVIRKKKAPDSVTAKGTKAAAAAEELASAEATEKALEKLKKRKAVTEASADDIDPEEAAEEAAAAVEVDPDAVEDEVEEEAIAERKEVKDLLAAGREKGFLTYDEVNDALPADIVSSDQIDDVMSMFGDNDIEIVDAQKAAQSNEIKPTVAVEEESKQDADADDDDEDDEPGGKSNDPVRLYLRKMGSVSLLTREGEVEIAKRIEDGEKEVLRAMLACRVAVADILDIGNKLKTGKLRVRDVIKDAPEEAQAEGAEEAPEEGVEGEQPQQLAQSELNKIEQINKQIERFRKFAKDCEVLEEELSGKKKLTDVKKKEVKQEVKDLRTKMMEVLEEMRLNKKQVDRIVLNLKQLIERVDKAEEELRDLERRNGVSMKELRPQLKESRDNPNTAKKLQKQLNFTPEQLEALDRDVRTAVRKIKRVEEEANLPVDALRRNYDAIRLGERRAERAKSELVEANLRLVVSIAKKYTNRGLQFLDLIQEGNIGLMKAVDKFEYKRGYKFSTYATWWIRQAITRAIADQARTIRIPVHMIETINKLIRTSRYLVQEIGREPTPEEIAEKMELPLDKVRKVLKIAKEPISLETPIGEEEDSHLGDFIEDKSLVSPADAVINMNLAARTRKVLATLTPREEKVLRMRFGIGEKSDHTLEEVGQDFEVTRERIRQIEAKALRKLRHPSRSKRLRSFVES

SEQ ID NO: 9880 - protein, 881 aa, Arabidopsis thaliana
MRGSALLDLILFLLVSPLAHSFKGSEISKFYDKSISNQISQSDRESGYVLVSTVDGSISLVDMSSQKLDWTFHTNEPIYSSYQAPHYHYTTDEERSSVLGDDFYMDCDKDWRLYNSSVRKGKRVNEIVDASEFIGTLPYTSTDRIVLGKKDTSVFLLDWKTGKLVKRYRMDELYSNTVVENDKEKAIVLSKEAPLLFGSGFKKSEDFPELVYIERKDFKIQCISKFGDVLWSVSYAKMEAKLQNHESVQFISGLSSSVGKNQFPLSYTTSVPMVQLRNVKYETLFPRLGFLDEALYLPFQDRKPNQLAIGDGNQLTLPGNKEAEEVLSLPLPETVISQITDIIDGSTKQAGFASKFSGLIVLIFGFCVTMLSVCGLFFYRLRQSIRIKEPYVSEVPIATPKKKKSKKNGTTKAVHKKENGFISGGNKDPSHEENEKRLLTAFPGLNNSSAEGYRVGKLFVSNKEIAKGSNGTVVLEGSYEGRLVAVKRLVQSHHDVAQKEILNLMASDKHSNIVRWYGVDQDEHFIYISLELCACSLNDLIYASSALLESPMASSSIHSIQINPIFENGKGVELWKENGHPSPVLLKLMRDIVAGLVHLHDIGIVHRDLKPQNVLIVKNSSLCAKLSDMGISKRLPADTSALTRNSIGLGSGSSGWQAPEQLRNERQTRAVDLFSLGCVLFFCMTGGKHPYGDNYERDVNVLNDQKDLFLIESLPEAVHLLTGLLNPDPNLRPRAQDVMHHPLFWNSDMRLSFLRDASDRVELENREEGSQLLAALESTAAVTLNGRWDEKLDSIFLDNIGRYRRYKFDSIRDLLRVIRNKLNHYRELPKELQELLGSVPEGFERYFSSRFPKLLIQVYTVLFDYCNNEEFFFKYSKTTVF

SEQ ID NO: 9881 - protein, 261 aa, Homo sapiens
MASQLQNRLRSALALVTGAGSGIGRAVSVRLAGEGATVAACDLDRAAAQETVRLLGGPGSKEGPPRGNHAAFQADVSEARAARCLLEQVQACFSRPPSVVVSCAGITQDEFLLHMSEDDWDKVIAVNLKGTFLVTQAAAQALVSNGCRGSIINISSIVGKVGNVGQTNYAASKAGVIGLTQTAARELGRHGIRCNSVLPGFIATPMTQKVPQKVVDKITEMIPMGHLGDPEDVADVVAFLASEDSGYITGTSVEVTGGLFM

SEQ ID NO: 9882 - protein, 118 aa, Brassica rapa subsp. pekinensis
  unsure (1)..(118): unsure at all Xaa locations
LGPFMXXGMEVEAHHFDPVASKLAWEQVFKLFYGMTTDQAVVEEEEAKLATVLDVYEARLKEFKYLAGETFTLTDLHHIPVIQYLLGTPTKKLFDERPHVSEWVAEITNRPASQKILQ

SEQ ID NO: 9883 - protein, 506 aa, Yersinia pseudotuberculosis
MRYAHPGTPEALVSFKATYGNYIGGEFVEPLGGQYFMNTSPVNGSDIAQFPRSDARDIDAALDAAHRAADAWGKTSVQHRSNLLLQMADRIEANLEYLAVAESWDNGKPIRETLNADLPLAVDHFRYFAGCLRAQEGGVAEIDEKTVAYHFHEPLGVVGQIIPWNFPLLMAAWKLAPALAAGNCVVLKPAEQTPLGITLLLELVGDLFPAGVLNVVQGYGREAGEALASSKRIAKIAFTGSTPVGRHIMACAAENIIPCTVELGGKSPNIYFADVMEAEPEFIEKAIEGLVLGFFNQGEVCTCPSRALIHESIYAPFMARVMAKVANIRRGDPLDTETMIGAQASRQQFDKILSYIDIARKEGGEILTGGARATMTPALDAGFYIQPTLIKGDNLMRCFQEEIFGPVIGVTTFKDEAEALAIANQTQFGLGAGIWTRDTHLAYRMGRGIKAGRVWTNCYHVYPAHAAFGGYKQSGVGRETHKMALNQYQQTKNLLVSYDTAPLGLF

SEQ ID NO: 9884 - protein, 575 aa, Oryza sativa (japonica cultivar-group)
MDFFSEYGDANRYKIQEVIGKGSYGVVCSAIDQHTGDKVAIKKIHNIFEHLSDAARILREIKLLRLLRHPDIVEIKHIMLPPSRRDFKDIYVVFELMDTDLHQVIKANDDLTKEHHQFFLYQMLRALKYIHTANVYHRDLKPKNILANANCKLKICDFGLARVAFNDTPTTVFWTDYVATRWYRAPELCGSFFTKYSPAIDIWSIGCIFAEILTGKPLFPGKNVVHQLDLMTDLLGTPSMDTVTRIRNEKARRYLSSMRKKQPVPFSERFPKADPAALKLLQRLLAFDPKDRPTAEEALADPYFKGLAKAEREPSCQPITKMEFEFERRKVTKEDVKELIFREILEYHPQLLKDYMNGTEKTNFLYPSALDNFRRQFANLEENGGKNGDAVPSDRKHVSLPRTTTVHSAPIPPKDHQNITSQVPQRIPGRTGRGACPVIPFENLSAMGPYNQRRVVRNPVLPPATTNLSAYAYHRKSDSSERELQQELEKDRMRYQPSEHFMDAKVVSHMSHDLRASSYYVSKAKSDVADRAALQSNMMQGIGPFNGIAAVGGLSELTAPLTTEMYLVNGYRLTA

SEQ ID NO: 9885 - protein, 614 aa, Oryza sativa (japonica cultivar-group); identical to SEQ ID NO: 3712

SEQ ID NO: 9886 - protein, 402 aa, Oryza sativa (japonica cultivar-group)
MWGDRTHHKHWNQAHVPSGTSKDKFQAKGQPKFIPDNYSSVDEVTAALRDAGLESSNLILGIDFTKSNEWSGRYSFGRKSLHAISATPNPYEQAISIIGRTLSPFDDDNLIPCFGFGDASTHDQSVFSFYQDSRSCCGFEEVLERYRQIVPHLNLSGPTSFAPLIYAAISVVENSNLQYHVLVIIADGQVTTSNTKDGKLSPQEQATIQAIVDASYYPLSIVMVGVGDGPWDAMQHFDDCIPDRAFDNFQFVNFTEIMSTSKDMPKKEAAFALAALMEIPSQYKATQGLRPLEKHAGHVASHLRILPPPNKVLENDNAAASRPPTASSQSTGFGKNTTDEQNCGITLIIFFYGIIKVCPICLTNPKDMAFQCGHLTCKECGPTLSTCPLCRVPITMRVRLYS

SEQ ID NO: 9887 - protein, 182 aa, Oryza sativa (japonica cultivar-group)
MTEYYSSTVDECYETTGRQHGHGHGHGHGHGHGHGGMRVESHTDDYYSEGGEIDRGRRNNSMHSQEYLMRQQSGHGGYGYGGGQQQEYYKREEREHKQRERVGEIGALASGAFALYEGHQAKKDPANAQRHRIEQGVAAVAAVGAGGYAYHEHREQKQASYGAKEQQYGYARMPQQQGYYCN

SEQ ID NO: 9888 - protein, 238 aa, Oryza sativa (japonica cultivar-group); identical to SEQ ID NO: 3337

SEQ ID NO: 9889 - protein, 500 aa, Oryza sativa (japonica cultivar-group)
MAPPPSLLATALLLLLLAIAGGPNAAAVAEAVRYQTLVATPLSPHPYTATAVEDDGLFQGSLAADEGGAAASTVGLRVVHRDDFAVNATAAELLAHRLRRDKRRASRISAAAGGAAAANGTRVGGGGGGSGFVAPVVSGLAQGSGEYFTKIGVGTPVTPALMVLDTGSDVVWLQCAPCRRCYDQSGQMFDPRASHSYGAVDCAAPLCRRLDSGGCDLRRKACLYQVAYGDGSVTAGDFATETLTFASGARVPRVALGCGHDNEGLFVAAAGLLGLGRGSLSFPSQISRRFGRSFSYCLVDRTSSSASATSRSSTVTFGSGAVGPSAAASFTPMVKNPRMETFYYVQLMGISVGGARVPGVAVSDLRLDPSTGRGGVIVDSGTSVTRLARPAYAALRDAFRAAAAGLRLSPGGFSLFDTCYDLSGLKVVKVPTVSMHFAGGAEAALPPENYLIPVDSRGTFCFAFAGTDGGVSIIGNIQQQGFRVVFDGDGQRLGFVPKGC

SEQ ID NO: 9890 - protein, 521 aa, Oryza sativa (japonica cultivar-group)
MSRSVQLAVAAGDQVDPDSLRLHQLGYKQELKRGLSALSNFAFSFANISVMMGVTTTYNTGLRYGGPVSMTLGWLVVAVFNCCVALSMAEICSAYPTSGGLYYWSAKLAGKQWASLASWVTGWFNVVGQWAAIASVDFSLAQLLQVIILLSTGGGNGGGYMASKYTVLAIYAFILILHGIINSLPIEWLSLFGHVGAIWNAAGIFVLTILIPAVAKDRPNIEFVFTHLNTENGMGIHDKAYILAVGLLMSQYSVIGYDTSAHMVEETKNADRSGPIGIITSVLFATVFGWIYLLALTSVVTDIPYLLSPSNDAGGYAIAQALYTAFHRRYGSGVGGIVCLGAVAVAVFLCGIACVTSNSRMAYAFSRDGAMPLSRVWYRVNKHEVPLNVVWLGVAVAFVMALTSLGSQVAFQAMGSIATLGMYIAYALPVFFRVTTARRSFVPGPFHLGRYGVVVGWAGVVWVATVTVLFSLPVAYPVANKETFNYTPVAVGGVLLLSVGAWVLRARFWFQGPITNVDTHC

SEQ ID NO: 9891 - protein, 532 aa, Oryza sativa (japonica cultivar-group); identical to SEQ ID NO: 3368

SEQ ID NO: 9892 - protein, 637 aa, Oryza sativa (japonica cultivar-group); identical to SEQ ID NO: 3498

SEQ ID NO: 9893 - protein, 515 aa, Oryza sativa (japonica cultivar-group); identical to SEQ ID NO: 3349

SEQ ID NO: 9894 - protein, 556 aa, Oryza sativa (japonica cultivar-group); identical to SEQ ID NO: 3336

SEQ ID NO: 9895 - protein, 773 aa, Oryza sativa (japonica cultivar-group)
MVSAADAVIPACAAVGIAFAVWQWLLVSRVKVSPYSAAAAAARNGGAGRAVFRPEGEVDDDDGGCGDDEEADGDGGVAAMARCAEIQSAIRVGANSFLFTQYKYLAAFTAVFAVVIFLFLGSVHRFSTESQPCQYTRGKACKPALANAVFSTIAFLLGAATSVASGFLGMRIATAANARTTVEARRGIGPAFAAAFRSGAVMGFLLASLGLLVLYVAIKVFGLYYGDDWEGLYESITGYGLGGSSMALFGRVGGGIYTKAADVGADLVGKVERNIPEDDPRNPAVIADNVGDNVGDIAGMGSDLFGSYAESTCAALFVGSISSFGADHNFAAVSYPLLISSAGLIVCLITTLFATDLYRVKTVDGVAPALKLQLLISTVLMTVGVLVVTFTALPHEFTMFDFGEVKRVKNWHLFFCVTIGLWAGLAIGFTTEYFTSNAYSPVRDVADSCRTGAATNVIFGLALGYKSVIVPVFAIAVSIYVSFTLASIYGIAVAALGMLSTVATGLAIDAYGPISDNAGGIAEMAGMSHRIRQRTDALDAAGNTTAAIGKGFAIGSAALVSLALFGAFVSRAGMAVINVLSPKVFVGLVVGAMLPYWFSAMTMKSVGSAALKMVEEVRRQFAAIPGLMEGRATPDYASCVRISTDASLREMMPPGALVLLAPLVAGTFFGVQTLAGLLAGALVSGVQVAISASNSGGAWDNAKKYIEAGASDHAKALGPKGSDAHKAAVIGDTIGDPLKDTSGPSLNILIKLMAVESLVFAPFFAAHGGLIFK

SEQ ID NO: 9896 - protein, 468 aa, Drosophila melanogaster
MRSGPREKLLYTVTVQPNLDEPHGDYLSTVDVDPESPTYCQIVHRTFTNRKGDELHHSGWNACSSCYYVDESSKTVPKRDRLVLPSLNSDFIYILDVVTDPRKPEIVKTIDGDVLKSHNVTAPHTTHCLANGNIMISVMGDAEGYAKGDFILFDSDFNCIGTWTKGDKKALCGYDFWYQPYFDVMVSSEWGAPNKWRRGWKNVDLEDMSQYGCRLNFYKWSTQTLYQTIDLGSDGITPLEIRFLHNPKKAEGFVGCALNAKVFHFKKKSDSDEFEAKKVIDIPGKLVDTGSGVAEDMGGMISDIIISLDDRFLYVNCWRHGDVRQYDITDPENPKLTGQLFLGGAICSDLPNVIVKEDKELKERPPARYVKGRRLEGGPQMLQLSLDGKRLYVSSSLYSPWDKQFYPKMVSQGGHIVLIDVDTVNGGISLNEDFLVDFANEPYGPSLPHEMRYPGGDCTSDIWLANDA

SEQ ID NO: 9897 - protein, 1311 aa, Drosophila melanogaster
MMSAGGTYISTASVEVPQALQDGEKFIRWDDDSGTGTPVTMRVDAKGFFLYWVDQNNELDILDIATIRDVRTGQYAKRPKDNKLRQIVTLGPQDTLEEKTVTVCHGSDFVNMTFVNFCCTRRDIAQLWTDGLIKLAYSLAQLNGSAIMFLQKAHTKLCLQVDKSGRIPVKNIIKLFAQNKEDRKRVEKALDVTGLPSGKVDSISVSKFQFEDFYNLYKYLTQRSEVERLFDSIVGNSKRKCMSIAQLVEFLNKTQRDPRLNEILYPYANPARAKELIQQYEPNKFNAQKGQLSLDGFLRYLMGDDNPIMAPSKLDLCDDMDQPMSHYFINSSHNTYLTGHQLTGKSSVEIYRQCLLAGCRCVELDFWNGRTEEPVIVHGYTFVPEIFAKDVLEAIAESAFKTSEYPVILSFENHCNPRQQAKIANYCREIFGDMLLDKPLDSHPLEPNMDLPPPAMLRRKIIIKNKKKHHHHHHHHHHKKPAQVGTPAANNKLTTANSVDAKAAQQVGLSASHEDGGVTRSTANGDVATGTGTGSAAGTAGHAPPLQQIRQSSKDSTGSSDSDSSSEDESLPNTTPNLPSGNEPPPEKAQKETEAGAEISALVNYVQPIHFSSFENAEKKNRCYEMSSFDEKQATTLLKERPIEFVNYNKHQLSRVYPAGTRFDSSNFMPQLFWNAGCQLVALNFQTLDLAMQLNLGIFEYNARSGYLLKPEFMRRSDRRLDPFAESTVDGIIAGTVSITVLSGQFLTDKRANTFVEVDMYGLPADTVRKKFRTKTVRDNGMNPLYDEEPFVFKKVVLPELASIRIAAYEEGGKLIGHRVLPVIGLCPGYRHVNLRSEVGQPIALASLFLCVVVKDYVPDDLSNFAEALANPIKYQSELEKRDIQLSVLTDEAEALGSADEDLSKSFVFVQVGGQKKELRPVESLATSPKHRPSISAAAAMSVDVTVDRTDGGRGEDSISIVAPSIQHQHSLDQSVSTSIRQVESSQFDVDLVLAEPLEKILDHKSVKEKRLEMEKKLESLRKKHDKEKIKIAGQKSSPLEGKKPKFAITNKLVKRLSNKSLEPGVEIPACPLDLGDSSEESAAADAGEDLAGGSSSLDGRTQESRLRSACREYTSQYRELQEKYHEAIYSAAEKVLKTSQTGQTKQLKASLDKVTGEVMHQLQEARRNEVKNLATVHRDRDELIRMKREVASSVVERGVAERVRLKQTFDRRTDELQKQHDSVRNALAEHRSKARQILDKEAESRSCVSSNGFLVLFHGPHHHGCTGSGSSALSGNNLTLNLDAGAAGSHSAISPAKSHNSIAAAAEMKT

SEQ ID NO: 9898 - protein, 760 aa, Drosophila melanogaster
MARCYLRMATWQNKLQDSIRPDAIQGALECFEKATSYDPNWYKAWHLWAYMNFKVVQAQKSALDKQQPPGASMGMTMGSGLDSDLMIIQRYAVPAVQGFFRSISLIKGNSLQDTLRLLTLWFDYGNHAEVYEALLSGMKLIEINTWLQVIPQLIARIDTHRQLVGQLIHQLLMDIGKNHPQALVYPLTVASKSASLARRNAAFKILDSMRKHSPTLVEQAVMCSEELIRVAILWHEQWHEGLEEASRLYFGDRNVKGMFEILEPLHAMLERGPQTLKETSFSQAYGRELTEAYEWSQRYKTSAVVMDLDRAWDIYYHVFQKISRQLPQLTSLELPYVSPKLMTCKDLELAVPGSYNPGQELIRISIIKTNLQVITSKQRPRKLCIRGSNGKDYMYLLKGHEDLRQDERVMQLFSLVNTLLLDDPDTFRRNLAIQRYAVIPLSTNSGLIGWVPHCDTLHTLIRDYRDKKKVPLNQEHRTMLNFAPDYDHLTLMQKVEVFEHALGQTQGDDLAKLLWLKSPSSELWFERRNNYTRSLAVMSMVGYILGLGDRHPSNLMLDRMSGKILHIDFGDCFEVAMTREKFPEKIPFRLTRMLIKAMEVTGIEGTYRRTCESVMLVLRRNKDSLMAVLEAFVYDPLLNWRLLDVDKKGNDAVAGAGAPGGRGGSGMQDSLSNSVEDSLPMAKSKPYDPTLQQGGLHNNVADETNSKASQVIKRVKCKLTGTDFQTEKSVNEQSQVELLIQQATNNENLCQCYIGWCPFW

SEQ ID NO: 9899 - protein, 860 aa, Drosophila melanogaster
MTLETQPVGGVSDGKIAGLYDLEETLGSGHFAVVKLARHVFTGAKVAVKVVDKTKLDDVSKAHLFQEVRCMKLVQHPNVVRLYEVIDTQTKLYLVLELGDGGDLYDYIMKHDSGLSEELARKYFRQILRAITYCHQLHVVHRDLKPENVVFFEKLGLVKLTDFGFSNKFLPGQKLETFCGSLAYSAPEILLGDSYDAPAVDIWSLGVILYMLVCGQAPFEKANDSETLTMIMDCKYTVPSHVSTDCRDLIASMLVRDPKKRATVEEIASSAWLKPIDEPDSTTSTSEHFLPLVSREQLGEEDHAFIIQKMINGNIASKEEILQALDKNKYNHITATYFLLAELRLRRRREELAQKQRLLNDASMKVGDASRKLVPEKPSPTEAQKGGVPISINVTPAAQFANDGGKPDKRSRKCSIVREEDEDESATECTAVGNELKVTSSSRREAFSDSPFSRSIHERSSSEPGNQRKGEQIANSGVPSHSRTKIVVSVDATLAHKLKQMEKSAKIDEDTLSGLKELEIGKLKPLPSSSKNPVLTHRRTKLNKIRTPSCSSSEASDDDTKTRNKKKINKFVGDTPVRFRMHRRDSHDDSSDSQDQLYPPPGSASNAGNFISKSGSVSGKKEGQSQYKEPNNKSDENRKSHSQKNRKQHNKDHVDKHSHAERQLADSSTATTGNSTNRRRRIRESQSLDRITEAQEYEMRHRCYAESEAASSSSSSTQHIDQRYSLLNLNTSTFSVAETKEEYDEEADATNATDQIMNTLNAAKATLQQEQYFNNNTNLSRNFNHNHNQSIIHISSQKANGKKSNETPKDIYNLNSIEHIDLILEDKSLTKAIHVTGSKCFVTMKKIRRLGKYFPVMNFS

SEQ ID NO: 9900 - protein, 469 aa, Drosophila melanogaster
MVAAKYERLNTSGEAAGNGNGNASDAEDEEIELHLAQKTQLGNGHRLRQSNFKYASGKCGSGETPCTNETATLAQENMMMQMAVGTLAIIFLYLALSISLTFYQTDINRQMPFPLAIVTYHLVVKFLLAAAARRIYRMRVGRSRVQLDWRLALRKMAPTGVASAIDIGFSNWGLALVPISLYTMTKSSTIVFILLFAIAFGLEKKSWYLVSIVGLIGTGLLMFTYKSTDFNALGFFFILFASLSSGLRWSFAQFIMQKSKLGLHNPIDMIYYMQPWMIASLVPLVIGIEGAGLIAVIEDLHNHTSNEITWAIARISAGALLAFLMEFSEFLVLCKTSSLTLSIAGIFKDICQLALAVTIRKDHLSVINYIGLIICLAGIVCHLLHKYSNMKEMQRQQELQLDNDQEESSPGEYKFNDGSAIVGVHVKSHSTLTVPLLEQTDSEDESGASNKQNASDVIFDVLKRRDMQR

SEQ ID NO: 9901 - protein, 485 aa, Arabidopsis thaliana
MALLVEKTSSGREYKVKDMSQADFGRLEIELAEVEMPGLVSCVTEFGPSQPLKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKNGTFPDPTSTDNPEFQIVLSIIKDGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMLGLETYPGVKRITIKPQTDRWVFPDTNSGIIVLAEGRLMNLGCATGHPSFVMSCSFTNQVIAQLELWNEKSSGKYEKKVYVLPKRLDEKVAALHLGKLGARLTKLTKDQSDYVSIPVEGPYKPVHYRY

SEQ ID NO: 9902 - protein, 296 aa, Ictalurus punctatus
MGFVKVVKNKAYFKRYQVKFRRRREGKTDYFARKRLVIQDKNKYNTPKYRMIVRFSNRDIVCQIAYAKIEGDMIVCAAYSHELPKYGVTVGLTNYAAAYCTGLLLARQLLNKFGLDKVYEGQVEITGDEFNVESIDDKPSAFTCYLDAGLARTTTGNKVFGALKGAVDGGLSIPHSTKRFPGYDSESKEFNAEVHRKHILGLNVAEYMRLLIEEDEEAYKKQFSRFIKNGVTPDSIEEMYKKAHAAIRENPVHEKKPKREVKKKRWNRAKLTLAQRKDPVAQKKASFLRAQAAEED

SEQ ID NO: 9903 - protein, 299 aa, Ictalurus punctatus
MGFVKVVKNKAYFKRYQVKFRRRREGKTDYFARKRLVIQDKNKYNTPKYRMIVRFSNRDIVCQIAYAKIEGDAIVCAAYSHELPRYGVSVGLTNYAAAYCTGLLLARRLLNKFNLDKVYEGQVEVTGEEFNVESVDGQPGAFTCYLDAGLTRTTTGNKVFGALKGAVDGGLSIPHSTKRFPGYDSESKEFSGEVHRKHILGLNVSEYMSSLIEEDEDAYKKQFSRFIKNGVTPDSVEEMYKKAHAAIRENPAHQKKPKKELKKKKRWNRAKLTLGQRKDRVAQKKASFLRAQEAAADDE

SEQ ID NO: 9904 - protein, 263 aa, Arabidopsis thaliana
MGSGKERDTFVYLAKLSEQAERYEEMVESMKSVAKLNVDLTVEERNLLSVGYKNVIGSRRASWRIFSSIEQKEAVKGNDVNVKRIKEYMEKVELELSNICIDIMSVLDEHLIPSASEGESTVFFNKMKGDYYRYLAEFKSGNERKEAADQSLKAYEIATTAAEAKLPPTHPIRLGLALNFSVFYYEIMNAPERACHLAKQAFDEAISELDTLSEESYKDSTLIMQLLRDNLTLWTSDISEEGGDDAHKTNGSAKPGAGGDDAE

SEQ ID NO: 9905 - protein, 715 aa, Mus musculus
ESLMNIHGFDLGSRYMDLKPLGCGGNGLVFSAVDNDCDKRVAIKKIVLTDPQSVKHALREIKIIRRLDHDNIVKVFEILGPSGSQLTDDVGSLTELNSVYIVQEYMETDLANVLEQGPLLEEHARLFMYQLLRGLKYIHSANVLHRDLKPANLFINTEDLVLKIGDFGLARIMDPHYSHKGHLSEGLVTKWYRSPRLLLSPNNYTKAIDMWAAGCIFAEMLTGKTLFAGAHELEQMQLILDSIPVVHEEDRQELLSVIPVYIRNDMTEPHRPLTQLLPGISREALDFLEQILTFSPMDRLTAEEALSHPYMSIYSFPTDEPISSHPFHIEDEVDDILLMDETHSHIYNWERYHDCQFSEHDWPIHNNFDIDEVQLDPRALSDVTDEEEVQVDPRKYLDGDREKYLEDPAFDTSYSAEPCWQYPDHHENKYCDLECSHTCNYKTRSSPYLDNLVWRESEVNHYYEPKLIIDLSNWKEQSKEKSDKRGKSKCERNGLVKAQIALEEASQQLAERERGQGFDFDSFIAGTIQLSAQHQSADVVDKLNDLNSSVSQLELKSLISKSVSREKQEKGRANLAQLGALYQSSWDSQFVSGGEECFLISQFCCEVRKDEHAEKENTYTSYLDKFFSRKEDSEMLETEPVEEGKRGERGREAGLLSGGGEFLLSKQLESIGTPQFHSPVGSPLKSIQATLTPSAMKSSPQIPHKTYSSILKHLN

SEQ ID NO: 9906 - protein, 278 aa, Streptomyces aureofaciens
MPQHTSGSDRAAVPPAARGSVRSTAPSSLEVLWRSYKDSGDERLREQLILHYSPLVKYVAGRVSVGLPPNVEQADFVSSGVFGLIDAIEKFDIERSIKFETYAITRIRGAMIDELRALDWIPRSVRQKARAVERAYATLEAQLRRTPTEGEVAGEMGIGVEELHTVFSQLSLANVVALEELLHVGGEGGDRLSLMDTLEDHAADDPVEVAEDRELRRLLARAINTLPEREKTVVTLYYYEGLTLAEIGNVLGVTESRVSQIHTKSVLQLRAKLADVGR

SEQ ID NO: 9907 - protein, 258 aa, Streptomyces coelicolor
MRPPAPSTLDELWRSYKTTGDERLREQLILHYSPLVKYVAGRVSVGLPPNVEQADFVSSGVFGLIDAIEKFDVDREIKFETYAITRIRGAMIDELRALDWIPRSVRQKARNVERAYATLEARLRRTPSESEVAVEMGIAVEDLHAVFSQLSLANVVALEELLHAGGEGGGRLSLMDTLEDTAADNPVEVAEDRELRRLLARAINTLPEREKTVVTLYYYEGLTLAEIGNVLGVTESRVSQIHTKSVLQLRAKLAGFGR

SEQ ID NO: 9908 - protein, 198 aa, Gossypium barbadense
GQNPLFPRILGHEAEGVVESVGEGVIDVQPGDHVLPIFTGECKECPHCLSEASNMCDLLRINTERGGMLHDGHTRFSKDGKPIYHFLGTSTFSEYTVVHVGQVAKINPEAPLDKVCVLSCGMSTGFGATVNVAKPKKGGSVAIFGLGAVGLAAAEGARVCEASRIIGIDLNPNRFEEAKKFGCTEFVNPKDHNKPVQE

SEQ ID NO: 9909 - protein, 198 aa, Gossypium barbadense
GQNPLFPRILGHEAGGVVESVGEGVIDVQPGDHVLPIFTGECKECPHCLSEASNMCDLLRINTERGGMLHDGHTRFSKDGKPIYHFLGTSTFSEYTVVHVGQVAKINPEAPLDKVCVLSCGMSTGFGATVNVAKPKKGGSVAIFGLGAVGLAAAEGARVCEASRIIGIDLNPNRFEEAKKFGCTEFVNPKDHNKPVQE

SEQ ID NO: 9910 - protein, 198 aa, Gossypium barbadense
GQNPLFPRILGHEAGGVVESVGEGVIDVQPGDHVLPIFTGECRECPHCLSEASNMCDLLRINTERGGMLHDGHTRFSKDGKPIYHFLGTSTFSEYTVVHVGQVAKINPEAPLDKVCVLSCGMSTGFGATVNVAKPKKGGSVAIFGLGAVGLAAAEGARVCEASRIIGIDLNPNRFEEAKKFGCTEFVNPKDHNKPVQE

SEQ ID NO: 9911 - protein, 198 aa, Gossypium hirsutum
GQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQE

SEQ ID NO: 9912 - protein, 198 aa, Gossypium hirsutum
GQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKAVQE

SEQ ID NO: 9913 - protein, 198 aa, Gossypium hirsutum
GQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAGEGARVCEASRIIGIDLNPNRFEEAKKFGCTEFVNPKDHNKPVQE

SEQ ID NO: 9914 - protein, 198 aa, Gossypium hirsutum
GQNPLFPRILGHEAEGVVESVGEGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGSVAIFGLGAVGLAAAEGARVCEASRIIGIDLNPNRSEEAKKFGCTEFVNPKDHNKPVQE

SEQ ID NO: 9915 - protein, 198 aa, Gossypium hirsutum
GQNPLFPRILGHEAGGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNLKDHNKPIQE

SEQ ID NO: 9916 - protein, 198 aa, Gossypium hirsutum
GQNPLFPRILGHEAEGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGSVAIFGLGAVGLAAAEGARVCEASRIIGIDLNPNRFEEAKKFGCTEFVNPKDHNKPVQE

SEQ ID NO: 9917 - protein, 198 aa, Gossypium hirsutum
GQNPLFPRILGHEAEGVVESVGEGVIDVQPGDHVVPIFTGECKECPHCLSEASNMCDLLRINTERGGMLHDGHTRFSKDGKPIYHFLGTSTFSEYTVVHVGQVAKINPEAPLDKVCVLSCGMSTGFGATVNVAKPKKGGSVAIFGLGAVGLAAAEGARVCEASRIIGIDLNPNRFEEAKKFGCTEFVNPKDHNKPVQE

SEQ ID NO: 9918 - protein, 198 aa, Gossypium hirsutum
GQNPLFPRILGHEAEGVVESVGKGVIDVQPGDHVLPIFTGECRECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGSVAIFGLGAVGLAAAEGARVCEASRIIGIDLNPNRFEEAKKFGCTEFVNPKDHNKPVQE

SEQ ID NO: 9919 - protein, 198 aa, Gossypium hirsutum
GQNPLFPRILGHEAEGVVESVGEGVIDVQPGDHVLPIFTGECRECPHCLSEASNMCDLLRINTERGGMLHDGHTRFSKDGKPIYHFLGTSTFSEYTVVHVGQVAKINPEAPLDKVCVLSCGMSTGFGATVNVAKPKKGGSVAIFGLGAVGLAAAEGARVCEASRIIGIDLNPNRFEEAKKFGCTEFVNPKDHNKPVQE

SEQ ID NO: 9920 - protein, 198 aa, Gossypium hirsutum
GQNPLFPRILGHEAGGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPVQE

SEQ ID NO: 9921 - protein, 198 aa, Gossypium hirsutum
GQNPLFPRILGHEAGGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNLKDHNKPVQE

SEQ ID NO: 9922 - protein, 198 aa, Gossypium hirsutum
GQNPLFPRILGHEAGGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPIQE

SEQ ID NO: 9923 - protein, 198 aa, Gossypium hirsutum
GQNPLFPRILGHEAEGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAIFGLGAVGLAAAEGARVCEASRIIGIDLNPNRSEEAKKFGCTEFVNPKDHNKPVQE

SEQ ID NO: 9924 - protein, 198 aa, Gossypium hirsutum
GQNPLFPRILGHEAGGVVESVGKGVIDVQPGDHVLPIFTGECKECPHCLSEASNMCDLLRINTERRGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPIQE

SEQ ID NO: 9925 - protein, 198 aa, Gossypium hirsutum
GQNPLFPRILGHEAEGVVESVGEGVIDVQPGDHVLPIFTGECKECPHCLSEASNMCDLLRINTERRGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPVQE

SEQ ID NO: 9926 - protein, 198 aa, Gossypium hirsutum
GQNPLFPRILGHEAEGVVESVGKGVIDVQPGDHVLPIFTGECRECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPIQE

SEQ ID NO: 9927 - protein, 198 aa, Gossypium hirsutum
GQNPLFPRILGHEAEGVVESVGEGVIDVQPGDHVLPIFTGECRECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPIQE

SEQ ID NO: 9928 - protein, 198 aa, Gossypium hirsutum
GQNPLFPRILGHEAGGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRFEEAKKFGCTEFVNPKDHNKPVQE

SEQ ID NO: 9929 - protein, 604 aa, Cucumis sativus
MEIESLRVSVDEKVLKDEEKNEKEEMKMKMKMKRKLGGVKTMPFILGNEVCDRFASSGFHSNIITYLTQDLNMPLVPASNILTNFAATSSFTSLIGALIADSFAGRFWTITIASIIYELGMVTITISAILPSLHPPPCPTQINCTQASGTQLMILYLALLLTSLGAGGIRPCVVAFAADQFDMTKVGIAGRTWNFFNWYYFCMGMATLTALTVVVYIQDNVGWGWGFGLPTIAMALSVVAFVVGSPLYNKLKPSGSPLVRLAQVVVAAFKNRKAVLPDDSKLLYRNHELDAAIAIQGRLVHTDQFKWLDKAAVITSPDSTANPPNLWRLATVHRVEELKSIIRMLPIWAAGILLVTASSHQHSFTIQQARTMNRHLTPTFQIPPATLSIFGILSMLTGLVLYDRLLVPFAKKLTHNPSGITCLQRMGVGFAINILATLVSSIVEIKRKKVAANHGLLDNPTATIPFSVFWLVPQFWLHGIAEVFMSVGHLEFMYDQSPESLRSTATALYWLAISVGNYIGTLMVYLVHKYTGEEHNWLPDRNLNRGRLEYYYWLVSGIQVMNLVYYVICAWFYTYKPLEEEKINIENKDGDQEWERCEDTIKIA

SEQ ID NO: 9930 - protein, 822 aa, Oryza sativa (japonica cultivar-group); identical to SEQ ID NO: 943

SEQ ID NO: 9931 - protein, 474 aa, Oryza sativa (japonica cultivar-group); identical to SEQ ID NO: 3108

SEQ ID NO: 9932 - protein, 387 aa, Oryza sativa (japonica cultivar-group); identical to SEQ ID NO: 3325

SEQ ID NO: 9933 - protein, 389 aa, Oryza sativa (japonica cultivar-group)
MQKQLRRLRTLGRGASGAVVWLASDDASGELLAVKSAAGEGGAEQLRREGRVMSGLCSPHIVPCLGSRAAAGGEYQLFLEFAPGGSLADEAARSGGRLAERAISAYAADVARALAYLHGNSLVHGDVKARNIMVGADGRAKLADFGCARRTDSERPIGGTPAFMAPEVARGEEQGPAADVWALGCTIIEMATGRVPWSDMDDVFSAVHRIGYTDAVPEIPEWLSPEAKNFLSRCFTRNPSDRPTAAQLLEHPFLASASSDIDETAPKHGWVSPKSTLNAECWESDEDDEVEEGMSQSATKRISALAITCSALPDWDSEDGWIDLQSDPSEVSETPAPMVVTTADFGLWWEEALDAEIDLHFVDVDGDGYVTRTGEVHLPEEVFGRRRLL

SEQ ID NO: 9934 - protein, 311 aa, Oryza sativa (japonica cultivar-group)
MAKHFVLNTGAKIPSVGLGTWQSDPGVVGDAVYAAVKAGYRHIDCARMYKNENEVGIALKKLFEEGVVKREDLFITSKLWCDCHAPEDVPESLDKTLSDLQLEYLDLYLIHWPFRVKKGSGISNTEDYIPPDIPSTWGAMEKLYDSGKSRAIGVSNFSSKKLGDLLAVACVPPAVDQVECHPGWQQTKLHNFCQSTGVHLSAYSPLGSPGSTWMNSNVLKESVIISIAEKLGKTPAQVALHWNIQMGHSVLPKSVTEERIKQNIDVYDWSIPEDLLVKFSEIKQVRLLRGDVIVNPHSVYKTHEELWDGEI

SEQ ID NO: 9935 - protein, 311 aa, Oryza sativa (japonica cultivar-group); identical to SEQ ID NO: 3915

SEQ ID NO: 9936 - protein, 305 aa, Oryza sativa (japonica cultivar-group); identical to SEQ ID NO: 3510

SEQ ID NO: 9937 - protein, 355 aa, Solanum tuberosum
MPSIISSQLDLYSIKELPESHAWKSSLDDDGSRNINAESIPVIDLNHDHKFVMDTIGHACKTWGAFQIVNHNISHRLLNHMETHGTRLFSLPMQQKLKAARSSDGIAGYGVARISSFFDKLMWSEGFTIFGSPLEHARQLWPYDYNKFCDVIEEYENEMEKLAGRLMGLMLGSLGIAKEDVKWAVGPRSGSSALQLNSYPACPDPDRAMGLAAHTDSTLLTILHQNNTSGLQVFKEGNGWVTVLPLRGALVLNVGDLVHILSNGLYPSVLHRAIVNRTRHRLSVAYLYGPPSGVKISPLSKLVDQRNPQMYRPVTWSEYLGTKAKHFDKALSSVRLCAPRIGFANSKDQSGVQVG

SEQ ID NO: 9938 - protein, 373 aa, Solanum tuberosum
MPSRISDSCRPHHSQKHFDLNSIKELPESHAWTSSNDHYTQENSCNFESIPVIDLDNNNNNNNNNILDHIGHACKKWGAFQIINHSISEKLLQDIEVAGKTLFSLPMQQKLKAARSPDGVTGYGAARISSFFSKLMWFEGFTIVGSPIEHARQLWLKDYNKFCEVIEEYEKEMEKLAGRLMWLILGSLGITKDDVKWAVGPKGETKEGCAALQLNSYPACPDPGRAMGLAAHTDSTILTILHQNNTSGLQVYQEGNGWITVPPIPGALVVNIGDLLHILSNGSYPSVLHRAVVNRTRYRLSVAYLYGPPSGVRVSPLSKLVDHRHPPLYRAVTWSEYLGTKAKYFDKALSSVRLCVPLNGFTDAKDHKGVQVG

SEQ ID NO: 9939 - protein, 480 aa, Medicago sativa
MRKSVTLKAGEVPSRLTRARAVALSTSGQLPPMKEVAPGTQNQKQPLRANSKRAVSDVTYLPHEMRAILQDVTNNCGENTNRSCLNPTEIQAKKRKVAKPAQPDVSNEVPSAAERPPFIADSKRVSSMEMRLRSSEDFRCLDDLEDNAPFRMSSNQSGTNNNLLQNQTSRISARLLSSQKKASQIVAAKKGNISELLDVSKHPDVADIDADFEDPQLCSHYAADIYDHLRVAELSRRPYPNFMETVQQDITPSMRAILVDWLVEVSEGYKLQANTLFLTVYLIDWFLSKNCIERERLQLLGITCMLIATKYEEINAPRIEDFCFITDNTYVVKLESLVLKSSSYQLFAPTTKTFLRRFLRAAQASYKRPSIELEYLANYLAELTLMNYGFLNFLPSMVAASSVFLARWTLDQSSHPWNPTLEQYASYKASDLKATVLALQDLQLNSNDDCPLTAIRKKYTQDKLNCVAALSSPKLLETLF

SEQ ID NO: 9940 - protein, 261 aa, Mus musculus
  unsure (1)..(261): unsure at all Xaa locations
MAATAREDGVRNLAQGPRGCEHYDRACLLKAPCCDKLYTCRLCHDTNEDHQLDRFKVKEVQCINCEKLQHXQQTCEDCSTLFGEYYCSICHLFDKDKRQYHCESCGICRIGPKEDFFHCLKCNLCLTTNLRGKHKCIENVSRQNCPICLEDIHTSRVVAHVLPCGHLLHRTCYEEMLKEGYRCPLCMHSALDMTRYWRQLDTEVAQTPMPSEYQNVTVDILCNDCNGRSTVQFHILGMKCKLCDSYNTAQAGGRRVPVDQQ

SEQ ID NO: 9941 - protein, 252 aa, Nicotiana tabacum
MAALLTDNLSREQYLYLAKLAEQAERYEEMVQYMDKLVLSSTPAAELTVEERNLLSVAYKNVIGSLRAAWRIVSSIEQKEESRKNEEHVSLVKEYRGKVENELTEVCAGILKLLESNLVPSASTGESRVFYLKMKGDYYRYLAEFKVGDERKQAAEDTMNSYKAAQEIALADLPPTHPIRLGLALNFSVFYFEILNSSDKACSMAKQAFEEAIAELDTLGEESYKDSTLIMQLLRDNLTLWTSDAQDQLDES

SEQ ID NO: 9942 - protein, 162 aa, Lactobacillus acidophilus
RIPVHMVETINKLIRIQRQLLQDLGREPTPEEIGAEMNMPTNKVRDILRIAQERVSLETPIGEEDDSHLGDFIEDKDATSPEQHASYEMLKEQLEQVLETLTDREENVLRLRFGLEYGRTRTLEEVGKVFGVTRERIRQIEAKALRKLRHPSRSNQLRDFMD

SEQ ID NO: 9943 - protein, 412 aa, Medicago sativa subsp. X varia
MTELDPSKKVADRYLKREVLGEGTYGVVYKAIDTQTGQTVAIKKIRIGKQKEGVNFTALREIKLLKELKDPNIIELIDCFPHKGNLHLVFEFMETDLEAVIRDRNIFLAPGDIKSYLQMTLKGLAHCHKKWILHRDMKPNNLLIGPNGQLKLADFGLARIFGSPDRRFTHQVFARWYRAPELLFGTKQYGPGVDVWAAACIFAELLLRRPFLQGSSDIDQLGKIFAAFGTPSPSQWPDMVYLPDYVEYQFVPAPPLRSLFPMATDDALDLLSKMFTYDPKDRISVQQALEHRYFTCPPQPTDPVKLPRPAPKKEIKPSDLNPPEGPTVLSPPRKTRRVMPGRDGLEGNSLQGDRVDDNHGNLKQTGGDNTGKNEPAPMSLDFSVFGLKPPNRPTINSADRSHLKRKLDLEFQ

SEQ ID NO: 9944 - protein, 1598 aa, Apis mellifera
MADCPYARCIQERRHIRRELLRWTKNMVFVVGLERVAEELMGRRRWKQYQDTLYSGTRSSESLTAQAHHRLYPAFSSSCDPVPGNLEQIGSRPLHPPASSTSLPATITTTTTTTTTTTATAAATATTTATGLIKQETLQRHHHLQNHHHHLQSTAVQDHHRPYQQQQQQQQRQQQRQEERRLRPDEIKVEVGEDEFANGGAARDESKAGSTDASTPATVTTTGATTTLPAASATGTGPATPSAVVATSNATAAMTTGTTTIPTRRLRKRRQNDGEGADDRDDDEENEEEEDGRGQSEAEKRLKLDEDADGAVSPLRREKDRGSREYPTSNATDTDGTKERTEEVALDRTPVTQGLLRVKKEEELQEAPSCGGGPTILTTPGLDSDGIRLPCREVEAAATARNVVAPFLIGSRRTSPPPEDWKPLDKCYFCLDGKLPHDDQPPLSPQSDSSSSSRSAESPMSVQVDPMAASVVAAALTGTYPTLLPQWCLPPREAPLVGVQPHQDSATPADQPLDLSAKPKNSQDNNISLLEQQKIPLRMTAGIDPKSIFNSGYRPKPRMSGPVAAVAAAAVAAAGVGGVPVVGAGGGRRAYTEEELQAALRDIQSGKLGTRRAAVIYGIPRSTLRNKVYKLAMERERDASLSSTHSHPHEPGAPATTITTITTTTTTTTTTTTTTTTPNTTQNASATTPPPQVDEVDDKELSGAEEEKEVEKALLKPLLSLEDLVRFSTLEGSGGDSLRTLLQRGQETGAEWPGLEHANIGPYIQKMIAAAAPFKGMETQDYRIPEVMRRLMSEDKRLSKSVNGDQSQPPHQQLHHHQSTHPQAQAQAQPQQQQQQQQQQPQQQQQQQQQQQQQQRGPMTNDDFNPNIEEEASDSAQGRAILKIPSYKPASTPGCSSKNGEPTSAAFAQGFATAASSPGLLERASPAFSGTSSPTNSLVGKTVAVNFRDVIAKSISVKFQEGQTVSGGGMGGCQPGGVVQSQQPIMTDPSPFKRGRYTPPQPANAQQGQAQAQAKPQSQEANKPKPATGGKGTRPKRGKYRNYDRDSLVEAVRAVQRGEMSVHRAGSYYGVPHSTLEYKVKERHLMRPRKRDQKQSDDKTKETSTVTAAAAATNIRPGTADNKPQLKPQKPFTSPGGIPGPNGIKMPSFMEGMPHLPFTPFNFWNPPPFMPSPFMAGAPNVPTILPEQYFATSRIRGLQEQQRNAAMVQQQQQQQQQQQQQQQQQQQQQQQQQHQAREREGVGAGIAETSAGTSNSRGAAQMSKVPRDVSEGIYDGSGANGSFLDNLIRSSLETGIPRDQRAMTEARNQQQQASSQQQIPESMRSKALIDQLCRNSRRTPVPRLAQDSSEDESYRGPSASGGRPVPERPERVPTVDLSPSPSDRGRNDDGSDRLTSPPTPLSISRAGSRDEDSTRDSTKLDRSSREREVHNGGQQEDRDRKTLTSAPQQPQQQQQQQQQQQQQQQQLNHYPDLHNLYAVPTDKKSACDSKLIVDHSSQKTQQQQPQQQQQQQQQQQPQQQSQQPQQQQPQPQQQQQQQQQQQPQQQQKEYGAVSGLVVQLQRGYNSGNNRSGEQANSQQQQQQQSGEPVIGMEDSVEQ

SEQ ID NO: 9945 - protein, 244 aa, Cavia porcellus
MDLGLAGRRALVTGAGKGIGRSTVLALKAAGAQVVAVSRTREDLDDLVRECPGVEPVCVDLADWEATEQALSNVGPADLLVNNAAVALLQPFLEVTKEACVTSFNVNLRAVIQVSQIVAKGMIARGVPGAIVNVSSQASQRALTNHTVYCSTKGALYMLTKMMALELGPHKIRVNAVNPTVVMTPMGRTNWSDPHKAKAMLDRIPLGKFAEVENVVDTILFLLSNRSGMTTGSTLPVDGGFLAT

SEQ ID NO: 9946 - protein, 377 aa, Danio rerio
MATAGKVIKCRAAVAWEPKAPLMMEEIEVAPPQEGEIRIKVIATGLCHTDLYHLVDGDKRGFPVVLGHESAGVVESVGPGVTDYKPGDKVIPLFLSQCGKCKFCKCPKTNLCESSWATKYHDIMAEPTSRFTCRGQTILQFMGTSTFSEYTVINQNAVAKIDENAPLDRVFLLGCGITTGYGAAVNTAGVTPGSVCAVFGLGAVGLAAVMGCKNAGASRIFAVDINEKKFEKAKVFGATDFLNPKAFNKPISEVLIEMTNGGGVDFSIECTGNTEVMRSALESCAKGWGVSVVVGWTNVQDFSAKPIQLIYGKTWKGSLFGGFKCKDSVPKLVRDYMSGKIMLDEFITHKMNLEQVNDAINLMKTGQGIRTIMTVSK

SEQ ID NO: 9947 - protein, 393 aa, Methanosarcina mazei
MKLFISYGMQLDLFNGSNVHTIELLNNLKKLGVDVLLFSRSSKNRSYKNPNIIEVPSTHFQFLFSNYLNIFTYQLSLFLYLIYYTIKLKPDLFYARLSGSGASSTIVSSILGIPQVGEVNGITIDEMIIQGSSKSKIKIAQLIESINLKGCSKLIAVTDGVKKGLMEIYFIPESKIVVINNGANTELFIPMDKNKVKNELNLDSTLHYICFVGNLIPWQGVEYLIRAAPLILKEFADARFLIVGDGIMKKEWMKLADDLGLLDNFIFTGRIPYEKVPVYINASDICVAPFIKERNSKIGLSALKTYEYLACGKPLVASAIPGVKDLIELSGGGIAVTPENSEELAAAVIKLLRDENSRKLMGEKGRKYIVKNHSWNSVAKKVLSVCNEASKSH

SEQ ID NO: 9948 - protein, 102 aa, Paramecium caudatum
MAGKSGKGIGKVSAKRHARKPNKASIEGITKPAIRRLARRGGVKRISSFLYDDSRNVLKSFLENVIRDAITYTEHARRKTVTVMDVVYSLKRQGRTLYGFGA

SEQ ID NO: 9949 - protein, 305 aa, Arabidopsis thaliana
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAVVLPLPIETSSSSDDPPTSLSLSLPGADVSEESNRSHESTNINNTTSSRHNHNNTVSFMPFSGGFRGAIEEMGKSFPGNGGEFMAVLQEMIKAEVRSYMTEMQRNNGGGFVGGFIDNGMIPMSQIGVGRIE

SEQ ID NO: 9950 - protein, 294 aa, Arabidopsis thaliana
MKRLSSSDSMCGLISTSTDEQSPRGYGSNYQSMLEGYDEDATLIEEYSGNHHHMGLSEKKRRLKVDQVKALEKNFELENKLEPERKTKLAQELGLQPRQVAVWFQNRRARWKTKQLEKDYGVLKGQYDSLRHNFDSLRSDNDSLLQEISKIKAKVNGEEDNNNNKAITEGVKEEEVHKTDSIPSSPLQFLEHSSGFNYRRSFTDLRDLLPNSTVVEAGSSDSCDSSAVLNDETSSDNGRLTPPVTVTGGSFLQFVKTEQTEDHEDFLSGEEACGFFSDEQPPSLHWYSASDHWT

SEQ ID NO: 9951 - protein, 779 aa, Arabidopsis thaliana
MPLKEDDCCLFAEEYDGPPLSYNIPCAVPINVEKIPVAAVVSPVCISDNMSFPVIQPILSVESKKFLIDSVSPTSVIANCGSNQLELVSDSITVSPTSVIEHTEEEEEEEGGDGEDCELSSSGELLLRSCSVKESLDLNESSSNPLVPDWESNESVLSMDYPSSRVTGDCVSETNGDGKKQPVVTFLGIASDDGFEEEESCSNLRRVRVVPVKKQPQTKGKKGSCYRCFKGSRFTEKEVCLVCDAKYCNSCVLRAMGSMPEGRKCVTCIGFPIDESKRGSLGKCSRMLKRLLNDLEVKQIMKTERFCEANQLPAEYVYVNGQPLYPEELVTLQTCSNPPKKLKPGDYWYDKVSGLWGKEGEKPYQIISPHLNVGGPISPEASNGNTQVFINGREITKVELRMLQLAGVQCAGNPHFWVNEDGSYQEEGQKNTKGYIWGKAGTKLLCAVLSLPVPSKSTANASGEQLYSANSRSILDHLEHRTLQKILLVGNSGSGTSTIFKQAKILYKDVPFLEDERENIKVIIQTNVYGYLGMLLEGRERFEEEALALRNTKQCVLENIPADEGDAKSNDKTVTMYSIGPRLKAFSDWLLKTMAAGNLGVIFPAASREYAPLVEELWRDAAIQATYKRRSELGLLPSVASYFLERAIDVLTPDYEPSDLDILYAEGVTSSSGLACLDFSFPQTASEENLDPSDHHDSLLRYQLIRVPSRGLGENCKWIDMFEDVGMVVFVVSMSDYDQVSEDGTNKMLLTKKLFESIITHPIFENMDFLLILNKYDLL

SEQ ID NO: 9952 - protein, 393 aa, Arabidopsis thaliana
METSIACYSRGILPPSVSSQRSSTLVSPPSYSTSSSFKRLKSSSIFGDSLRLAPKSQLKATKAKSNGASTVTKCEIGQSLEEFLAQATPDKGLRTLLMCMGEALRTIAFKVRTASCGGTACVNSFGDEQLAVDMLADKLLFEALRYSHVCKYACSEEVPELQDMGGPVEGGFSVAFDPLDGSSIVDTNFTVGTIFGVWPGDKLTGITGGDQVAAAMGIYGPRTTYVLAVKGFPGTHEFLLLDEGKWQHVKETTEIAEGKMFSPGNLRATFDNSEYSKLIDYYVKEKYTLRYTGGMVPDVNQIIVKEKGIFTNVTSPTAKAKLRLLFEVAPLGLLIENAGGFSSDGHKSVLDKTIINLDDRTQVAYGSKNEIIRFEETLYGTSRLKNVPIGVTA

SEQ ID NO: 9953 - protein, 420 aa, Gnetum parvifolium
  unsure (1)..(420): unsure at all Xaa locations
MDPDSFSAAFFKWEQRSPIPLQMQRAGNVFHDFSVPSPTVGVPPIMANTSNVCISNRKEMICLEGLFRHYGVRYITMTKMMEMGFTVNTLVNMTEQELDEAIRALVEIYRMELLVGEKYGIKSAIRAERRRLDEAEKKRLQDLFSDVDGKRKIDENVLDTLSQEGLSVEEPHGDNTMLLSQNNTASSFPLNLNAGTDPVLILQNGARMGSTVGAFMGLPADNNMGDSHGHGRGNNGNGKASKKQKRRRPRESGEEGEDRQREHPFIVTEPGELARGKKNGLDYLFDLYEQCGKFLSEVQQIAKXRGEKCPTKVTNQVFRHAKYSGASYINKPKMRHYVHCYALHCLDVEQSNRLRKAYKERGENVGAWRQACYYPLVAKARESGWDIDGVFNKHEKLRIWYVPTKLRQLCHLEKSKQCHL

SEQ ID NO: 9954 - protein, 486 aa, Oryza sativa (japonica cultivar-group); identical to SEQ ID NO: 3324

SEQ ID NO: 9955 - protein, 182 aa, Oryza sativa (japonica cultivar-group); identical to SEQ ID NO: 732

SEQ ID NO: 9956 - protein, 515 aa, Oryza sativa (japonica cultivar-group); identical to SEQ ID NO: 4049

SEQ ID NO: 9957 - protein, 321 aa, Rhodnius prolixus
MKVLILPVFTIIILACVGLAAKERDFTIHVATWNVNGRKPTTITNLIGQNSDKYENLPDMVIVGLQEVTMSAVKAVSNALTGELWSETMEKTLKSNYQKVKSVALLGIVLNVFLKLNTAWALKNAAVDEVTTGMVGLYGNKGGVIMKSQLHDLMFCIVNAHFHAHDKGQESRIKDYKEINEGREKLCTPKSDFIFWLGDLNFRIVEKDKYTPESIEKFIKKKDYDELLANEQLKEAKDAGKIFKDYQEGKIKFAPTFKLNVDEGTYNLKRRPSWTDRVLYKSETNKNIDVLAYHSLENHTRSDHFPVMAQYKIKVPDNDKK

SEQ ID NO: 9958 - protein, 184 aa, Crithidia fasciculata
AGGIAEMSHMGHEIREITDALDAAGNTTAAIGKGFAIASAAFVALALYGAYISRVAIPVVNILDARVMPGLLFGAMLPYWFSAMTMKSVGIAAMDMVNEIRRQFQDPEVAEGRKEPDYESCVAIATQAALHQMIPPAALVMLTPIVVGILFGKYTLAGLLPGAIVSGVQMAISASNTGGAWDNA

SEQ ID NO: 9959 - protein, 184 aa, Endotrypanum schaudinni
AGGIAEMSLIGHEIREITDALDAAGNTTAAIGKGFAISSAAFVALALYGAYVSRVAIPMVNILDSHTMPGLLFGAMLPYWFSAMTMKSVGVAAMDMVNEIRRQFQDPEVAEGRKEPDYESCVAIATQAALRQMIPPAALVMLTPIVVGILFGKYTLAGLLPGAIVSGVQMAISASNTGGAWDNA

SEQ ID NO: 9960 - protein, 470 aa, Arabidopsis thaliana
RMLQVGGPGYATPLAAMSGPSEKLIYVTAVYTGTGIDKPDYLATVDVDPSSPSYSSVIHRLPMPFVGDELHHSGWNSCSSCHGDASVDRRYLVLPSLISGRIYAIDTKENPRAPSLYKYVDPKEIADKTGLAFPHTAHCRTGEILVSCLGDEEGNAKGNGLLLLDSDFNIKNRWEKPDISPLYGYHFWYQPRHKTMISTSWGAPKAFSKGFNLQHVADGLYGSHLHVYSWPGGEIKQLIDLGPTGLLPLEIRFLHDPSKDTGFVGSALSSNMIRFFKNSDETWSHEVVISVKPLKVENWILPEMPGLITDFLISLDDRFIYFVNWLHGDIRQYNIEDPKNPVLTGQIWVGGLLQKGSPVKAVGEDGNTFQFEVPQIKGKSLRGGPQMIQLSLDGKRLYATNSLFSAWVVSFYPEIMEKGSHIIQIDGDTEKGGLTINPDFFVDFGDEPDGPSLAHEMRYPGGDCTSDIWI

SEQ ID NO: 9961 - protein, 184 aa, Herpetomonas muscarum
AGGIAEMSHMGHEIREITDALDAAGNTTAAIGKGFAIASAAFVALALYGAYISRVAIPVVNILDARVMPGLLFGAMLPYWFSAMTMKSVGIAAMDMVNEIRRQFQDPEVAEGRKEPDYESCVAIATQAALHQMIPPAALVMLTPIVVGILFGKYTLAGLLPGPIVSGVQMAISASNTGGAWDNA

SEQ ID NO: 9962 - protein, 184 aa, Phytomonas sp.
AGGIAEMSHMGHEIREITDALDAAGNTTAAIGKGFAISSAAFVALALYGAYVSRVAIPTVNILDSRVMPGLLFGATLPYWFSAMTVKSVGIAAMDMVNEIRRQFQDSDVAEGRKEPDYESCVIIATRAALQQMIAPASLVMLSPLIVGILFGKYTVAGMLPGSIVSGVQLALSASNSGGAWDNA

SEQ ID NO: 9963 - protein, 487 aa, Lotus japonicus
MATVLDHGVVNEKKSVNGCCKSGPGYASPIESMSGPRESLIYVTAVYAGTGIEKPDYLATVDVDPSSPTYSKVIHRLPVPYVGDELHHTGWNSCSSCHGDPSAERRFLIAPSLVSGRIYVIDTKTNPRSPSLHKVVDPADIIQKTGLAYPHTSHCLASGELMISCLGDKDGNAEGNGFLLLDSDFNVKGRWEKPGHSPLFGYDFWYQPRHNTMISTSWGAPTAFTKGFDLQHVADGLYGRHLTCIQLARGELRQTLDLGNTGLLPLEIRFLHDPAKDTGFVGSALSSNMIRFFKTQDGSWSHELAIPVKPLKVQNWILPEMPGLITDFLISLDDRFLYFVNWLHGDIRQYNIEDLKNPVLTGQLWVGGLIQKGSPVAAIGEDGKTWQSDVPEIQGQKLRGGPQMIQLTLDGKRLYVTNSLFSAWDKQFYPGLVEKGSHILQIDVDTEKGGLKINPNFFVDFGAEPDGPALAHEMRYPGGDCTSDIWI

SEQ ID NO: 9964 - protein, 488 aa, Medicago sativa
MGTVLQHAVVSEKVNNQQGCCKSGPGYASPLEAMSGPRETLIYVTAVYAGTGIEKPDYLATVDLDPNSPTYSKVIHRLPVPYVGDELHHTGWNSCSSCHGDPSAQRRFLIVPGIVSGRVYVIDTKTNPRAPSLHKVVEPEDISTKTGLAYPHTSHCLASGEIMISCIGDKDGNAEGNGFLLLDSEFNVKGRWEKPGHSPLFGYDFWYQPRHNTMISTSWGAPKAFLQGFNLQHVADGLYGRHLHVYSWPGGEIKQTLDLGDKGLLPLEIRFLHDPAKDTGFVGSALTSNMIRFFKTQDGSWNHEIVISVEPLKVQNWFLPEMPGLITDFLISLDDRFLYFVNWLHGDIRQYNIEDVKNPKLTGQVWAGGLIQKGSPVVAVKDDGETWQSDVPEIQGKKLRGGPQMIQLSLDGKRLYVTNSLFSAWDKQFYPKLVEQGSHILQIDVDTENGGLKINPNFFVDFGAEPDGPSLAHEMRYPGGDCTSDIWI

SEQ ID NO: 9965 - protein, 478 aa, Glycine max
VMNQRNMHDCPKTGPGYPSPLAAMSGPKETLLYVTAIYSGTGRDKPDFLATVDVDPSSPTYSKVIHRLPVPYLGDELHHFGWNSCSSCYGDPSAVRRYLILPSLVSGRIYVVDTRSNPRSPSLHKVVEPEDIISKTGLAYAHTSHCLASGDVMISFLGDKDGNAAGSGFLLLDHEFNLKGRWEKPGHSPSFGYDFWYQPQHKTMISSSWGAPAASTKGFNLQHVSDGLYGRHLTCIQLAWGELRQTLDLGESGVLPLEVRFLHDPSKDTGFVGCALSSNMVRFLRPRDESWSHEVAISVKPLKVQNWILPEMPGLITDFLISLDDRFLYFVNWLHGDIRQYNIEDPKNPVLTGQVWVGDYFQKGSPIVAITEDGNTWQSDVPDIQGNKLSAGPQMIQLSLDGKRVYVTNSLFSAWDKQFYPELVEKGSHMLQIDVDTENGGLKINPNFFVDFGAEPGGPALAHEMRYPGGDCTSDIWI

SEQ ID NO: 9966 - protein, 407 aa, Leishmania major
MQAKGEAAMRDLIAELHAMQSPYTVQRFISSGSYGAVCAGVDSEGIPVAIKRVFNTVSDGRTVNILSDSFLCKRVLREIRLLNHFHHPNILGLRDIFVHFEEPAMHKLYLVTELMRTDLAQVIHDQRIVISPQHIQYFMYHILLGLHVLHEAGVVHRDLHPGNILLADNNDITICDFNLAREDTADANKTHYVTHRWYRAPELVMQFKGFTKLVDMWSAGCVMAEMFNRKALFRGSTFYNQLNKIVEVVGTPKIEDVVMFSSPSARDYLRNSLSNVPARAWTAVVPTADPVALDLIAKMLEFNPQRRISTEQALRHPYFESLFDPLDLTEGLSERFHFDESVTDVYDMHKIFTAEVERFNDLRERREEVARERAVAAQQQGEQVLGTDHMPRTHSLMELAGSAPAPS

SEQ ID NO: 9967 - protein, 700 aa, Caenorhabditis elegans
MSHHHEHTVSTIHVATILVETHITDPMLLSAKCMTAYSPADSNAEARLLSGGSDPISDTENLLDLAYEVGTSSSDNTRYDRESENDEEEIGVGWEDTTSSSLNKRMCKSATFHDFCDDSEYSRRPVTTLHEEDFDEEEEDEFEDASDRRNLDEDDVEYEDEDDEDDIVVEEEEITPEDIEHSPTGVTTQTTPPSNNTSKSKKKKKRKSDEEDGLRKMKKSSTFASFLNMFVSRRRSGRDSGERLMSRSTCMLRPSISLSVVQESMILGSDGESVEVSPCTSDQTPTGVPPRYIVNVKMRQKTARKWSEEEIQKRLSLPADLRLPVAVVDKLNRTPTLDQPLTRKNRRASLSEIGFGKLETYEKLDKLGEGTYATVFRGRSILTNKFVALKEIRLEQEEGAPCTAIREVSLLRNLRHANVVTLHDIIHTDRLLTLVFEYVDRDLKQYMDSCNNAMQMNNIRLFLYQLLRGLAYCHQRRVLHRDLKPQNLLITAKGELKLADFGLARAKSVPTKTYSNEVVTLWYRPPDVLLGSTDYSTHIDMWGVGCILFEMIAGRALFPGGTPTEQLGLIFRTLGSPRPDRHPTICEKPTFYPYANRHYNPDPLCRQIPRIDAHGFELLMKFLQYEGKDRVSAAEAVKHPFLRTIAVKCCHLRDEQSVLEADGIHIERELLASDHHHSSRRHHRGTLVKDKYRMHSSHHT

SEQ ID NO: 9968 - protein, 135 aa, Calycadenia multiglandulosa
QRNHRHYMGEEIESLSLKEIQNLEQQLDTGLKHIRTRKNQLLHESISELQKKGKAIQEQNTSLTKRIKEKEKDKRTLPQNSQWEQHSYVDHDTTFLMPPPHPTLNIGGDYKQVGGGGGGAHDDGRSNELNLSLQP

SEQ ID NO: 9969 - protein, 133 aa, Centromadia pungens
QRNHRHYMGEDIESLSLKEIQNLEQQLDTGLKNIRTRKNQLLHESISELQKKGKAIQEQNTTLTKKIKEKEKDKTIPQNTQWEMHNYVDPDTTFLMPPPPPALNMGGDYNHGGASSSEGGDGRTNELDLSLQP

SEQ ID NO: 9970 - protein, 133 aa, Deinandra lobbii
QRNHRHYMGEDIESLSLKEIQNLEQQLDTGLKNIRTRKNQLLHESISELQKKGKAIQEQNTTLTKKIKEKEKDKTIPQNTQWEMHNYVDPDTTFLMPPPPPALNMGGDYNHSGAGSSEGGDGRSNELDLSLQP

SEQ ID NO: 9971 - protein, 130 aa, Madia sativa
QRNHRHYMGEEIESLSLKEIQNLEQQLDTGLKHIRTRKNQLLHESISELQKKGKAIQEQNTTLTKRIKEKEKDKTIPQSSHWEQYVDHDTTFLMPPPHPPINIGGDYNQVGGGGGDGSGSSNELDLSLQP

SEQ ID NO: 9972 - protein, 123 aa, Kyhosia bolanderi
RQVTYSKRRNGIFKKAHELTVLCDAKVSLIMFSNTGKFHEYISPSTTTKKIYDMYQTTLGFDLWSSHYERMTETMKKLKDSNNKLRREIRQRVLGEDLDCLDMNDLTILEQQMQDSLTVVRER

SEQ ID NO: 9973 - protein, 363 aa, Mus musculus
MAPAGSTRAKKGILERLDSGEVVVGDGGFLFTLEKRGFVKAGLWTPEAVVEHPSAVRQLHTEFLRAGADVLQTFTFSATEDNMASKWEAVNAAACDLAQEVAGGGGALVAGGICQTSLYKYHKDETRIKNIFRLQLEVFARKNVDFLIAEYFEHVEEAVWAVEVLREVGAPVAVTMCIGPEGDMHDVTPGECAVKLARAGADIIGVNCRFGPWTSLQTMKLMKEGLRDASLQAHLMVQCLGFHTPDCGKGGFVDLPEYPFGLEPRVATRWDIQKYAREAYNLGIRYIGGCCGFEPYHIRAIAEELAPERGFLPPASEKHGSWGSGLNMHTKPWIRARARREYWENLLPASGRPFCPSLSKPDA

SEQ ID NO: 9974 - protein, 496 aa, Mus musculus
MDRMKKIKRQLSMTLRGGRGIDKTNGVPEQIGLDESGGGGGSDLGEAPTRIAPGELRSVRGPLSSAPEIVHEDMKMGSDGESDQASATSSDEVQSPVRVRIRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNVINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFRTYNYPKYRAEALLSHAPRLDSDGADLLTKLLQFEGRNRISAEDARKHPFFLSLGERIHKLPDTTSIFALKEVQLQKEANIRSTSMPDSGRPAFRVVDTEF

SEQ ID NO: 9975 - protein, 331 aa, Mus musculus
GEGAYGMVSSAYDHVRKTRVAIKKISPFEHQTYCQRTLREIQILLRFRHENVIGIRDILRAPTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFDMELDDLPKERLKELIFQETARFQPGAPEGP

SEQ ID NO: 9976 - protein, 311 aa, Leishmania mexicana
MSSFGRVTARSGDAGTRDSLDRYNRLDVLGEGTYGVVYRAVDKITGQYVALKKVRLDRTEEGIPQTALREVSILQEFDHPNIVNLLDVICSDGKLYLVFEYVEADLKKAIEKQEGGYSGMDLKRLIYQLLDGLYFCHRHRIIHRDLKPANILLTSGNVLKLADFGLARAFQVPMHTYTHEVVTLWYRAPEILLGEKHYTPAVDMWSVGCIFAELARRKVLFRGDSEIGQLFEIFQVLGTPTDTEGSWPGVSRLPDYRDVFPKWTAKRLGQVLPELHPDAIDLLSKMLKYDPRERISAKEALQHPWFSDLRW

SEQ ID NO: 9977 - protein, 340 aa, Pichia anomala
MSHKASDEHHVDTDLITLSRFILTSQQKVAAQATGELTLLLNSLQFAFKFIANNIRKAELVNLMGLAGASNSTGDAQKKLDVIGDEIFINAMKASGNVKVLVSEEQEDLIVFDGPGNYAVVCDPIDGSSNIDAGVSVGTIFGIYKLLPGSKGSIKDVLRPGTEMVAAGYTMYGASAHLMLTTGQGVNGFTLDASLGEFILTHPNLTISDEKHIFSVNEGNTTYWTPEVQQFIADLKKPQFNGKPYSARYIGSMVADVHRTLLYGGLFAYPADAKSKAGKLRILYECFPMAFLFEQAGGKAVTDNGDRILELKPKAIHDRSGIWLGSKVEIDRFLKATGKI

SEQ ID NO: 9978 - protein, 443 aa, Bacteroides thetaiotaomicron
MKTKYTYKQIWTIAYPILISLIMEQLIGMTDTAFLGRVGEIELGASAIAGVYYLAIFMMAFGFSVGAQILIARRNGEGNYKEIGPIFYQGIYFLVVVAAILFTLSIVFSPFILKNIISSPHIYDAAESYIHWRVYGFFFSFVGVMFRAFFVGTTQTKTLTLNSIVMVLSNVVFNYILIFGKFGFPQLGIAGAAIGSSLAELVSVIFFIIYTWKRIDCKKYALNILPKFQSRTLKRILNVSVWTMIQNFVSLSTWFMFFLFVEHLGERSLAIANIIRNVSGIPFMIAMAFAATCGSLVSNLIGAGEKDCVRGTINQHIRIGYVFVLPILIFFCLFPDLILRIYTDMPDLRDASIPSLWVLCAAYVVLVPANVYFQSVSGTGNTRTALAMELCVLTIYVAYATYFILYLKMDIAFAWTTESVYGIFILLFCYWYMKKGNWQKKQI

SEQ ID NO: 9979 - protein, 238 aa, Oryza sativa (japonica cultivar-group); identical to SEQ ID NO: 1175

SEQ ID NO: 9980 - protein, 831 aa, Oryza sativa (japonica cultivar-group); identical to SEQ ID NO: 944

SEQ ID NO: 9981 - protein, 306 aa, Oryza sativa (japonica cultivar-group)
MPRYDDRDRYDDRYGGNTRLYVGRLSSRTRTRDLEDLFGRYGSHPHGFLMLCLSMQEEFSDARDADEARYNLDGRDFDGSRMIVEFAKGVPRGPGGSREYMGRGPPPGSGRCFNCGIDGHWARDCKAGDWKNRCYRRGRSYSRSPSPRRGRSRGRSYSRSRSRSYSRSQSPRRDSRNERRSRSPRDSRSPRGSPRDSRSPRGSPRDSRSPKGSPRDTQSPRGSPRDSRSPRRSASPPNGRNRSPTPNASRSPAPRDSRSPMRADSRSPADHERRDMSTAANGRSPSPRDYEDNGNHRASPRGSASP

SEQ ID NO: 9982 - protein, 732 aa, Oryza sativa (japonica cultivar-group); identical to SEQ ID NO: 3319

SEQ ID NO: 9983 - protein, 232 aa, Oryza sativa (japonica cultivar-group)
MTVVDAESRFHVLAVDDSLIDRKLIEMLLKNSSYQVTTVDSGSKALELLGLRDEGDDSSSSPSSSSPDHQEIDVNLIITDYCMPGMTGYDLLKRVKGSSSLKDIPVVIMSSENVPARINRCLEDGAEEFFLKPVKLADMKKLKSHLLKRKQQLPMAAAAPDKPPHKPDEAAASAAAIAEAATAQTDGIISDCSCSGSSKRKAAAMEQEVISSPDQRTKPRLSSTSSGLAVET

SEQ ID NO: 9984 - protein, 280 aa, Oryza sativa (japonica cultivar-group); identical to SEQ ID NO: 3910

SEQ ID NO: 9985 - protein, 264 aa, Arabidopsis thaliana
MDKRLWSLQGMTALVTGAASGIGYAIVEELAGFGAKIHICDISKTLLNQSLSEWENKGFQVSGSVCDVTSHPEREKLMQTVSSIFDGKLNILVNNVGVLRGKPTTEYVADDFTFHISTNLEAAYHFCQLSHPLLKASGYGSIVFLSSVAGVVSLIDCGSIYGLTKGALNQLARNLACEWAKDGIRANAVAPNVVKTAQSQSFLEDVSKKEGLLSRTPLGRVGEPNEVSSLVVFLCLPAASYITGQTICVDGGLTVNGFSYQPHA

SEQ ID NO: 9986 - protein, 223 aa, Arabidopsis lyrata
MRIRRREEKENQEYKKGLWTVEEDNILMDYVLNHGTGQWNRIVRKTGLKRCGKSCRLRWMNYLSPNVNKGNFTEQEEDLIIRLHKLLGNRWSLIAKRVPGRTDNQVKNYWNTHLSKKLVGDYSSAVKTTGEDDDSLPSLFITAATTSCHHQQENVYENIAKRFDGVVSASYEDKPKQELAQNDVLMATTNDPSHYYGNNALWVHDDDFELSSLFTRNDEFCFW

SEQ ID NO: 9987 - protein, 104 aa, Arabidopsis lyrata
MRIRRREEKENQEYKKGLWTVEEDNILMDYVLNHGTGQWNRIVRKTGLKRCGKSCRLRWMNYLSPNVNKGNFTEQEEDLIIRLHKLLGNRWSLINSQKSTGKNR

SEQ ID NO: 9988 - protein, 812 aa, Homo sapiens
MEPLGNWRSLRAPLPPMLLLLLLQVAGPVGALAETLLNAPRAMGTSSSPPSPASVVAPGTTLFEESRLPVFTLDYPHVQIPFEITLWILLASLAKIGFHLYHKLPTIVPESCLLIMVGLLLGGIIFGVDEKSPPAMKTDVFFLYLLPPIVLDAGYFMPTRPFFENIGTIFWYAVVGTLWNSIGIGVSLFGICQIEAFGLSDITLLQNLLFGSLISAVDPVAVLAVFENIHVNEQLYILVFGESLLNDAVTVVLYNLFKSFCQMKTIETIDVFAGIANFFVVGIGGVLIGIFLGFIAAFTTRFTHNIRVIEPLFVFLYSYLSYITAEMFHLSGIMAITACAMTMNKYVEENVSQKSYTTIKYFMKMLSSVSETLIFIFMGVSTVGKNHEWNWAFVCFTLAFCLMWRALGVFVLTQVINRFRTIPLTFKDQFIIAYGGLRGAICFALVFLLPAAVFPRKKLFITAAIVVIFFTVFILGITIRPLVEFLDVKRSNKKQQAVSEEIYCRLFDHVKTGIEDVCGHWGHNFWRDKFKKFDDKYLRKLLIRENQPKSSIVSLYKKLEIKHAIEMAETGMISTVPTFASLNDCREEKIRKVTSSETDEIRELLSRNLYQIRQRTLSYNRHSLTADTSERQAKEILIRRRHSLRESIRKDSSLNREHRASTSTSRYLSLPKNTKLPEKLQKRRTISIADGNSSDSDADAGTTVLNLQPRARRFLPEQFSKKSPQSYKMEWKNEVDVDSGRDMPSTPPTPHSREKGTQTSGLLQQPLLSKDQSGSEREDSLTEGIPPKPPPRLVWRASEPGSRKARFGSEKP

SEQ ID NO: 9989 - protein, 450 aa, Borrelia afzelii
QMDSGESIIENILKNEGLVIENYYNLINTIYSRMEREEFFKREKDKDKESNPDYYNKKKRIASFYKIPLKPIQDRLISYVDNKHRVYELGGDIFEKNLKSERLALKELLRDVPLYQDELRIFSDDYIDSANKIKDLQRQQRIILSRLKIEKIRDLRVLGRDLTIAEKRIEIEKSLKLKEDAIKEQITEAQLAQKELERIEMYYEYPMDKIISMSEEIAKGKQMMQHAKDQLIKANLRLVVSIAKKYANRGLHFFDLVQEGNIGLIKAVEKFEYKRGFKFSTYATWWIRQAITRSISDQARTIRVPVHMIEQINRLNRETRYLVQVLGKDPTDEELSDRLGWELKKVKTVKSVSREPVSLETPIGEEEDSVLSDFIEDKAIKNPANHTSFVVLQDQIRSILGTLPEREQEVVKMRFGLEDGYSLTLEEVGLHFNVTRERIRQIESKALRRL

SEQ ID NO: 9990 - protein, 450 aa, Borrelia afzelii
QMDSGESIIENILKNEGLVIENYYNLVNTIYSRMEREEFFKREKDRDKESNPDYYNKKKRIASFYKIPLKPVQDRLISYVDNKHRVYELGGDIFEKNLKKERLALKELLRDIPLYQDELRIFSDDYIDSANKIKDLQRQQRIILSRLKIEKIRDLRVLGRDLTIAEKRIEIEKSLKLKEDAIKEQITEAQLAQKELERIEMYYEYPMDKIISMSEEIAKGKQMMQHAKDQLIKANLRLVVSIAKKYANRGLHFFDLVQEGNIGLIKAVEKFEYKRGFKFSTYATWWIRQAITRSISDQARTIRVPVHMIEQINRLNRETRYLVQVLGKDPTDEELSDRLGWELKKVKTVKSVSREPVSLETPIGEEEDSVLSDFIEDKAIKNPANHTSFVVLQDQIRAILGTLPEREQEVVKMRFGLEDGYSLTLEEVGLHFNVTRERIRQIESKALRRL

SEQ ID NO: 9991 - protein, 450 aa, Borrelia burgdorferi
QMDSGESIIENILKNEGLVIENYYNLVNTIYSRMEREEFFKREKDKDKESSPDYYNKKKRIASFYKIPLKPIQDRLISYVDNKHRVYDLGGDIFEKNLKKERLALKELLRDIPLYQEELRIFSDDYIDSANKIKDLQRQQRIILSRLKIEKIRDLRVLGRDLTIAEKKIEIEKSLKLKEDAIKEQITEAQLAQKELERIEMYYEYPTDKIISMSEEIAKGKQMMQHAKDQLIKANLRLVVSIAKKYANRGLHFFDLVQEGNIGLIKAVEKFEYKRGFKFSTYATWWIRQAITRSISDQARTIRVPVHMIEQINRLNRETRYLIQVLGKDPTDEELSDRLGWELKKVKTVKSVSREPVSLETPIGEEEDSVLSDFIEDKAIKNPANHTSFVVLQDQIRAILGTLPEREQEVVKMRFGLEDGYSLTLEEVGLHFNVTRERIRQIESKALRRL

SEQ ID NO: 9992 - protein, 450 aa, Borrelia garinii
QMDSGESIIENILKNEGLVIENYYNLINTIYSRMEREEFFKREKDKDKESNPNYYNKKKRIASFYKVPLKPIQDRLISYVDSKHRVYELGGDIFEKNLKSERLALKELLRNVPLYQDELRIFSDDYIDSANKIKDLQRQQRIILSRLKIEKIRDLRVLGRDLTIAEKRIEIEKSLKLKEDAIKEQITEAQLAQKELERIEMYYEYPMDKIISMSEEIAKGKQMMQHAKDQLIKANLRLVVSIAKKYANRGLHFFDLVQEGNIGLIKAVEKFEYKRGFKFSTYATWWIRQAITRSISDQARTIRVPVHMIEQINRLNRETRYLVQVLGKDPTDEELSDRLGWELKKVKTVKSVSREPVSLETPIGEEEDSVLSDFIEDKAIKNPANHTSFVVLQDQIRSILGTLPEREQEVVKMRFGLEDGYSLTLEEVGLHFNVTRERIRQIESKALRRL

SEQ ID NO: 9993 - protein, 450 aa, Borrelia garinii
QMDSGESIIENILKNEGLVIENYYNLINTIYSRMEREEFFKREKDKDKESNPDYYNKKKRIASFYKVPLKPIQDRLISYVDNKHRVYELGGDILEKNLKSERLALKELLRNVPLYQDELRIFSDDYIDSANKIKDLQRQQRIILSRLKIEKIRDLRVLGRDLTIAEKRIEIEKSLKLKEDAIKEQITEAQLAQKELERIEMYYEYPMDKIISMSEEIAKGKQMMQHAKDQLIKANLRLVVSIAKKYANRGLHFFDLVQEGNIGLIKAVEKFEYKRGFKFSTYATWWIRQAITRSISDQARTIRVPVHMIEQINRLNRETRYLVQVLGKDPTDEELSDRLGWELKKVKTVKSVSREPVSLETPIGEEEDSVLSDFIEDKAIKNPANHTSFVVLQDQIRSILGTLPEREQEVVKMRFGLEDGYSLTLEEVGLHFNVTRERIRQIESKALRRL

SEQ ID NO: 9994 - protein, 450 aa, Borrelia garinii
QMDSGESIIENILKNEGLVIENYYNLINTIYSRMEREEFFKREKDKDKESNPDYYNKKKRIASFYKVPLKPIQDRLISYVDNKHRVYELGGDIFEKNLKSERLALKELLRNVPLYQDELRIFSDDYIDSANKIKDLQRQQRIILSRLKIEKIRDLRVLGRDLTIAEKRIEIEKSLKLKEDAIKEQITEAQLAQKELERIEMYYEYPMDKIISMSEEIAKGKQMMQHAKDQLIKANLRLVVSIAKKYANRGLHFFDLVQEGNIGLIKAVEKFEYKRGFKFSTYATWWIRQAITRSISDQARTIRVPVHMIEQINRLNRETRYLVQVLGKDPTDEELSDRLGWELKKVKTVKSVSREPVSLETPIGEEEDSVLSDFIEDKAIKNPANHTSFVVLQDQIRSILGTLPEREQEVVKMRFGLEDGYSLTLEEVGLHFNVTRERIRQIESKALRRL

SEQ ID NO: 9995 - protein, 437 aa, Homo sapiens
MAAGTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFVDSDIVPPASTWVFPTLGIMHHNKQATENAKEEVRRILGLLDAYLKTRTFLVGERVTLADITVVCTLLWLYKQVLEPSFRQAFPNTNRWFLTCINQPQFRAVLGEVKLCEKMAQFDAKKFAETQPKKDTPRKEKGSREEKQKPQAERKEEKKAAAPAPEEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKIFK

SEQ ID NO: 9996 - protein, 450 aa, Borrelia garinii
QMDSGESIIENILKNEGLVIENYYNLINTIYSRMEREEFFKREKDKDKESNPDYYNKKKRIASFYKIPLKPIQDRLISYVDNKHRVYELGGDIFEKNLKSERLALKELLRNVPLYQDELRIFSDDYIDSANKIKDLQRQQRIILSRLKIEKIRDLRVLGRDLTIAEKRIEIEKSLKLKEDAIKEQITEAQLAQKELERIEMYYEYPMDKIISMSEEIAKGKQMMQHAKDQLIKANLRLVVSIAKKYANRGLHFFDLVQEGNIGLIKAVEKFEYKRGFKFSTYATWWIRQAITRSISDQARTIRVPVHMIEQINRLNRETRYLVQVLGKDPTDEELSDRLGWELKKVKTVKSVSREPVSLETPIGEEEDSVLSDFIEDKAIKNPANHTSFVVLQDQIRSILGTLPEREQEVVKMRFGLEDGYSLTLEEVGLHFNVTRERIRQIESKALRRL

SEQ ID NO: 9997 - protein, 450 aa, Borrelia garinii
QMDSGESIIENILKNEGLVIENYYNLINTIYSRMEREEFFKREKDKDKESNPDYYNKKKRIASFYKVPLKPIQDRLIRYVDNKHRVYELGGDIFEKNLKSERLALKELLRNVPLYQDELRIFSDDYIDSANKIKDLQRQQRIILSRLKIEKIRDLRVLGRDLTIAEKRIEIEKSLKLKEDAIKEQITEAQLAQKELERIEMYYEYPMDKIISMSEEIAKGKQMMQHAKDQLIKANLRLVVSIAKKYANRGLHFFDLVQEGNIGLIKAVEKFEYKRGFKFSTYATWWIRQAITRSISDQARTIRVPVHMIEQINRLNRETRYLVQVLGKDPTDEELSDRLGWELKKVKTVKSVSREPVSLETPIGEEEDSVLSDFIEDKAIKNPANHTSFVVLQDQIRSILGTLPEREQEVVKMRFGLEDGYSLTLEEVGLHFNVTRERIRQIESKALRRL

SEQ ID NO: 9998 - protein, 450 aa, Borrelia japonica
QMDSGESIIENILKNEGLVIENYYNLVNTIYSRMEREEFFKREKDKDKESSPDYYNKKKRIASFYKIPLKPIQDRLISYVDNKHRVYELGGDIFEKNLKRERLALKELLQDIPLYQDELRIFSDDYIDSANKIKDLSRQQRIILNRLKIEKIRDLRVLGRDLTIAEKGIEIEKSLKLKEDAIKEQITEAQLAQKELERIEMYYEYPMDKIISMSEEIAKGKQMMQHAKDQLIKANLRLVVSIAKKYANRGLHFFDLVQEGNIGLIKAVEKFEYKRGFKFSTYATWWIRQAITRSISDQARTIRVPVHMIEQINRLNRETRYLIQVLGKDPTDEELSDRLGWELKKVKTVKSVSREPVSLETPIGEEEDSVLSDFIEDKAIKNPANHTSFVVLQDQIRAILGTLPEREQEVVKMRFGLEDGYSLTLEEVGLHFNVTRERIRQIESKALRRL

SEQ ID NO: 9999 - protein, 250 aa, Chlamydomonas reinhardtii
RIRVHGAKELLLKSNYKLVMTVCKSFVGKGPHIQDLVSEGVKGLLKGVEKYDATKGFRFGTYAHWWIRQAVSRSLAETGRAVRLPMHMIEQLTRLKNLSAKLQTQLAREPTLPELAKAAGLPVTRVQMLMETARSAASLDTPIGGNELGPTVKDSVEDEREAADEEFGSDSLRNDMEAMLLELPEREARVVRLRFGLDDGKEWTLEEIGEALNVTRERIRQIEAKALRKLRVKTIDVSGKLMEYARTWRC

SEQ ID NO: 10000 - protein, 269 aa, Azoarcus evansii
MTTTLGRNRENAAPLAGRHALVTGAGSGIGRACAIELARLGATLTLVGRRAALLESACAELPGDGHGFAAADITDFAALRAAFDAATAARGPVAILVNNAGAAKSAPFGRTEPELWNEMLAVNLTGTYNCTHAVLAGMQAAGWGRIVNIASTAGLAGYAYVAAYCAAKHGVVGLTRALALEVAKQGITVNAVCPGYTDTPLIEGAVDNIVAKTGRSTDDAKAALAARNPQGRLVQPEDVAGTVGWLCLPSSDAIHGQSIAVAGGEVMCG

SEQ ID NO: 10001 - protein, 270 aa, Azoarcus evansii
MTTTLDPKRERTAAPLAGRHALVTGAGSGIGRACALELARLGATLTLVGRRGAALEATCAELEGDGHGLAVADITDFAAVRAAFDAAVAARGPIAILVNNAGAAKSAPFGRTDPELWSEMLAVNLTGTYHCTHAVLAGMQAAGWGRIVNVASTAGLVGYAYVAAYCAAKHGVVGLTRALALEVAKQGITVNAVCPGYTDTPLIEGAVDNIVAKTGRSTDDAKAALAARNPQGRLVQPEDVAATVGWLCLPSSDAIHGQSIAVAGGEVMCG

SEQ ID NO: 10002 - protein, 299 aa, Ethmostigmus rubripes
  unsure (1)..(299): unsure at all Xaa locations
MPIDAVSFLKDFIAGGVAAAISKTSVAPIERVKLLLQVQHASKQIAVDKQYKGMVDCFVRIPQEQGILSYWRGNLANVIRYFPTQALNFAFKDKYKQIFLGGVDKRTQFWRYFLGNLASGGAAGATSLCFVYPLXFARTRLAADIGKGLEQREFTGLGNCIAKIFKSDGLVGLYRGFGVSVQGIIIYRAAYFGTYDTAKGMLPDPKNTPIVISWLIAQTVTTCAGIISYPFDTVRRRMMMQSGRKKADILYKNTIDCWGKIYKTEGGAAFFKGAFSNILRGTGGAFVLVLYDEIKALIF

SEQ ID NO: 10003 - protein, 521 aa, Pleurotus ostreatus
MVLSTKLAALVASLPFVLAATKKLDFHIRNDVVSPDGFERRAITVNGIFPGTPVILQKNDKVQINTINELTDPGMRRSTSIHWHGLFQHKTSGMDGPSFVNQCPIPPNSTFLYDFDTAGQTGNYWYHSHLSTQYCDGLRGSFIVYDPNDPLKHLYDVDDESTIITLADWYHDLAPHAQNQFFQTGSVPIPDTGLINGVGRFKGGPLVPYAVINVEQGKRYRFRLIQISCRPFFTFSIDNHTFDAIEFDGIEHDPTPAQNIDIYAAQRASIIVHANQTIDNYWIRAPLTGGNPAGNPNLDISLIRAILRYKGAPAVEPTTVATTGGHKLNDAEMHPIAQEGPGNLGTGPPDMAITLNIAQPNPPFFDINGISYLSPSVPVLLQMLSGARKPQDFLPSEQVIILPANKLIEVSIPGAGAHPFHLHGHTFDIVRTSNSDVVNLVNPPRRDVLPINGGNTTFRFFSGNSGAWFLHCHIDWHLEAGLAVVFAERPAEVNEGEQAQIVTQDWRTLCPAYDGLAPEFQ

SEQ ID NO: 10004 - protein, 433 aa, Borrelia burgdorferi B31 [sequence omitted]

SEQ ID NO: 10005 - protein, 1494 aa, Borrelia burgdorferi B31
MKKANFLSTNFLILLLVCFVNVNLFSKDIFKFKLVDQFFPFYYKNNKGEYEGLIFSILDKWAKDNNADIMVEHIDNLNESEIEDEAIYLGLTYNVKLNDFFYFKSELARSISILFFKNSNKKYKNTHSTFLSNFNIGVIKNTIYEDILRLKNVNTIFLADNSQELVLALKNDKVDYIYGDCKTLHYIANNFLSEDLVIFTGDVFYSIKNRVAISRNAPEIVKNLNLDLFSYLMKMPEELVFSFLDSNAKGSFVDVGLYNDYPPLSFINSQGKLSGILVDLWNLLSRQHIFKPIFKGFSKEDIKKSLDGKSVGIFGGIISNDSVLENVNYVVSKPIYPLNFKFYSKDLSNDAGPINSQFIDFNFNNIQLNKNKDIVNNFIDIVNNSYGFIENSITTKYLLKLNGYNGRLKSYDSIFNKNRFLVLAIDNRIYKVIKYILNSIFDDISFESLLQIDKNWLDKEEINSSRINSYKIMNKVKFNIEEKIWLSKNNKLNLAVKNWYPIDYVEANNYKGINQFLLDKIRMFSGLRFNIIKVHSSLDLKKLIKSGKIDMLNTNATDSNLDNVFNIKLNSRIPLYIFSNKKRVLPSRSLEKFAILDFLYSKNLASNIKSKLILVSSFNEALLLLYKGKVDGIISDEYTAAAVFEELNIDDVEKIPTFRDLAFDLSLAIYNQDYILKEIIQKVVMRSNVDSQMYLNDWKFDIYYKSRSIRFKNFKFLVITFIIFYFTFLGFVIIFMFRLSFEQKRRYSFVMNEKKIAEAANAAKTIFIANVSHDIRTPINGIMAATELLDTTILTDVQKDYVRMINYSSDSLLSLIDDILYLSKIDVNELYVESQEIDLESEMEMVLKAFQSQCAKKNIDLFSYSKSIFNNYIKGDIVKIKQVLINLIGNAFKFTDDGVIVLNYEEVCRTRTDGNRVLVTVEFKVIDTGKGIEKENFSKIFEIFKQEDDSSSRVHEGAGLGLSISRELIRLMGGLGIAVDSKVGEGTTFSFMLPFLLGSELKSKKLSINRFQSVNGDNKVLNVLLSQKSIKIFEHCSILLGCSSNVRYVASFEDAYKVFKKYPSYNFVYINVNNDNIQEGIRLANNIERLNSDVQIIFLFYYLDNKALKNLKYGYVKKPLMGLGICSILYKKEFNPEMDFEDLVPIDSALRIKEPINVLIAEDNQVNQKVLKDILVVIGINENFIDVVDDGVKALKSLKDKKYTISFIDIRMPRYDGFSVAKEIRKFEKAKNLKPCVLVAVTAHALQEYKDKCLASGMNDYISKPIHISSIKTILKKYLQFEVDDIGENENLNQLVKFPNLDVNRALKELNLSYVSYSELCRGLVDFISINIIDLEKAFDEEDLSLIKDISHSISGALSNMRSELYKDFQKIETSKDSISELKKMYSFVKDDLFQLISDIKENILFESEIVSENKLYFKNNDQFLNLLNKLLIGIKTRKPREYKEILESINKYVLDDNIQVLFSDLRRNLRLYRFAESSKILEEIIEMLNNKRY

SEQ ID NO: 10006 - protein, 573 aa, Borrelia burgdorferi B31
MTLSGKRISKGIGIGEVLCIRKNFDKIISREKIDFSQVDSEISKFNKAKSKAIEALRDLERKAMLQFGDDKKGIFEGQVLIVEDDELDELVIELIVKENYSAAYSIYLAFENLVKSVEDYKDPYLKERASDYKDIRNRLISIILGQVSDFSEINKDIILVTEELTPSDTMQFDLNYVKGFLTAVGGETSHAAILARTMGLPALVMTLSDIDALKDGDKIVIDAMSSIVIKNPSSDEINLYEGKILRQVELEKELFSLKDKDAETKDGTKVFLKANIGTPVDITYVNKYGVEGIGLFRTEFLYMRSLQPPTEDEQFETYKRVIETMEKKGVVTIRTLDVGGDKEIPYLNFKKEENPFLGFRALRMYKEYEELIQAQFNAIFRASHYGKIRVMVPMLTIYEEIETIEYFVNNAKINLKSRGLPFDENLEVGCMIEVPSAALISSKLANKLKFFSIGTNDLTQYVLAVDRGNQKISNLYDKYNPAVLKLIKKVLDDGVSSGIDVSVCGELGGDDAGALLLVGLGFRSLSMIPSATLRIKYLLKKYTIMELEELANKVLNSDSKQETLSYFDKFIGD

SEQ ID NO: 10007 - protein, 631 aa, Borrelia burgdorferi B31
MSDLEKKYSKLIEGIITHLGDRKSLSFSELSNLLPDDILEPEILDCICSVLEDRGIRLVNKISELDLVVSEDGNDEEEEVEIESDRNFMILDDGFQSDEEDIDIDVKLDDCDEEDISVKDDLGSGYIKGNVLKDSHSEDPIKLYLKEIGKEFLLTGNQEVELAKQMDSGESIIENILKNEGLVIENYYNLVNTIYSRMEREEFFKREKDKDKESSPDYYNKKKRIASFYKIPLKPIQDRLISYVDNKHRVYDLGGDIFEKNLKKERLALKELLRDIPLYQEELRIFSDDYIDSANKIKDLQRQQRIILSRLKIEKIRDLRVLGRDLTIAEKKIEIEKSLKLKEDAIKEQITEAQLAQKELERIEMYYEYPTDKIISMSEEIAKGKQMMQHAKDQLIKANLRLVVSIAKKYANRGLHFFDLVQEGNIGLIKAVEKFEYKRGFKFSTYATWWIRQAITRSISDQARTIRVPVHMIEQINRLNRETRYLIQVLGKDPTDEELSDRLGWELKKVKTVKSVSREPVSLETPIGEEEDSVLSDFIEDKAIKNPANHTSFVVLQDQIRAILGTLPEREQEVVKMRFGLEDGYSLTLEEVGLHFNVTRERIRQIESKALRRLKNPKKTQKLKDYLEDLN

SEQ ID NO: 10008 - protein, 453 aa, Borrelia burgdorferi B31
  unsure (1)..(453): unsure at all Xaa locations
MKMSKILVADDEKNIREGIATYLEDEGYFVFTASDGEEALETIENENLDVIISDLRMPQISGEKLLKIVKEKNLGIPFIILTAHGTVDSAVDAMREGAYDFLTKPLDLERLLLIIKRSLNKKENNDNENANLENILIRKDLKYYEKIMGKSLLMQKIFELVIKIAKSNASILITGESGVGKEIIADAIFDLSNRNDKPFIKVNCAALSESILESELFGHEKGAFTGAISKKKGRFELANKGTIFLDEIAEISPEIQVKLLRVLQNKTFERVGGEATIKVDIRLLAATNKNIEEEIKKEKFREDLFYRLNIININIPPLRERKDDISYLTNILIKDVAKENNREEKTLSNDAMKALYYYDWPGNIRELKNVLESALILSKGKQITKEDLPAKIKNNENLIFKITLPXGISLKEAEKEIIKQTLFHSKNNKSKCAEILKIGRKTLHNKIIEYNID

SEQ ID NO: 10009 - protein, 266 aa, Borrelia burgdorferi B31
MNIFSNEDLNIYLKSVREHKLITHEEEIKLAGQIQRGNAKAKNKMINANLRLVLKIIKRYAGKGLKIEDLIQEGNLGLIRAAEKYDPNKNTKFSTYASFWIKQSLQRALNTKTRLVKVPYRKENLILQINKYLTEEEKSPKKEEIMKRFNLSPAQYIKIIPYLEKEYSLDKEIEGSENSTLLNLYEDNSFNPEITLEQDSTLKHLNYILETKLNEKERYIIKKRYNLDNSPKKSTLKDISTELGISSETVRQIEKRVLKKLKEEIN

SEQ ID NO: 10010 - protein, 1032 aa, Pseudomonas aeruginosa PAO1
MDIELPGFDIERELGEGAMATVYLATQRSLQRKVALKVMAAALAADPSFAERFLREGRTLARLSHPNTVTIHDIGNVGSCYYMAMEYLPNGTLKERIQQGLDPEQGLAYVRQVAAALGYAHSQGLVHRDVKPANILFRADGTAVLSDFGIAKSIEDNTQFTQVGFAVGTPSYMSPEQARGQEIDGRADLYALGVVLYEILTGKLPYNGKDSLSTALAHLTEPLPELPIEQGRYQDILRQLLAKDPAERFPTAGALIAALDRLAPSALEATQIRPLATPQGSPRASNPPPAEPAPLPPADLGGLQPVSIQLPPVTPSAGGATPPPPPPSQAAKPPSPPPPPLPPAKPRAGGSRTPLIAAAAAAVLLAIGGGAWWLLGSGDAPSAADPAPLGQTPADKPQQQTPVADAEQDGGERPLLMPGKKTLFQRVLTKPGAAISAEAGGPPRAGAVPAFSVLYVYARKQVGGSPWLRVGASSNGEGDGWLPASAVSDWKQSLVLKFTERSGRAPVMFLNSAEQVERLLGDTRAARDTLTQAVDHKGDPQVVAVEPNDRAIPQDQFYLLPIFDSKESFDADGQPAQLLEVASIDPGGSAAAPQAPGQAGQGGASGAASDTFRTGIVLVVDTSVSMQPYIDRVREVIDGLQRQIGERGDLDKVSFGLVGFRNNTDKTPGLEYVSKTLVPLQPGNDAQRFAELSSQVRATDVSSHSFNEDAFAGIMQAVDEMDWSPYAGRVVLLVTDAGALRKNDPLGRTQMNEAEVRQAALRKGVKIYALHLRTPAGKNNHGYAEQQYRSLTADANPKIADLYIPVAGGEVNAFGNTVKEIGTVFADLVHDAGNRKPQAPRFDAAPSVASKSAAIGYAMQMEFLGRRDPVRAPQVVTAWTADRDLTNPALPAFQVCVLLSKLQLNELQQSLKLIVDAAKRTQTSPKDFFQEIASASAYMSRDPAQLVKGSNLAQSGVLGEYLEGLPYRSKSLNMTQDLWLSLSVAEQQDFIDELESKIRLYETFHNDVANWVRFGDADAGDALYRVPLSTLP

SEQ ID NO: 10011 - protein, 496 aa, Pseudomonas aeruginosa PAO1
MFELSDWQRRAATQRFIDQALIGGRQRPAASGATFDAIDPASNRLLARVAACDAADVDAAVAAARRAFDEGPWARLAPVERKRVLLRLAELMLAHREELALLDSLNMGKPVMDAWNIDVPGAAHVFAWYAESLDKLYDQVAPTAQQTLATITRVPLGVIGAVVPWNFPLDMAAWKLAPALAAGNSVVLKPAEQSPFSALRLAELALEAGVPEGVLNVVPGLGEQAGKALGLHPEVDALVFTGSTEVGKYFMQYSAQSNLKQVWLECGGKSPNLVFADCRDLDLAAEKAAFGIFFNQGEVCSANSRLLVERSIHDEFVERLLAKARDWQPGDPLDPASRAGAIVDRRQTAGILAAIERAQGEGATLLGGGRQLTINGSDNFIEPTLFGDVRPDMQLAREEIFGPVLAISAFDSEDEAIRLANDSRYGLAASLWSDDLHRAHRVARRLNAGTVSVNTVDALDVAVPFGGGKQSGFGRDLSLHSFDKYTQLKTTWFQLR

SEQ ID NO: 10012 - protein, 483 aa, Pseudomonas aeruginosa PAO1
MQLKDAKLFRQQAYVDGAWVDADNGQTIKVNNPATGEIIGSVPKMGAAETRRAIEAADKALPAWRALTAKERANKLRRWFDLMIENQDDLARLMTIEQGKPLAEAKGEIAYAASFLEWFGEEAKRIYGDTIPGHQPDKRIIVIKQPIGVTAAITPWNFPSAMITRKAGPALAAGCTMVLKPASQTPYSALALAELAERAGIPKGVFSVVTGSAGEVGGELTSNPIVRKLTFTGSTEIGRQLMAECAQDIKKVSLELGGNAPFIVFDDADLDAAVEGALISKYRNNGQTCVCANRLYVQDGVYDAFVDKLKAAVAKLNIGNGLEAGVTTGPLIDAKAVAKVEEHIADAVSKGAKVVSGGKPHALGGTFFEPTILVDVPKNALVSKDETFGPLAPVFRFKDEAEVIAMSNDTEFGLASYFYARDLARVFRVAEQLEYGMVGINTGLISNEVAPFGGIKASGLGREGSKYGIEDYLEIKYLCLGGI

SEQ ID NO: 10013 - protein, 284 aa, Pseudomonas aeruginosa PAO1
MTTSLQPVHALVPGANLEAYVHSVNSIPLLSPEQERELAERLFYQQDLEAARQMVLAHLRFVVHIAKSYSGYGLAQADLIQEGNVGLMKAVKRFNPEMGVRLVSFAVHWIKAEIHEFILRNWRIVKVATTKAQRKLFFNLRSQKKRLAWLNNEEVHRVAESLGVEPREVREMESRLTGQDMAFDPAADADDESAYQSPAHYLEDHRYDPARQLEDADWSDSSSANLHEALEGLDERSRDILQQRWLSEEKATLHDLAEKYNVSAERIRQLEKNAMSKLKGRILA

SEQ ID NO: 10014 - protein, 469 aa, Pseudomonas aeruginosa PAO1
MSAVMTPAGFTDYKVADITLAAWGRRELIIAESEMPALMGLRRKYAGQQPLKGAKILGCIHMTIQTGVLIETLVALGAEVRWSSCNIFSTQDQAAAAIAAAGIPVFAWKGETEEEYEWCIEQTILKDGQPWDANMVLDDGGDLTEILHKKYPQMLERIHGITEETTTGVHRLLDMLKNGTLKVPAINVNDSVTKSKNDNKYGCRHSLNDAIKRGTDHLLSGKQALVIGYGDVGKGSSQSLRQEGMIVKVAEVDPICAMQACMDGFEVVSPYKNGINDGTEASIDAALLGKIDLIVTTTGNVNVCDANMLKALKKRAVVCNIGHFDNEIDTAFMRKNWAWEEVKPQVHKIHRTGKDGFDAHNDDYLILLAEGRLVNLGNATGHPSRIMDGSFANQVLAQIHLFEQKYADLPAAEKAKRLSVEVLPKKLDEEVALEMVKGFGGVVTQLTPKQAEYIGVSVEGPFKPDTYRY

SEQ ID NO: 10015 - protein, 617 aa, Pseudomonas aeruginosa PAO1
MSGKAQQQSRLKELIARGREQGYLTYAEVNDHLPEDISDPEQVEDIIRMINDMGINVFETAPDADALLLAEADTDEAAAEEAAAALAAVESDIGRTTDPVRMYMREMGTVELLTREGEIEIAKRIEEGIREVMSAIAQFPGTVDSILADYNRIVAEGGRLSDVLSGYIDPDDGSLPAEEVEPVNLKDDSADSKEKDDEEEESDDSSDSDDEGDGGPDPEEARLRFTAVSEQLDKAKKALKKHGRGSKQATAELTGLAELFMPIKLVPKQFDALVARVRSALEGVRAQERAIMQLCVRDARMPRADFLRLFPNHETDEKWVDSVLKSKPKYAEAIERLRDDILRNQQKLAALESEVELTVAEIKEINRAMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELGERMDMPEDKIRKVLKIAKEPISMETPIGDDEDSHLGDFIEDSTMQSPIEMATSESLKESTREVLAGLTAREAKVLRMRFGIDMNTDHTLEEVGKQFDVTRERIRQIEAKALRKLRHPSRSEHLRSFLDE

SEQ ID NO: 10016 - protein, 273 aa, Pseudomonas aeruginosa PAO1
MKTLTLIDGQEVAAIGQGTWHIGEQPGERKREVAALREGIELGMTLIDTAEMYAEGGAEDVVGAAIAGRREEVFLVSKVYPHNASREGLPAACERSLRRLGCETIDLYLLHWQGRYPLEETIEAFERLRDQGKILRWGVSNFDLGDMYELDGSACAANQVMYNLEERGIEYDLLPWCQERGMPVMAYCPVGQGGRLLRHPALGEIAARHDASSAQVALAWLLEQGVIAIPKAVTSAHIRLNAAAADLELSADDLRALDQAFPPPTRKRNLAIV

SEQ ID NO: 10017 - protein, 925 aa, Pseudomonas aeruginosa PAO1
MFKDLGIKGRVLLLTLLPTSLLAMVLGGYFTWVQLSDMRAQLIERGQLIAEQLAPLAATALARKDTAVLNRIANEALDQPDVRAVTFLDARQERLAHAGPSMLTVAPAGDASHLSMSTELDTTHFLLPVLGRHHSLSGATEPDDERVLGWVELELSHHGTLLRGYRSLFTSLLLIAAGLGVTALLALRMSRAINAPLELISQGVAQLKEGRMETRLPPMGSNELDELASGINRMAETLQSAQEEMQHNIDQATEDVRQNLETIEIQNIELDLARKEALEASRIKSEFLANMSHEIRTPLNGILGFTNLLQKSELSPRQQDYLTTIQKSAESLLGIINEILDFSKIEAGKLVLENLPFNLRDLIQDALTMLAPAAHEKQLELVSLVYRDTPIQLQGDPQRLKQILTNLVGNAIKFTQGGTVAVRAMLEDESDDRAQLRISVQDTGIGLSEEDQQALFKAFSQADNSLSRQAGGTGLGLVISKRLIEQMGGEIGVDSTPGEGAEFWISLSLPKSRDDNEEPGASWAAGQRVALLEPQELTRRSLHHQLTDFGLEVSEFADLDSLQESLRNPPPGQLPISLAVLGVSAAIHPPEELSQSFWEFERLGCKTLVLCPTTEQAQYHATLPDEQVEAKPACTRKLQRKLQELLQVRPTRSDKPHAMVSGRPPRLLCVDDNPANLLLVQTLLSDLGAQVTAVDSGYAALEVVQRERFDLVFMDVQMPGMDGRQATEAIRRWEAEREVSPVPVIALTAHALSNEKRALLQAGMDDYLTKPIDEQQLAQVVLKWTGLSLGQSLASMSRAPQLGQLSVLDPEEGLRLAAGKADLAADMLAMLLASLAADRQAIRQARDNDDRTALLERVHRLHGATRYCGVPQLRAACQTSETLLKQNDPAAAAALDELDKAIEALADTASATTHLSSTSLDSSEL

SEQ ID NO: 10018 - protein, 301 aa, Pseudomonas aeruginosa PAO1
MTRTRWFALACLILAMALWGSSYVVLKVAFRELPPLWVIFGRMALGSLVFLVAWRWRGRIDYRPGDWKYLLGLAVCEPCLYFLCESFALQYTSAAQAGMITALLPLLVAVGAWLLLHERIGRMTWIGFGLAVLGSIWLSLAGEPDLHAPQPLLGNFFELLAMLCATGYTLLLKHLSARYSAFALTAMQAFVGTLFFLPLALASADLPSQPSALGIQAVVYLGVVVTVGAYGLYNFGVGRLPASQASGFINLIPVFTLVFAALFLGETLNGPQMLAAGLVFIGVAISQWRSAPPPPPAGVLN

SEQ ID NO: 10019 - protein, 473 aa, Pseudomonas aeruginosa PAO1
MAAKVLLVEDDRALREALSDTLLLGGHEFVAVDSAEAALPVLAREAFSLVISDVNMPGMDGHQLLGLIRTRYPHLPVLLMTAYGAVDRAVEAMRQGAADYLVKPFEARALLDLVARHALGQLPGSEEDGPVALEPASRQLLELAARVARSDSTVLISGESGTGKEVLANYIHQQSPRAGKPFIAINCAAIPDNMLEATLFGHEKGSFTGAIAAQPGKFELADGGTILLDEISEMPLGLQAKLLRVLQEREVERVGARKPINLDIRVLATTNRDLAAEVAAGRFREDLYYRLSVFPLAWRPLRERPADILPLAERLLRKHSRKMNLGAVALGPEAAQCLVRHAWPGNVRELDNAIQRALILQQGGLIQPADLCLTAPIGMPLAAPVPVPMPAMPPATPPSVEIPSPAAGQDASGALGDDLRRREFQVIIDTLRTERGRRKEAAERLGISPRTLRYKLAQMRDAGMDVEAYLYAI

SEQ ID NO: 10020 - protein, 496 aa, Pseudomonas aeruginosa PAO1
MTDLRDTSRDERLLAAHGYRQELERGLSLWSSFSVGFATISPVVGIYSVMSLGAMSMGPSWVWVVPLCLLLQFGVALVYAELSSQFPLAGGCYQWVRRLVGDRLAWFTGFLYLASALASLTTVAYLGGFWLGLLATGAPPSANGQVLCGALLLALGLAVNLLGINPLKYFVNAGIVAEAIASIGIGVLLLLFFRNHPLDLLFSGPGGTGDADGSYLDGVLTALAVGGWAFLGFDACSQISEETTDARVSTPRAILRSMLVVGFTVMLTAFAVTLSYQDIGAVVSGQVVDPVTPAVVDAFGAWAERPFVAVVLIAFVACVVSVQTYIGRAIFGMARDAILPGSALLRRVDRRKVPMAAMVCSTLLASLGLALGLNATAVGTLIAFGSGGFFVVFLIVAACALWARLVGRWDPDKGALRLGRAGLAVNVLAVAWLSFEALNVAWPRASLAPPDAPWFQVWAVVVVFSALAAFGLLYMVIAKPHRRIATSLSFAAPPAD

SEQ ID NO: 10021 - protein, 315 aa, Pseudomonas aeruginosa PAO1
MSNTEERCDLSSSRDCPERHEHLLQRVTARAAEIGGGITVSRLMPSRQRRMIGAWCFLDHAGPAEFEPGGGLAVGPHPHIGLQTFTWMIQGEALHRDSLGNVQVIRPGQVNLMTAGHGIAHTEESLPDERHAHAAQLWIALPYEQRDIAPAFDHHPDLPRWQEQGVTFTLLAGALAGRQAPCRLYSPLLGADLACHDASTLQLTLDPHFEYGLLPLEGGLEVGGEHFAVNELAYLGDGRDGLQLQLDPGARVLLLGGAPFGAEIFMWWNFVGHSKGEIARAQKAWEEGDARFGRLDALEGPRLSAPPIPWKIDAE

SEQ ID NO: 10022 - protein, 232 aa, Pseudomonas aeruginosa PAO1
MIERRPFDRLGHANHGWLNARHHFSFADYYDPEREDWGRLRVWNDDEIAAGSGFPPHPHRDMEIITYVREGAITHQDSLGNKGRTEAGDVQVMSAGTGIVHSEYNLEAETTRIFQIWIIPDRRGDQPRWGSKPFPKAERDGRFVTLASGDEQDSEALHIRADAEVAAVTLKAGQSAEYALENGRRAYLVPATGSIEVNGVRAEARDGLAVRDEPTLKVTALEDSEVLLVEVA

SEQ ID NO: 10023 - protein, 259 aa, Pseudomonas aeruginosa PAO1
MNVLIVYAHPEPRSLNGALKDFAVARLEAAGHAVQVSDLYAMGWKAVLDAGDSLEREASERFDPSATSLRAFENGWQSVDIAGEQDKLRWADTLILQFPLWWFSMPAILKGWIDRVYACGFAYGVGEHSDSHWGDRYGEGRMQGKRAMLVVTAGGWESHYAARGINGPMDDLLFPIHHGILHYPGFEVLPPFVVYRSGRIDAERFAALSEQLGRRLDDLQRAAPIPFRRQNGGDYLIPALTLRDELAPQRAGFAMHLAE

SEQ ID NO: 10024 - protein, 477 aa, Pseudomonas aeruginosa PAO1
MNSPALPLSRGLRIRAELKELLTLAAPIMIAQLATTAMGFVDAVMAGRASPHDLAAVALGNSIWIPMFLLMTGTLLATTAKVAQRHGAGDQPGTGPLVRQALWLALLIGPLSGAVLWWLSEPILGLMKVRPELIGPSLLYLKGIALGFPAAALYHVLRCYTNGLGRTRPSMVLGIGGLLLNIPINYALIYGHFGMPKMGGPGCGWATGSVMWFMFLGMLFWVNKASIYRASQLFSRWEWPDRATIGPLVAVGLPIGIAVFAESSIFSVIALLIGGLDENVVAGHQIALNFSALVFMIPYSLGMAVTVRVGHNLGAGLPRDARFAAGVGMAAALGYACVSASLMLLLREQIAAMYSPDPAVIAIAASLIVFSALFQFSDALQVTAAGALRGYQDTRVTMIMTLFAYWGIGLPVGYSLGLTDWFQEPTGPRGLWQGLVVGLTGAAIMLCIRLARSARRFIRQHERLQREDAEAASVLGR

SEQ ID NO: 10025 - protein, 303 aa, Pseudomonas aeruginosa PAO1
MRKSADAFAFQTMLLLCVIWGIQQVTIKWAATDIAPVMQAAIRSGIAAALVGLLMCWRGGWEGLRQGTLGAGLLTGTLFALEFLFIALGLQYTTASHMSVFLYTAPIFSALGLHFLLPSERLRPLQWLGVAVCFGGIAVAFGGGLSWAEMDGRMLLGDAFGLLAGMSWGATTVAVRGTRLSEAPPSLTLFYQLFVACAGLLLIALFSGQFGEVRWTPVSTASVLFQGVVVSFASYFCWFWLLRRYLANNLAIFSFMTPLFGVTFGVLLLGEPLSLNFVAGAALVLAGITLVSGEQWLRRLLRR

SEQ ID NO: 10026 - protein, 651 aa, Pseudomonas aeruginosa PAO1
MSQRHGWDIRTRMLAISLGPALLLTLLLTAYFTYSRLQDLRQELTHTGQLIADQLAPAAEYGVIAGNTPVLQKLLQATLDTPHVRFIEVRDRNDNILVYVEQLSGALQNAAPIDIFHSTIQRQRIALASDPLLDGASEGDGQSGEDYLGRVVVGMSNDAFSQRQQEILLKAALLAAFALILTFLVARRLAQRLSAPISTMGQAVEAIQSGDYKTSLPILDDGEIGDLARHINNLASGLDRASREQEQAIGQLISAREEAEQANRAKSDFLAMMSHELRTPMNGVLGMLQLLETTEQTREQAEYTALATESTEHLLKVINDILDFSRIERGALELECIPFNLLELVQGSALVFQHSAQQRGLALELQIQAGLENIEVCGDPTRIRQILVNLLGNALKFTEEGAIHLSLEWQALDHDVLWLTCAVHDSGIGISPERLEHMFDAFQQADSSISRRYGGTGLGLAIARTLAERMGGTLQAESKEGSGSTFTLEIPLPFQQSPAHRQQAAGDAAPVAAGQEILLVEDNPVNQTVIEAMLRSLGYRVTLVADGIQAVRSAERQRYDAILMDCRLPVLDGYSATREIRAQENGRRVPIIALTANALQGDRENCLQAGMNDYLAKPFKRAELQRILQRWIGSQPELPVTSNETGRGEPE

SEQ ID NO: 10027 - protein, 253 aa, Pseudomonas aeruginosa PAO1
MSKLLSGQVALVTGGAAGIGRATALAFAAAGVKVVVADLDSAGGEGTVEAIRQAGGEALFIRCDVTRDAEVKALVEGCAAAYGRLDYAFNNAGIEIEQGKLADGNEAEFDAIMAVNVKGVWLCMKHQIPLMLAQGGGAIVNTASVAGLGAAPKMSIYAASKHAVIGLTKSAAIEYAKKGIRVNAVCPAVIDTDMFRRAYEADPRKAEFAAAMHPLGRVGRVEEIAAAVLYLCCDNAGFTTGIALPVDGGATAI

SEQ ID NO: 10028 - protein, 791 aa, Pseudomonas aeruginosa PAO1
MVEYVVSLDKLGVHDVEHVGGKNASLGEMISNLAGAGVSVPGGFATTAQAYRDFLEQSGLNDRIHAALDALDVDDVNALAKTGAQIRQWVMEAEFPARLDSEIRQAFAALANGNDNLAVAVRSSATAEDLPDASFAGQQETFLNIRGVDNVIRAAKEVFASLFNDRAIAYRVHQGFDHKLVALSAGVQRMVRSETGTAGVMFTLDTESGFRDVVFITGAYGLGETVVQGAVNPDEFYVHKPTLEAGRPAILRRNLGSKAIKMIYGDEAKAGRSVKVVDVDRADRARFALSDAEVTELAKQAMIIEKHYGRPMDIEWAKDGDDGKLYIVQARPETVKSRASATVMERYLLKEKGTVLVEGRAIGQRIGAGPVKVINDVSEMDKVQPGDVLVSDMTDPDWEPVMKRASAIVTNRGGRTCHAAIIARELGIPAVVGCGNATQILQDGQGVTVSCAEGDTGFIFEGELGFDVRKNSVDAMPDLPFKIMMNVGNPDRAFDFAQLPNEGVGLARLEFIINRMIGVHPKALLNFAGLPADIKESVEKRIAGYPDPVGFYVEKLVEGISTLAAAFWPKKVIVRLSDFKSNEYANLIGGKLYEPEEENPMLGFRGASRYISESFRDCFELECRALKKVRNEMGLTNVEIMVPFVRTLGEASQVVELLAGNGLKRGENGLKVIMMCELPSNALLADEFLEFFDGFSIGSNDLTQLTLGLDRDSGIVAHLFDERNPAVKKLLANAIAACNKAGKYIGICGQGPSDHPDLARWLMEQGIESVSLNPDSVLDTWFFLAEGQDQA

SEQ ID NO: 10029 - protein, 403 aa, Pseudomonas aeruginosa PAO1
MNNSFWKAGHAPTLFAAFLYFDLSFMVWYVLGPLGVQIAGDLQLSTQQRAMMVATPILAGAVLRFLLGLLADRWSPKSAGILAQVIVIAALAAAWLLGVNSYAQALLLGLFLGFAGASFAVALPLASQWYPPQHQGKAMGIAGAGNSGTVLAALFAPGLAAAFGWNNVFGFALLPLVLTLLVFAMVARNAPQRPAPKAMGDYLKALGDRDSWWFMFFYSVTFGGFLGLASTLPGYFHDQYGLNPVTAGYYTAACVFAGSLMRPLGGALADRIGGIRSLLMVYTLAAICIAAVGFHLPSAMAALGLFVVAMLSLGAGNGAVFQLVPQRFHKEIGVMTGLIGMAGGIGGFCLTAGLGAIKQSTGDYQLGLWLFASLGVLAWFGLHGVKRRWRTTWGSAAVTAARV

SEQ ID NO: 10030 - protein, 253 aa, Pseudomonas aeruginosa PAO1
MHTHSPIPRTALVTGGSSGIGLAIARRLRQQGYRIALVARDSQRLQRAAAELGGVPWMAADLSRREAVEAVAAWVGDTFQGLDVLVNNAGFTRKIAATTPLAEAEREWDALLDGNLKSAFLMSLAVLPHFAEEGGRIIHIGSIAAQTGSGSPGALGYAAAKAGLHGFGVALARELGSRGITVNSVAPGYIADTRFFPGGLDPQRVAAIVGETPLGRTGRVEDIAAAVAWLASPEAGFVTGTVVSVNGGWRVGN

SEQ ID NO: 10031 - protein, 255 aa, Pseudomonas aeruginosa PAO1
MSKTHLFDLDGKIAFVSGASRGIGEAIAKLLAQQGAHVIVSSRKIDGCQAVADAITAEGGKATAIACHIGEMEQIQNVFAQIREQFGRLDILVNNAATNPQFCNVLETDLGAFQKTVDVNIRGYYFMSIEGGKLMKEHGGGSIINVASINGVSPGEFQGIYSVTKAAVISMTKVFAKECAQFGIRCNALLPGLTDTKFASALVKNDAIRNLALQRIPLKRVAEPSEMAGAVLYLASEASSYTTGVALNVDGGFLS

SEQ ID NO: 10032 - protein, 1234 aa, Pseudomonas aeruginosa PAO1
MSSPLTDRSARLQALQHALRERILILDGGMGTMIQSYKLEEADYRGERFADWPSDVKGNNDLLLLSRPDVIQAIEKAYLDAGADILETNTFNATQVSQADYGMQSLAYELNVEGARLARQVADAKTAETPDKPRFVAGVLGPTSRTCSISPDVNNPGYRNVTFDELVENYVEATRGLIEGGADLILIETIFDTLNAKAAIFAVQGVFEELGVELPIMISGTITDASGRTLSGQTTEAFWNSVRHARPISVGLNCALGAKELRPYIEELSTKADTHVSAHPNAGLPNAFGEYDESPAEMAVVVEEFAAAGFLNIVGGCCGTTPAHIEAIAKAVAKYPPRAIPEIPRACRLSGLEPFTIDRSSLFVNVGERTNITGSAKFARLIREENYAEALEVAQQQVEAGAQVIDINMDEGMLDSKAAMVTFLNLIASEPDISRVPIMIDSSKWEVIEAGLKCIQGKGIVNSISMKEGVEAFKHHARLCKRYGAAVVVMAFDEDGQADTQARKEEICKRSYDILVDEVGFPPEDIIFDANIFAIATGIEEHNNYAVDFINACAYIRDNLPYALSSGGVSNVSFSFRGNNPVREAIHSVFLYYAIRNGLTMGIVNAGQLEIYDEIPKALRDRVEDVVLNRTPEATEALLAIADDYKGGGAVKEAEDEEWRSYSVEKRLEHALVKGITTWIVEDTEECRQQCARPIEVIEGPLMSGMNVVGDLFGAGKMFLPQVVKSARVMKQAVAHLIPFIEAEKGDKPEAKGKILMATVKGDVHDIGKNIVGVVLGCNGYDVVDLGVMVPAEKILQTAIAEKCDIIGLSGLITPSLDEMVHVAKEMQRQNFQLPLMIGGATTSKAHTAVKIDPQYSNDAVVYVTDASRAVGVATSLLSKELKADYVARTRADYAVVRERTANRSARTERLSYEQAIANKPAFDWAGYQAPTPSFTGVRVLDEIDLAVLAEYIDWTPFFISWDLAGKYPRILTDEVVGEAATSLFNDAQAMLKKLIDEKLIKARAVFGFWPANQVEHDDLEVYGADGETLATLHHLRQQTIKPDGKPNLSLADFVAPKESGVRDYIGGFITTAGIGAEEVAKAYEAKGDDYNSIMVKALADRLAEACAEWLHERVRKEYWGYARDEHLDNEALIKEQYVGIRPAPGYPACPDHTEKGTLFELLDPQGLSGVSLTEHYAMFPAAAVSGWYFAHPQAQYFAVGKIDKDQVERYSQRKGQEASVSERWLAPNLGYDD

SEQ ID NO: 10033 - protein, 506 aa, Pseudomonas aeruginosa PAO1
MIYAAPGTPGAVVTFKPRYGNYIGGEFVPPVKGQYFTNTSPVNGQPIAEFPRSTAEDIDKALDAAHAAAEAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAELLAGGSVEKLEGNLASGYYIQPTLLKGHNGMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDINPLGFF

SEQ ID NO: 10034 - protein, 256 aa, Pseudomonas aeruginosa PAO1
MTLKGKTALVTGSTSGIGLGIALSLAEAGADLLLNGFGEVDAALAQVRARGVRAEHHPADLSSPEQIGELMAFAERTFGGVDILVNNAGIQYVAPVQEFPTERWDAIIAINLSSVFHTTRLALPGMLARGWGRIVNIASTHGLVASAGKSAYVAAKHGVLGLTKSVALETARTPVTCNAICPGWVLTPLVQKQIDARTAEGVSPEQAEHDLLAEKQPSLAFVTPEQLGGLTLFLCSEAADQVRGAAWNMDGGWVAQ

SEQ ID NO: 10035 - protein, 632 aa, Pseudomonas aeruginosa PAO1
MHRTSRRTFVKGLAATGLLGGLGLWRAPAWALAGPGQQNLLAGDSFDLFIGETPVNLSGSPAAAMTINGSLPGPTLRWREGDNVTLRVRNRLAEDTSIHWHGIILPANMDGVPGLSFEGIAPGGLYEYRFKVRQNGTYWYHSHSGLQEQAGVYGALVIDAREPEPFSYDRDYVVLLSDWSDEKPQRILAKLKKQSDYYNFHKRTVGDFIDDVSANGWAATLADRKMWAEMKMSPTDLADVSGYTYTYLLNGQPPDGNWTGLFRPGEKLRLRFVNASAMSYFDVRIPGLKMTVVAADGQHVEPVSVDELRIAVAETYDVIVEPGGERAYTLFAQSMDRSGYARGTLALAEGLSAPVPTPDPRPLIGMDDMGMGGMDHGAMGHGAATRPASEMDHSKMSGMDVNGMDHSKMAGMDMSGMDHSKMAGMDMNGMDHSKMAGMDMNGMDHSRMGMGAMPMQSHPASEDGNPLVDMQTMTPTPKLADPGLGLRDNGRRVLTYADLRSRFADPDGREPGRTIELHLTGHMEKFAWSFDGIKFSDAEPLRLTYGERLRIVLVNDTMMTHPIHLHGMWSDLEDEQGNFLVRKHTIDMPPGTRRSYRVTADALGRWAYHCHLLFHMEMGMFREVRVDEGDNA

SEQ ID NO: 10036 - protein, 222 aa, Pseudomonas aeruginosa PAO1
MDGVLISSREAIAAAWSRVAGEQGVALGPDCLRDHVHGRPGGYTLDYLFGHLPMERRRILKQRVDALEEGADCPLLPGVAAVIRQLRWLDVPLALVTSSWPARIDHVLRQHDLQAAFRTLVSRDDVVHGKPAPDGYRLAAARLGVAPSRCLVFEDSLSGVQAACAAGATCVAIGEESGLLAAGARWSVRDFRELRIVREDDRLYCQHRHPATTGSERSVGVP

SEQ ID NO: 10037 - protein, 231 aa, Pseudomonas aeruginosa PAO1
MRAALMECCSPQLVERIVAHSMFEEARRWCEEDLQAFASKDPAAQGRTSDIAFGYSSFKAVLHYRLSHMLCLRSTSEGDPERALEATALLVSSRGKLLSGAEIHPRCKIGSRFILDHGHGTVIGETAVIGDDCYILGGVVLGATGISANPAGKRHPTIGSRVQIGAFTRVLGDIAIGDDVFVGPHCVIKDDIPVGSVVTLRSELQVIRGPHIVQQLQPAATQTQIQPMEAS

SEQ ID NO: 10038 - protein, 482 aa, Pseudomonas aeruginosa PAO1
MNGHARHWIDGAWLDSAQRGQSFDPASGQPIGTYADGGRAEADAAIAAAVRAFEDGPWKDDHALRAKALEEIAAAFERHADALIDLLALENGKIKPEAAFEVGMVPGKLRYYAGLARSERGASGTPRPDVVSLVLREPMGVAGIIVPWNSPVVLMIRSLAPALAAGTTTVVKMPGQTAQTNAMVARIIAEAPSLPAGAVNIFSESGSEGARRLIDAAEVPVISFTGSSATGRAISAAGARHLKRFGLELGGKTPHLVFDDADLDAALPVLEKSLTVFAGQFCMTGSRLLVQRGVAERLRERLAQRLENLRVGPAADPRSDMGPLIDKANVERVERAVRQAIAAGARVVVRGGPVTEGELAAGAFYRPTLLEVDDPDLDIVQQETFGPVLTLQVFEHEEEGVALANRSEYGLAAGVWTRDVARAFRVARKIRAGTVWINDWAKVYDEFEEGGYRQSGLGRLNGVAALDDFVEYKHISLTTGAA

SEQ ID NO: 10039 - protein, 286 aa, Pseudomonas aeruginosa PAO1
MSEQRQTLPAQHQDQRPGHESQMQPKPEFVSADYRPAAKLEGKVALVTGGDSGIGRAVAVAFAREKADVVLVYLDENEDAAKTREIIESLGRQCLAFAGDVADAGFCRQVVDTLRQKWGRLDVLVNNAGEQHPQARLEDISEEQWEKTFRTNIFGMFQLTKAALPLMGKGGAIINTTSITAYKGNPQLIDYSSTKGAITSFTRSLSMNLVNRGIRVNAVAPGPIWTPLIPSTFSAEKVAHFGADTPMGRPGQPEELAASYVYLACNDSSYVSGQVLHVNGGTVVNG

SEQ ID NO: 10040 - protein, 286 aa, Pseudomonas aeruginosa PAO1
MKKVLGIYGNANRHWVGDGFPVRSLFSYNTLGQHISPFLLLDYAGPADFPPAQQRRGVGQHPHRGFETVTIVYQGEVEHHDSTGAGGRIGPGDVQWMTAASGILHEEYHSERFRSTGGTLEMVQLWVNLPSSDKMNPPRYQTLLDADIPRVGLPDRAGELRVIAGRYGRHQGPALTHSPLAVWDVQLKAGKHLALDLPKGHTCAVVVLRGTLAVGDEIVREAQVALLDRDDPRLELEANNDVQLLVLSGEPLDEPIIGYGPFVMSSREEIDQAIEDFENGRFIRAH

SEQ ID NO: 10041 - protein, 253 aa, Pseudomonas aeruginosa PAO1
MNDRFRDKVALVSGAAQGIGLGVARRLLEEGARVVAVDRSELVHELAGDACLCLTADLERYAECQRVLERTLERFGRLDILVNNVGGTLWAKPYQHYAEDEIEAELRRSLLPTLWCCRAALPAMLGQGSGAIVNVSSVATRGVNRVPYGAAKGGVNALTACLAFETADQGIRVNAVAPGGTDAPPRRIPRNAAAQSEEERRWYRQIVEQTLDSSLMKRYGSIDEQVAAILFLASDEASYITGVTLPVAGGDLG

SEQ ID NO: 10042 - protein, 393 aa, Pseudomonas aeruginosa PAO1
MLSNAQRALIKATVPLLETGGEALITHFYRTMLGEYPEVRPLFNQAHQASGDQPRALANGVLMYARHIDQLQELGPLVAKVVNKHVSLQVLPEHYPIVGTCLLRAIREVLGEQIATDEVLEAWGAAYQQLADLLIEAEESVYAASAQADGGWRGVRRFRVARKQAESEEITSFYLEPVDGQPLLAFQPGQYIGLRLDIDGEEVRRNYSLSAASNGREYRISVKREAGGRVSNYLHDRVAEGDELDLFPPAGDFVLRDSDKPLVLITAGVGITPALAMLQEALPQARPIRFIHCARHGGVHAFRDWIEDVSAQHEQVEHFFCYSEPRAGDSADAEGLLSREKLADWLPQERDLDAYFLGPRPFMAQVKRHLADLGVPSQQCHYEFFGPAAALDA

SEQ ID NO: 10043 - protein, 786 aa, Pseudomonas aeruginosa PAO1
MLGGRTSPRLIPAPMDIALTHRLSFKQASLTVLVAFILGTLLSLIQVGVDYASQDASINREVRALLDVSHNPAARIAYNIDAELAQELVLGLLRSPAVVRAEIIDTSGLPLASASREPAESRLRPLSDFLFGHKRVYEDPLHVDHAPGEALGVLHLEIDTFVFGNDFLRRAGITLLSGFVRSLLLSLILLVLFYTLLTKPLVSLIQALSGHDPRSPARMRLPCPKGHERDEIGVLVEVINRQLGRISVEIEQRREAENRLTQYLEELESIVAARTAELKAANARLTLSNQELEEARQTALDMAQARASFLANMSHEIRTPLNGLLGMLSLSLDGPLTPEQRQQLSIAHDSGKVLVELLNDVLDLSKFEAGQLVLEQIPFDLGVLVEDTASLLSQNAAAGVELTCLVDPALPAQVSGDPTRIRQIVSNLLSNALKFTRLGRVDVRVEATAEGVRISVRDTGIGIAQEALDRIFQPFTQADAGITRQYGGTGLGLALTRKLCEAMQGELTVESTVGLGSLFSVGLPLAPVSPPLQALPLRGRVIAQCSANSGLAQLLQTWLPRWGLEYKRLETDDSLLGHSLDVLISDCPDCLMGLRPSIGTPILLVTAYGSFLEPELARRLSPLRQLARPLSRNQLYQALKHVLEHTAIAPSSASDTTGEQRNTRVLLVEDNPVNQLVAKGLLHKLGCQVWIAEHGLNALKMLEEHPIDLVLMDCNMPVMDGYEATRQIRDSGRWGGLPIIALTANALPDERERCRAAGMDDYLAKPFHRDELKAILDRWCPLTASD

SEQ ID NO: 10044 - protein, 292 aa, Pseudomonas aeruginosa PAO1
MSYDSIFRPGLFDGQTIIVTGGGSGIGRCTAHELAALGAHVVLVGRKAEKLEKTAGEIVEDGGSVSWHACDIREEEAVKTLVANILAERGTIHHLVNNAGGQYPSPLASISQKGFETVLRTNLVGGFLVAREVFNQSMSKTGGSIVNMLADMWGGMPGMGHSGAARSGMENFTRTAAVEWGHAGVRVNAVAPGWIASSGMDTYEGAFKAVIPTLREHVPLKRIGSESEVAAAIVFLLSPGAAFVSGNTIRIDGAASQGSRAFPLFKGKPGQSRAYNGFHRAYLPDVLKDQED

SEQ ID NO: 10045 - protein, 247 aa, Pseudomonas aeruginosa PAO1
MSLQGKVALVTGASRGIGQAIALELGRLGAVVIGTATSASGAEKIAETLKANGVEGAGLVLDVSSDESVAATLEHIQQHLGQPLIVVNNAGITRDNLLVRMKDDEWFDVVNTNLNSLYRLSKAVLRGMTKARWGRIINIGSVVGAMGNAGQTNYAAAKAGLEGFTRALAREVGSRAITVNAVAPGFIDTDMTRELPEAQREALLGQIPLGRLGQAEEIAKVVGFLASDGAAYVTGATVPVNGGMYMS

SEQ ID NO: 10046 - protein, 288 aa, Pseudomonas aeruginosa PAO1
MPFLYRLASLLIALLVLPVQAAEMRVALLRTSGVETLDALTVDGGSWVRRVPLSHTAVLIEHHAATLLFDTGLGRDIDAQFRADMPWWAAPLFAYQKVVPARDQLDAAGIRVDRILLSHAHWDHASGLVDFPEVPVWAPYEEIAFSRIATPPAAFPSQFRHGVRWQPYSFDPRPFMGFDESLDLFGDGRLVLVPLPGHTPGSVGLFVTLDSGRRLFFSGDTSWRLEGVEGPRQKFFAGRALVDRDPARTLAQLAKIRLLLRSDPRLSVIPAHDARVQAALGYFPHWLE

SEQ ID NO: 10047 - protein, 285 aa, Pseudomonas aeruginosa PAO1
MTRYRDVLELHTGHPASDGAGVRLTRVIGGPSPERFDPFLMLDQFDTQNPDDYVAGFPSHPHRGFETVTYMLEGRMRHEDHLGNRGLLKPGGVQWMTAAHGIIHSEMPEQVEGAMRGFQLWVNLPAKNKLAPAGYRDIEPEDVPRLETAGGVKVTVIAGRFDDGQAQQIGAVERPDTEPHYYDLQLPAGGRIAPRLPDGHRVLLYVYEGSLTVEGERPVEIATNRLARLSEEGELSLRSEAGARVLVLAGKPLHEPIVQYGPFVMNSREEIEQALRDYRDGVLAV

SEQ ID NO: 10048 - protein, 292 aa, Pseudomonas aeruginosa PAO1
MRTPAWLGSGMPLLFVLLWSTGFLGAKFGLPYAEPFTFLAIRLLLAAALLAAFALLSGAPWPGSARLAGHVAVAGLLVHGLYLGGVFLAIEHGMSAGLTSLLVGLQPLATAALAGIWLGEQVSRRQWLGLALGLAGVALVVLGRIHGGADGLAWAAVLVALAAITCGTLYQKRFCGGMDLRTGGVVQYLASGALLGLAALLFESREVQWSTPFVLTLGWLVLGLSFGAVGLLYTLIRHGAASKVASLFYLVPPVTALASWLLFDERLAPAAIGGMLLVMLGVALVNWPGRRA

SEQ ID NO: 10049 - protein, 256 aa, Pseudomonas aeruginosa PAO1
MHPYFSLAGRIALVTGGSRGIGQMIAQGLLEAGARVFICARDAEACADTATRLSAYGDCQAIPADLSSEAGARRLAQALGELSARLDILVNNAGTSWGAALESYPVSGWEKVMQLNVTSVFSCIQQLLPLLRRSASAENPARVINIGSVAGISAMGEQAYAYGPSKAALHQLSRMLAKELVGEHINVNVIAPGRFPSRMTRHIANDPQALEADSASIPMGRWGRPEEMAALAISLAGTAGAYMTGNVIPIDGGFHL

SEQ ID NO: 10050 - protein, 919 aa, Pseudomonas aeruginosa PAO1
MSRLCLVLLLLCCALPARAQPPAPLDGEDLRLSLGAYAEYYRDAGGKARLGDILALPAQAFAALRGDHANFGKNAAAWWFRVRLDNRNGADLAGFLEVNYPLLDDLKVYLLTADGRIEQQESGDLFAFSQRPVQVRNFWFPLRLPPGESTLLLRVQSTSTVYLPLYFSTYAASAASQETLMGFNGAFYGVLFGLFCYNLFLFVSLREATYAWYLLYNLSLGLFSASFDGLLFKLLPGHVALESAGIYLLMYLSCLVSIQFSRGYLYTRRDFPRLDRFLRGLLLACVVLLASEPLVGLRAWNVLASLTVMLVSLSLLLAGVHVWRQGLRYGLYYILAWGALLLSFLVTTAASLGFELFGLFGSSVVKIGMTVELVTLSIGLADRINALKEEGFRSRQAAEQARVENEAKSRFLAKMSHEIRTPLNGVLGMLQLLRDTPLDRGQAAYVETIASSGSALMSVINDILDYARIESGKLHLERIDFDLEELLSDTLALFSAQAVEKRLHLHLGLDRGVPRRLNGDPTRLRQVLMNLLSNALKFTAEGHVAVRVQRRFDEGGRERLLYSVSDSGIGISAQAQKTLFESFSQADSSTTRRYGGSGLGLAISRELVQMMGGRIEVSSEPGKGTRFSVDLPLSPALDAGEADELAQLLQHRPALLASEDNLTLDCLQALLERWGLRVERCLQPRRLNAYLEDFSAPPLLVLAAPWPGPPSIWLDTLYAQLEQGQRILLLCPPQHCQDLPPHEGLRLLALAQPVAVKALREALLELYRERRRQPGRSSEAAPDERPPDAPCILVAEDNPVNQLVVRGFLAKRGYAVRLAGNGRLALDEYLRDPNGIQLILMDGEMPEMDGFEATRLIRREERAQGWPRVPIVALTAHILDEHRRAGIEAGMDAYLGKPVDRAELYATLERLLGQPSRQA

SEQ ID NO: 10051 - protein, 364 aa, Pseudomonas aeruginosa PAO1
MSAITRQTVEATLRQYQDPYLNQDPVSAGCLREVEIQGDRVRVRLELGYAAGLFRNGLAQTLQMALEALDGVARAEVRVDCVIQPHKAQPQVEVMGNVKNIVAVASGKGGVGKSTTAANLALALAREGARVGILDADIYGPSQGIMFGLPEGTRPKVREQKWFEPLEAHGVQVMSMAFLTDDSTPVVWRGPMVSGALIQLITQTAWDNLDYLVVDMPPGTGDIQLTLAQKVPVAGAVIVTTPQDLALLDAKKGVEMFRKVNIPVLGVVENMAVHICSNCGHAEHLFGEGGGEKLAAQFGVELLASMPLSIAIRTQADSGRPTVIADPESQLAMLYQEIARHVGARIVLSERASVGLPNISISDD

SEQ ID NO: 10052 - protein, 339 aa, Pseudomonas aeruginosa PAO1
MSTVDPVEQLLANGLKNLWYPICPVGFIEDKPVSLRRLGYKLAVWRDTDGTLHALEDHCPHRGAPLSRGVNLGDRLQCPYHGVEVRCDGVTARVPGSPGCKLEGSQATRFFHITEAAGAVWLYNSAGNVEEAPPLVLPEQLTDPEFSHFLCYTEWRGDYRYVLDNVMDPMHGTYLHKQSHSMSEGESQARFVTRDTDTGFIFEKDGQRGVNFDWTEWADTGMHWMRLEIPYPKTGGPGGNFHIVGSYTPIARDLCAVFHWRCRPLTGWQRDTWRFLYRNRLEARHWAVLEQDREMLEFMEPDANQRENLYQHDLGLVRLRRHLKNLAKAQLELIEARQL

SEQ ID NO: 10053 - protein, 494 aa, Pseudomonas aeruginosa PAO1
MIDLNPIQPICIAGEWRAGGGDLYESLYPATGEAVARLHAASLEDVEEAMAGAHRAFRESGWAQRKPHERATVLYRIAALIRERSEELAQLQRLDNGKPIRETRNLVASAAATFQFFAAACETLEESITPSRGDFVSMSVYEPMGVVVAITPWNSPIASEAQKLAPALAAGNAVVVKPAEITPLAALALARICDEAGLPRGLVSVLPGKGALIGDALTRHPLARRVSFTGGTRTGKHIARIAADKMMPVSLELGGKSPTMVLADADLDHAVAGVLYGIFSSSGESCIAGSRLFVASERYDEFMERLATGAAALRVGDPADERTQMGPLISARHRESVERYVEMGVAEGGRLRTGGLRPHGGAFDRGYFYTPTIIEGLTNGARLCREEVFGPVLVAMPFASEEALIEEANDSCYALAAGIWTRDFQRAWRLGRAVQAGTVWINTYKQFSISTPFGGWRDSGLGREKGRLGILQYMEQKSLYWGLNEQPLAWAGSH

SEQ ID NO: 10054 - protein, 265 aa, Pseudomonas aeruginosa PAO1
MKPYDLSEAVAVVTGGSSGIGLATVELLLEAGAAVAFCARDGERLRAAESALRQRFPGARLFASVCDVLDALQVRAFAEACERTLGCASILVNNAGQGRVSTFAETTDEAWSEELQLKFFSVIHPVRAFLPQLESRADAAIVCVNSLLASQPEPHMVATSAARAGVKNLVRSMAFEFAPKGVRVNGILIGLVESGQWRRRFEAREERELDWAQWTAQLARNKQIPLGRLGKPIEAARAILFLASPLSAYTTGSHIDVSGGLSRHA

SEQ ID NO: 10055 - protein, 956 aa, Pseudomonas aeruginosa PAO1
MLELDTRQIRMGQRAADKAEALRLLGAALVADGLAAPGYAEGLKAREAQGSTYLGQGIAIPHGTPDTRELVFSTGVRLLQFPEGVDWGDGQQVYLAIGIAAKSDEHLQLLQLLTRALGEADLGPALSAAASAEEVLGLLQGAPQELALDAQLVGLGQNAEDLDELAWLGARLLKKAGCVENGFAAVLQQTEPLPLGDGLCWLHSEQLVKRPGLAFVTPAQPLQHQGQLVTGLFCLASLGEAHQALLERLCDLLLEGRGAELVRATSSRSVLAALGGELPPDWPSARAVLANPHGLHARPAQALAQLAKGFAGEIRVRLADSEAAPVSAKSLSKLLALGARRGQTLEFSAEPAIAEDALPALLAAVREGLGEEVEALAEEALPDAVGEAEEDARPAPLRAGERLQAIAASPGIASGPAHVQVAQRFEFQPRGESPAHERERLLRAKRAVDEEIVGLVERSTVKAIREIFVTHREMLDDPELAEQVQLRLNRGESAEAAWSRVVEDSAAQQEALHDALLAERAADLRDLGRRVLARLCGVEAPREPEQPYILVMDEVGPSDVARLDAQRVAGILTARGGATSHSAIIARALGIPALVGAGAAVLGLEPGTALLLDGEHGWLQVAPSTEQLQQAAAERDARQQRQARADAQRLEPARTRDGHAVEVCANLGDTAGAARAVELGAEGVGLLRTEFVFMNNARAPDLATQEAEYRRVLDALDGRPLVARTLDVGGDKPLPYWPIPHEENPYLGLRGIRLTLQRPQILETQLRALFRAAGERPLRVMFPMVGSLDEWRQARDLALRLREEIPLADLQLGIMVEVPSAALLAPVLAREVDFFSVGTNDLTQYTLAIDRGHPSLSAQADGLHPAVLQLIDMTVRAAHAEGKWVGVCGELAADPLALPLLVGLGVDELSVSARSIALVKAGVRELQLVAARGLARKALGLASAAEVRALVEAEVQ

SEQ ID NO: 10056 - protein, 308 aa, Pseudomonas aeruginosa PAO1
MADPPRPVERAMRSQALRADVLMLITAMIWGVSFVAQRLGMDAIGPFLYTGLRFVLGALVLVPLLMLRSRRDGAQPFNRGQLLAGVILGVALTTGINLQQVGLLFTSVTNSGFITGLYVIVVPLLGLLFGQRTGAGTWLGASLAVLGMALLSIGPGFQVASGDWLQLAGAVVWGAHVLLVGLFASRYDPIRLAFLQFATCAAVSLLLALVFEEIHWDAIVQAGPALLYGGLLGVGTGFTLQVVAQKHAIASHAAIILSLEAVFAAIAGALFLAETLHLRGYFGCALMLAGMLVAQLWPRKLAAEARPA

SEQ ID NO: 10057 - protein, 334 aa, Pseudomonas aeruginosa PAO1
MALKKEGPEFDHDDEVLLLEPGIMLDESSADEQPSPRATPKATTSFSSKQHKHIDYTRALDATQLYLNEIGFSPLLTPEEEVHFARLAQKGDPAGRKRMIESNLRLVVKIARRYVNRGLSLLDLIEEGNLGLIRAVEKFDPERGFRFSTYATWWIRQTIERAIMNQTRTIRLPIHVVKELNVYLRAARELTHKLDHEPSPEEIANLLEKPVAEVKRMLGLNERVTSVDVSLGPDSDKTLLDTLTDDRPTDPCELLQDDDLSESIDQWLTELTDKQREVVIRRFGLRGHESSTLEEVGQEIGLTRERVRQIQVEALKRLREILEKNGLSSDALFQ

SEQ ID NO: 10058 - protein, 370 aa, Pseudomonas aeruginosa PAO1
MIKSRAAVAFAPNKPLEIVEVDVAPPQKGEVLVRIVATGVCHTDAYTLSGQDSEGVFPCILGHEGGGIVEAVGEGVTSLQVGDHVIPLYTAECGKCKFCLSGKTNLCQAVRATQGKGLMPDGTSRFSYKGEPVFHYMGCSTFSEYTVLPEISLAKIPKDAPLEKVCLLGCGVTTGIGAVLNTAKVEEGATVAIFGLGGIGLAAIIGAKMAKAARIIAVDINPGKFDIARELGATDFINPKDYDKPIQDVIVELTDGGVDYSFECVGNVQLMRAALECCHKGWGESVIIGVAGAGQEISTRPFQLVTGRVWRGSAFGGVRGRSELPSYVEKAQKGEIPLDTFITHTMGLEDINEAFELMHEGKSIRTVIHY

SEQ ID NO: 10059 - protein, 429 aa, Pseudomonas aeruginosa PAO1
MAKIVDIKGREVLDSRGNPTVEADVILDNGIVGSACAPSGASTGSREALELRDGDKSRYLGKGVLKAVANINGPIRDLLLGKDAADQKALDHAMIELDGTENKAKLGANAILAVSLAAAKAAAQAKGVPLYAHIADLNGTPGQYSMPVPMMNIINGGEHADNNVDIQEFMVQPVGAKNFAEALRMGAEIFHHLKAVLKARGLNTAVGDEGGFAPNLSSNEDALAAIAEAVEKAGYKLGDDVTLALDCASSEFFKDGKYDLEGEGKVFDAAGFADYLAGLTQRYPIISIEDGMDESDWAGWKGLTDKIGAKVQLVGDDLFVTNTKILKEGIEKGIGNSILIKFNQIGSLTETLEAIQMAKAAGYTAVISHRSGETEDSTIADLAVGTAAGQIKTGSLCRSDRVSKYNQLLRIEEQLGAKAPYRGRAEFRG

SEQ ID NO: 10060 - protein, 396 aa, Pseudomonas aeruginosa PAO1
MSRPQRISVLGATGSIGLSTLDVVQRHPDRYEAFALTGFSRLAELEALCLRHRPVYAVVPEQAAAIALQGSLAAAGIRTRVLFGEQALCEVASAPEVDMVMAAIVGAAGLPSTLAAVEAGKRVLLANKEALVMSGALFMQAVKRSGAVLLPIDSEHNAIFQSLPRNYADGLERVGVRRILLTASGGPFRETPLEQLASVTPEQACAHPNWSMGRKISVDSASMMNKGLELIEACWLFDAQPSQVEVVIHPQSVIHSMVDYVDGSVIAQLGNPDMRTPISYAMAWPERIDSGVSPLDMFAVGRLDFQRPDEQRFPCLRLASQAAETGGSAPAMLNAANEVAVAAFLERHIRFSDIAVIIEDVLNREAVTAVESLDQVLAADRRARSVAGQWLTRHAG

SEQ ID NO: 10061 - protein, 581 aa, Pseudomonas aeruginosa PAO1
MSDSCLPIAMVQSAQSHRPGTKPEIPALMQTVYTVLTLLLVVGATRLAAQLLPLPLPLIQIAAGALLALPSLGLHIALDPELFLFLFIPPLLFVDGWRIPKREVWRMRWPILMMAFGLVFFTVVGAGYFIHLLIPEIPLAASFALAAVLSPTDALAVSAITQGRLPKRLMHLLEGEALMNDASGLVAFKFAIAAAMTGVFSLVDASLNFLVVAVGGLAIGVFLSWSLGRIRAWMISRGWDDPATHVVLMLLLPFASYMVAEHLGVSGILSAVAAGMMQSWVDLLPRQTSTRLLNRSVWSMLEFAFNGVVFLLLGLQLPDIMKSVANHHGDLLWRSSLLLAYVAAITAVLMLIRYGWVYGYWKLSLRIDRWRGKSPPGLSGISLRRLSALSALSGVRGAVTLAAVLSVPMSLMDGSAFPQRDLIIFIATSVILISLIGATIGLPLLLRGLPASNNGAHERERREAWRKTAEAAIRALESEELPQVEGNDAANTSRVAEARAQIMAEYRQSLDTAPTTDEARDQAQALEIADKALRLKALRAQRLELYRQRRNNEIDDETLGDILRELDQQESWLTNRFARWV

SEQ ID NO: 10062 - protein, 463 aa, Pseudomonas aeruginosa PAO1
MTFTRRQVLGGLAGLAVVGLGAGGARLWLARPQVAQEYDYELIAAPLDLEIVPGFSSPALAYGGQCPGVELRAKQGEWLRVRFTNRLDEPTTIHWHGIRLPIEMDGVPYISQPPVQPGESFIYQFKTQDAGSYWYHPHLMSSEQLGRGLVGPLIIEEREPTGFRHEKVLCLKTWHVDEQGAFTPFSVPRQAAREGTRGRYSTINGKHVPTIDLPAGQIVRVRLLNVDNTVTYRLNLPNGEARIYAIDGHPVEPRGFEGQYWIGPGMRLELALKVPEAGTELSLRDGPVRLATIRSVASAEAPAGDWPKPLPANPVSEPDLANAEKIGFRFEWVGAMSDTSGKNPYPSFWQINGKAWEGGEEHKHNAPPLAKLKEGQSYIFELRNMAQYQHPIHLHGMAFKVLDSDRRDIIPYFTDTYLLGKNETARVALVADNPGLWMFHCHVIDHMETGLMGTIAVGEAWCG

SEQ ID NO: 10063 - protein, 489 aa, Pseudomonas aeruginosa PAO1
MLRISQEALTFDDVLLIPGYSEVLPKDVSLKTRLTRGIELNIPLVSAAMDTVTEARLAIAMAQEGGIGIIHKNMGIEQQAAEVRKVKKHETAIVRDPVTVTPSTKIIELLQMAREYGFSGFPVVEQGELVGIVTGRDLRVKPNAGDTVAAIMTPKDKLVTAREGTPLEEMKAKLYENRIEKMLVVDENFYLRGLVTFRDIEKAKTYPLASKDEQGRLRVGAAVGTGADTGERVAALVAAGVDVVVVDTAHGHSKGVIERVRWVKQTFPDVQVIGGNIATAEAAKALAEAGADAVKVGIGPGSICTTRIVAGVGVPQISAIANVAAALEGTGVPLIADGGIRFSGDLAKAMVAGAYCVMMGSMFAGTEEAPGEIELFQGRSYKSYRGMGSLGAMSGSQGSSDRYFQDASAGAEKLVPEGIEGRVPYKGALSAIVHQLMGGLRAAMGYTGSADIQQMRTQPQFVRITGAGMAESHVHDVQITKEAPNYRVG

SEQ ID NO: 10064 - protein, 258 aa, Pseudomonas aeruginosa PAO1
MFERVREDIQSVFHRDPAARNALEVLTCYPGLHAVWLHRLAHGLWTSGWKWLARLVSNFGRWMTGIEIHPGARIGRRFFIDHGMGIVIGETAEIGDDVTLYQGVTLGGTTWNKGKRHPTLGNNVVVGAGAKVLGPFTVGEGAKVGSNAVVTKEVPPGATVVGIPGRIIMREDSEQQAKRQAMAEKLGFDAYGVSQDMPDPVARAIGQLLDHLQAVDGRLEGMCQALTALGSDYCAKDLPVLREEDFAGVKDEDGNPAA

SEQ ID NO: 10065 - protein, 431 aa, Pseudomonas aeruginosa PAO1
MASLRQKQYSVLGMSTLSFAVNFAVWTMFSIIGIRIKDELGLSESQFGLMVALPILTGSLVRLPLGLITDRFGGRIVFFIHMLLVAIPIYGLAFASQYWHYLVLGLFVGLAGGSFAVGIAYTSAWFEKERQGTAMGIFGAGNAGAAITNLVAPMIVVAFGWRMVPQVYSVAMLVTAVLFWLFTWTDPAHLKGAAEASQRPNLAKQLAPLAELRVWRFGLYYFFVFGGFVALALWLPKYYIAEYGLDLKTASFITMLFTLPSGLIRALGGWFSDHYGARSVNWGVFWVCLVCLFFLSYPQTTMTIHGIQGDLSLGIGLNVWLFTFLVFVVGIAQGFGKASVYRIIHDYYPSNMGTVGGMVGVIGGLGGFCLPILFGYAADHIGVRSSCFMLLFGLTVVCMVWMHYAIKQQRRIDGQAASADVDLPPTLPTHS

SEQ ID NO: 10066 - protein, 424 aa, Pseudomonas aeruginosa PAO1
MLDLVAAFIALTTLLTYVNYRFIRLPPTIGVMATALVFSLIVQGLSELGYPILEVEMQEIIRRIDFSEVLMTWFLPALLFAGALHVDLSDLRSYKWPIGLLATAGVLIATFVIGGLAYYTFPLFGWQVDFIYCLLFGALISPTDPIAVLGILKSAGAPKPLATTIVGESLFNDGTAVVVFAIILGILQLGEAPTVSATAILFVQEAIGGVVFGAVLGYGVFVMMRGIDQYQVEVMLTLALVIGGAALAARLHVSAPIAMVVAGLIIGNHGRHYAMSDETRRYVDKFWELIDEILNALLFALIGLELLLLPFSWLHVAAAFALGGAVLVSRLLTVGPAILVLRRFRGANRQVPAGTIRILVWGGLRGGVSVALALSLPLGPERDLILSLTYIVVLVSILLQGLSIGPLVRRIYAGQPLEKSEGAH

SEQ ID NO: 10067 - protein, 653 aa, Pseudomonas aeruginosa PAO1
MNPPVFYGAAILILLFAAVVIGFPQRAGEWLLAAQTWASQTVGWYYLLAMTLYLIFVVVTALSGYGKIKLGADHDEPEFSYLSWAGMLFAAGISITLFFFCVSEPLTHFLQPPQGEAGTQEAARQAMELLFLHWGLHGWGVFALVAMALAYFAYRHNLPLALRSALYPLIGKRINGPIGYTVDCFGIIATVFGLGADMGFGVLQLNSGLDYLYAIPHTHPVQMALIVLMMGAAISVAVSGVDKGIRILSDINMLLACSLLLFVLFAGPTQHLLNTLVQNVGDYLGHLPGKSFDLYAYGGPSDWLGSWTVFYWAWWIAWAPFVGLFIARISRGRTIREFVFGVLFIPLGFTLAWMSIFGNSALEQALGGASELGRVAIEQPSMALYQMLQNYPWSRAVITVTVLVSFVFFVTSADSGTVVLSTLSAHGGSADDDGPKWLRVFWGSVTALVTGGLLFAGSIDALKSAVVLTSLPFSLILLLMMWGLHKAFYMESQRQRARSHSLAPLMSGNGKRSGGWKRRLSQAVHFPSRDEVYRFMNDVVRPAISEVSEVFREKGLAVDAQLDPGNASLSLEIGHGEQHRFLYQVLMRGYFTPSFARAGMGGLHLKNRRYFRAEVHLAEGSQDYDLMGYTKEQIINDMLDQYERHLQFLHLVR

SEQ ID NO: 10068 - protein, 678 aa, Pseudomonas aeruginosa PAO1
MQERIPDELTLPELTLRGLILGALITVVFTASNVYLGLKVGLTFASSIPAAVISMAVLRYFSGANILENNMVQTQASAAGTLSSIIFILPGLLMIGYWSGFPFWQTAAICSIGGILGVLYTIPLRRVMVVQSELPYPEGVAAAEILRVGSDGAEDEEDARAPRAAGNAPGLYDILGGGLVAALFSLWSSGFKVLAEGFSVWLSAGQAAFRLSTGFSLALVGAGYLMGITAGIAILIGVVISWGVAVPLLTVNSVPADGQSLSDLATQLWSSQVRFLGAGTIGVAALWTLATLFKPMVRGVWASLGAVRGNSQANSLRTELDMPAKWILLIAGILLVSLFVVFSHFLGAAAPDMASPQFWSLVAVCVVFAFFFGFLIAAACGYMAGLVGSSSSPISGIGIIAVILVSLLILGFGSIEGGLLDRQNGKLAIALALFTTSVVLAIAAISNDNLQDLKTGYLVGATPWRQQVALIVGCIVGALVIPPVLELLYSAYGFTGALPREGMDPGQALAAPQATLMTAIASGIFHDALNWNMILIGVALGIALILVDLLLRRTGKACLPVLAVGLGIYLPPTIGMTLVVGALISWLLENALKKRAAAAGVDEEAYAEEPKRRGVLLASGLIVGESLMGILLAGVIGATGEDAPLALAGAGFAGIAQWLGLVVFVAICVLFYRRVLAR

SEQ ID NO: 10069 - protein, 506 aa, Pseudomonas aeruginosa PAO1
MRYAHPGSEGAIVSFKARYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAELLAGGSVEKLEGNLASGYYIQPTLLKGHNGMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDINPLGFF

SEQ ID NO: 10070 - protein, 627 aa, Pseudomonas aeruginosa PAO1
MPKTLHEIPRERPATPLLDRASSPAELRRLGEADLETLADELRQYLLYTVGQTGGHFGAGLGVVELTIALHYVFDTPDDRLVWDVGHQAYPHKILTERRELMGTLRQKNGLAAFPRRAESEYDTFGVGHSSTSISAALGMAIAARLQGKERKSVAVIGDGALTAGMAFEALNHASEVDADMLVILNDNDMSISHNVGGLSNYLAKILSSRTYSSMREGSKKVLSRLPGAWEIARRTEEYAKGMLVPGTLFEELGWNYIGPIDGHDLPTLVATLRNMRDMKGPQFLHVVTKKGKGFAPAELDPIGYHAITKLEAPGSAPKKTGGPKYSSVFGQWLCDMAAQDARLLGITPAMKEGSDLVAFSERYPERYFDVAIAEQHAVTLAAGMACEGMKPVVAIYSTFLQRAYDQLIHDVAVQHLDVLFAIDRAGLVGEDGPTHAGSFDISYLRCIPGMLVMTPSDEDELRKLLTTGYLFDGPAAVRYPRGSGPNHPIDPDLQPVEIGKGVVRRRGGRVALLVFGVQLAEAMKVAESLDATVVDMRFVKPLDEALVRELAGSHELLVTIEENAVMGGAGSAVGEFLASEGLEVPLLQLGLPDYYVEHAKPSEMLAECGLDAAGIEKAVRQRLDRQ

SEQ ID NO: 10071 - protein, 495 aa, Pseudomonas aeruginosa PAO1
MSIAIDPSVSAFLRSPHGLLIDGESGPARSGADMPLYDPATGAELARVARAGAEDVDRAVAAARRAFEGNWAGQRPADRERLLLRLAERIEAHGEQLAQLETLNNGKSINLSRALEVGASVEFIRYMAGWATKIEGRSLDLSIAAVPGARYRAYTVPEPVGVVGAIVPWNFPLLMAIWKIVPALACGCTVVLKPADETPLTALRLGQLCLEAGIPPGVVNIVTGTGAEAGAALAAHPGIDKLAFTGSTPVGKLIGHAAVENMTRFSLELGGKSPVIILDDTSLDMAAAGSAGAIFFNQGQVCTAGSRLYVQRKRFDQVLERLAAIAGDLSIGPGLDPTTQINPLVSARQQERVLGMIESGVAEGASVVCGGARQGETGFYVQPTILADVTPGMQVVREEIFGPVLVATPFDDLDEAVRLANDSIYGLGASIWSNDLRQVMDLVPRIKAGTVWVNAHNLLDPSMPFGGFKQSGIGREMGHAAIEAYTENKSVCIAY

SEQ ID NO: 10072 - protein, 253 aa, Pseudomonas aeruginosa PAO1
MRRLENRVALVTGAGQGIGRAIAECFAAEGARVLLATRTASRGQAVLEAIRLGGGTAELLAVDLSEYDAARRAVSATLERFGQLDILLHNAAAFPQCALAELDEGTLERTLAVNLKSCFRLTQAALPALRRSVAGRVLVTSSVTGPRTAIPGLSHYAASKAGVNGFIRAAALELAGDGITVNGVEPGLVATPALGSLGDAAALAAHIPLGRVGQPLDIAHAMLFLASDEASYITGQTLVVDGGALLPENGGLA

SEQ ID NO: 10073 - protein, 241 aa, Pseudomonas aeruginosa PAO1
MVFQHDIYAGQQVLVTGGSSGIGAAIAMQFAELGAEVVALGLDADGVHAPRHPRIRREELDITDSQRLQRLFEALPRLDVLVNNAGISRDREEYDLATFERVLRLNLSAAMLASQLARPLLAQRGGSILNIASMYSTFGSADRPAYSASKGAIVQLTRSLACEYAAERIRVNAIAPGWIDTPLGAGLKADVEATRRIMQRTPLARWGEAPEVASAAAFLCGPGASFVTGAVLAVDGGYLCA

SEQ ID NO: 10074 - protein, 1417 aa, Pseudomonas aeruginosa PAO1
MNVQQSKFRLSRWAGATLALGLLLSGLGAWGLALVNEQQARMALEREAELLAEAVTRRVELYQYGLRGVRGALLTAGEVHIDRELFRRYSLTRDIDREFPGARGFGFIRRVAAADEAGFLRQARADGQPEFRIQQLTPHDGERYVIQYIEPVARNGQALGLDIASEANRREAARAALETGQVRLTGPITLVQASGLRQQSFLILMPIYRSGITPPPGPQRELEGFGWSYAPLLTGEVLAGLPIDNAAIHLELSDVTGDGAAVPFFVNGAAAPAQRLFGHMLRREIYGRHWQMAFSALPLFVQRLHQPSPRILFLAGSLVSLLLAALVNASALGRLRRRREAATQARLAAIVGNSADGIIGVGLDGVISDWNRGAEALFGYREEQAVGRRVVDLLVPPSKENEELDILARIARKEQVVSFDTVRRHQDGHLLDVAVTVSPILGPDGGVVGASKTVRDISAKKAAEARIRELNTGLEHQIAERTAELRRLNVLLGSVLQAASEVSIITLDRDGIISGFNLGAERMLGYRADEVVGKASPTLLHSERELLARGQELGEEGFRVLVARAEQEGAETREWTYLRKDGSPLSVTLSVTVLRDEAGAINGYLGIAVDVTEWRNAEREMAAARDQLQMAADVARLGIWRWNLADDSLQWNERMCEMYGQPLALRDGGLVYEHWRSRLHPEDLERTEASLRAAVEGRGNYDVIFRVVLPDGGIRFIQAGAQVERDADGNPLQVTGINIDITSDQQLQARLREAKEQADAASAAKSSFLANMSHEIRTPMNAVLGMLQLARQTDLNERQRDYLDKASSAATSLLGLLNDILDYSKIEAGKLVLEMLPFELEPLMQDLAVVLSGNQGDKDVEVIFDIDPELPSAVVGDRLRLQQILINLAGNALKFTARGHVLVSLRRLAHDAHLVRLRVLVADTGIGISAEQQQRIFEGFTQAEASTSRRFGGTGLGLFICKRLVDLMGGELRVESAPGSGSRFWFDLDLDVAHDQPLRAACPGAGEPLRLLVADDNLVAGELLERTVGALGWRADCVGSGSEAVARVQAAMAEGRRYDVVLMDWRMPDLDGLSAAQLIRQLQGDLPPPMVIMITAYGREVLADARDHSAPPFVDFLTKPVTPKQLADSVLHALHGEQGAPANPPPRPVERTQRLRGVRLLVVEDNALNRQVAAELLSSEGARVALADGGLAGVQQVLEASVPFDAVLMDMQMPDIDGLEATRRIRADGRFAGLPILAMTANASLADREACLAAGMNDHVAKPIDKERLVLCLLGHLGRSGARGAPATAADAGELVEARGDIVGRFGGSLELIVQVLRRFVPDMQDLFAQLERQLGEGDVQGSAATLHTIKGSASTVGASALAGRASELEQALRRADPLRGMEILAGIRLDELRTLCDACLLRLQAMFGDVQAESAS

SEQ ID NO: 10075 - protein, 486 aa, Pseudomonas aeruginosa PAO1
MIKHWINGREVESKDVFENYNPATGELIGEVASGGAAEIDAAVAAAREAFPKWANTPAKERARLMRRLGELIDRNVPHLAELETLDTGLPIHQTKNVLIPRASHNFEFFAEVCTRMNGHSYPVDDQMLNYTLYQPVGVCGLVSPWNVPFMTATWKTAPCLALGNTAVLKMSELSPLTANELGRLVHEAGIPPGVFNVVQGYGASAGDALVRHRDVRAVSFTGGTATGRRIMEAAGIKKYSMELGGKSPVLVFEDADLERALDAALFTIFSLNGERCTAGSRIFVQESVYPQFVAEFAARARRLIVGDPQDPKTQVGSMITQAHYDKVTGYIRIGLEEGATLVAGGLERPAGLPAHLSKGQFIQPTVFADVDNRMRIAQEEIFGPVVCLIPFKDEAEALRLANDVEYGLASYIWTQDIGKAHRLARGIEAGMVFINSQNVRDLRQPFGGVKASGTGREGGEYSFEVFAEIKNVCISMGSHHIPRWGV

SEQ ID NO: 10076 - protein, 434 aa, Pseudomonas aeruginosa PAO1
MSTASTLNSTTLPLSDSTHDRVTWRLMPLLLVCYVFAHLDRINIGFAKLQMSADLHFSDTVYGLGAGLFFIAYALFGLPSNLMLERIGPRRWIACLMLVWGCLSTAMLLVETARGFYLLRFLLGVAEAGFFPGILVYLNRWFPARRRGQITALFAIAVPMAGVIGGPLSGWILEGFHDALGLRGWQWMFLIEGLPVVLLGVVVWCSLPESFERVTWLSDEQKHLLREELAGEEQRKTITSFSGIFSNPQVWLLVAIYFAVMLAVNTIAFWMPSLIHGAGIAQDSRIGMLSAVPYLAGCAFMIFIGRSSDRLRERRWHLGIPLLMAAAGLSLAALAPTSAWLVMGGLVIAGMGASAALPMFWQLPPAFLSSATLAAGIALISSFGSIAAFLAPYLIGWMRDTTQSASLALYLLAILIALGAGLVLRTPAAVVNPR

SEQ ID NO: 10077 - protein, 238 aa, Pseudomonas aeruginosa PAO1
MTNHRTALVTGATRGIGLALARRLAASGWSVVGIARHASDDFPGRLLCCDLADPAQTAETLRGLLSESAVDALVNNAGIALPQSLENLDLAALQQVFDLNVRVAVQLAQACLPGLKRSPAGRIVNLCSRAIHGARERTAYAAAKSALVGVTRTWALELAPLGITVNAVAPGPIETELFRQTRPVGGEEERRILSTIPMQRLGRPDEVAALIEFLLSEGASFVTGQVIGVDGGGSLGGR

SEQ ID NO: 10078 - protein, 272 aa, Pseudomonas aeruginosa PAO1
MSSTIHPLPSFGLGTFRLTGQVVVDSVRSALELGYRAIDTAQIYGNEADIGRAIAESGVPRSELFLTTKVWVDNYAREKLLASLRESLEKLRTDRLDLVLIHWPAPGNGVELGEYMAALAEAKSLGLTRRIGVSNFNIELTRQAIAAVGAGEISTNQIELSPYLQNRALTAYLEEQGIAVTSYMTLAYGKVLKDPTLAGIAARHRATVAQVALAWAMQLGYAVIPSSTRRENLASNLLARDLRLDAEDMARIAGLERNGREVSPQGLAPAWD

SEQ ID NO: 10079 - protein, 496 aa, Pseudomonas aeruginosa PAO1
MTELLSREEYAAIAATLDLPQRAFIDGGFRDACGGRTFASTNPATGELLAQVAACDAEDVGHAVASARRAFEDGRWRSRTPAERKAALLRLAELLEEHLLELAVMESLDSGKPIRECQHTDLPETINTLRWHAELIDKIYDSTAPVGSAALAMVVREPIGVVGLVLPWNFPLLMLAWKIGPALAAGCSVVVKPAPETSLTALRVAELASQAGIPAGVFNVVPGGGREAGEPLGRHPDVAMVSFTGSTATGRLFLKYAAESNLKRVVLECGGKNPAVVMNDVEDLDLVAQHVVNGAFWNMGENCSASSRLIVHAEVREALLERIGAQLREWRMGDPLDPRNRLGALVSPAHFEKVRAYLDQARTERLAVRFGGATEAGIFVEPTVVDGVSPHSRLFREEIFGPLLSVTSFDDIDEAIALANDTVYGLAASAYTGSLRHALRLSREIRAGIVTVNCFGEGDASTPFGGYKESGFGGRDKSVWAHDQYTELKTIWIDAS

SEQ ID NO: 10080 - protein, 387 aa, Pseudomonas aeruginosa PAO1
MSIKVEDYFAPETFQRMKAFADKQETPFVVIDKQTIADAYDQLTDCFPFARIYYAVKANPATEITELLRDKGSNFDIASIYELDKVMKTGVGPERISYGNTIKKSKDIRYFYEKGVRLFATDSEADLRNIAKAAPGAKVYVRILTEGSTTADWPLSRKFGCQTDMAMDLLILARQLGLEPYGISFHVGSQQRDISVWDAAIAKVKVIFERLKEEDGIVLKMINMGGGFPANYITKTNDLETYAEEIIRFLKEDFGDDLPEIILEPGRSLIANAGILVSEVVLVARKSRTAVERWVYADVGKFSGLIETMDESIKFPIWTEKQGEMEEVVIAGPTCDSADIMYEHYKYGLPLNLASGDRLYWLSTGAYTTSYSAVEFNGFPPLKAFYL

SEQ ID NO: 10081 - protein, 296 aa, Pseudomonas aeruginosa PAO1
MPARRLPLLLFGAFFALYFIWGSTYLAIRFGVESWPPMLMAGVRFVIAGGLMFAWLRWRGAPLPTWREWRGAGVVGILLLSCGNGGVTVAEHWGVSSGVAALAVATVPLFTLLFSQLFGQRNTTLEWGGIVLGLFGIVLLNLGSNLQASPAGAGLILFAAASWAFGSVWSRRLSLPAGPMASAAEMLVGGAVLLVGSLASGERLEHWPSTSGWLALVYLILFGSIIAFSAYQYLLRNVRPAAATSYAYVNPAVAVLLGTLFAGERIGGIEGLAMLVIISAVVLIGLPQWRASRAAA

SEQ ID NO: 10082 - protein, 942 aa, Pseudomonas aeruginosa PAO1
MVRLRIAIGLLVSFLLLLLGPMSPAVADDAGVSSVPLQTTATTPSANQNWRLLRDESAQLRIADVLQRKEQFRPLAKRSFIFPASPQAVWLQVQLPAQKVPSWLWIFAPRVQYLDYYLVQDGQLVRDQHTGESRPFQERPLPSRSYLFSLPVDGKPMTLYVRMTSNHPLMAWFDQIDEAGLVGLEKPAYAFGMLLGGMLLLLMYNLIRFAYSRSASSLWLAAVHAALAVCAAANLGLVAFWLPGLKFNQSLTADLGALGAAVSLLWFACSFFRGTAESRLNRLLQGEALLILAVGAIIAFTQQLWFSWLIYLLVILSSLSVPLIAAWHWYRGYQPARLIVAGMIVFNAGFMVFLPVLFGTKQLDPGWLVLGVFSFATLAGLVLSVSLTERQRLIQQLNLQQRTSEAAHTAELQTKAEFLAKISHEIRTPMNGVLGMTELLLGTPLSAKQRDYVQTIHSAGNELLTLINEILDISKLESGQIELDEVQFDLNALIEDCLDIFRVKAEQQRIELISFTQPQVPRVIGGDPTRLRQVVLSLLDNAFKQTEEGEILLVVALDDQGETPRLRIAVQDSGHPFDAKEREALLTAELHSGDFLSASKLGSHLGLIIARQLVRLMGGEFGIQSGSSQGTTLSLTLPLDPQQLENPTADLDGPLQGARLLVVDDNETCRKVLVQQCSGWGLNVSAVSSGKEALAQLRTKAHLREYFDVVLLDQDMPGMTGMQLAAKIKEDPNLNHDILLIMLTGISNAPSKIIARNAGIKRILAKPVAGYTLKATLADELAQRGVSGVTNYLQPAKEAQAPSLPSDFRILVAEDNSISTKVIRGMLNKLNLQPDTASNGQEALSAMKATQYDLVLMDCEMPVLDGFSATEQLRAWEAHEQRPHTPVVALTAHILSEHKERARLVGMDGHMAKPVELSQLRELIAYWVGERDRRRQGDALPS

SEQ ID NO: 10083 - protein, 489 aa, Pseudomonas aeruginosa PAO1
MSDSRYTDLGLQPLAGEWRHGRAGRRLKVSNPFDGSLLLEIEQADRDDLDAAYAKAAEVQPAWAALGPSARAAVLYKAVEVFDRRHEEIVDWIIRESGSTRLKAEIEWGAARAITLESASFPARVHGRIVESDVPGKESRVYRSAIGVVGVISPWNFPLHLTQRSIAPALALGNAVVVKPASDTPVCGGLLLARIFEEAGLPAGLFSVVVGPGSEIGDAFVEHPVPGLVTFTGSTPVGRNIGRIASGGAHLKHVALELGGNSPFVVLGDADLEQAVNAAVFGKFLHQGQICMAINRIIVEDSLYDAFAARFVERVKGLRVGDPQRADTAVGPIVNARQLEGLLEKIRLARQEGAKPLYEGGVDGQLLAPHVFGEVTATMEIARDEIFGPLVGLLRARDEAHALELANASEYGLSSAVFSRDLERAVRFARQLRAGMTHVNDIPVNDEANAPFGGEKNSGLGRFNGDWAIEEFTTDHWISVQHAPRQYPF

SEQ ID NO: 10084 - protein, 351 aa, Pseudomonas aeruginosa PAO1
MFPKNAWYVACTPDELAGKPLGRRICDEPMVFYRGEDGRVAALEDFCPHRGAPLSLGFVEDGVLVCGYHGLAMGEDGRTRAMPGQRVRGFPCIRRFPVQERHGFVWVWPGAEEQADDALIPRLEWAESPDWAYGGGLYHIHCDYRLMIDNLMDLTHETYVHASSIGQKEIDEAAPTTRVEGDEVITSRHMQNVMAPPFWRMALRGNGLADDVAVDRWQICRFTPPSHVLIEVGVAHAGHGGYQAPAERKAASIVVDFITPESATSIWYFWGMARNFQAHDQALTESIREGQGKIFGEDLEMLESQQRNLLRHPRRDLLKLNIDAGGVQARRIIERLLADERQAAAPNRAQA

SEQ ID NO: 10085 - protein, 317 aa, Pseudomonas aeruginosa PAO1
MIEVIVGAIRLEAQDIHSFELFRADGAALPSFEPGAHIDLHLPNGLVRQYSLCGPAERPRHYRIAVLRCRDSRGGSATLHAELRVGQRLHIGEPRNLFPLSPEPGPHLLFAGGIGITPLLAMAERLARDGADFQLHYCAHSGERAAFVDYLGRCAFADRVHCHFDHGESSRRADLRALLATSPRDAQLYLCGPAGFMQWIEESARELGWEASRLHREHFAAAPRDASADGTFEVQLASNGALIRVAAGQTVLAALREAGVDLPASCEQGICGTCLTRVLDGEPEHRDLYLSEEEQAANDCFTPCCSRSRSPRLVLDL

SEQ ID NO: 10086 - protein, 234 aa, Pseudomonas aeruginosa PAO1
MNVLIVHAHNEPQSFTRALCDQACETLAGQGHAVQVSDLYAMNWNPVASAADFAERADPDYLVYALEQRESVKRQSLAADIQAELDKLLWADLLILNFPIYWFSVPAILKGWFDRVLVSGVCYGGKRFYDQGGLAGKKALVSLTLGGRQHMFGEGAIHGPLEDMLRPILRGTLAYVGMQVLEPFVAWHVPYISEEARGNFLRAYRARLENLEQDVPLRFPRLEQFDALLQPLAR

SEQ ID NO: 10087 - protein, 998 aa, Pseudomonas aeruginosa PAO1
MAAGRPGTGCGDHPLLRLSGIPADFLERRPAGPGAGAGAGEAAVRRAGLPGRGGGAGQLAALPARRRRRTGRPDTGLPHARARSRPGVFRRAGAARGGGDLLQPPAAGAHPIPRRPRRLSRRAVVRRKLRGGLRPLRRPPRQRRMGFRQPTELRQAGAPAHRLHRPRTTHRHAVRRAPGRRREHPCAARTADGGLPAGGGLAALAAGGEDGRDRPGPAWLSRRRQHPALAGRQRARLSAPRRQPRGRLVSGHGGVLARRLLWRVLLFSLCFTVLAGAVQLFFEYRREMREIEARLELIRSGYLASFERSLWDLNQEQLNVQLRGLGDFPDIARVSLQSADFNLLQGDQRPRGMLRVERFPLSYQPPGGERRQLGELEIAIDLAAVYRRLVSGGLASLLWMGSFLCGLAVALSWLFHSLVTRHLWRMSEFAGHIAEGDLQQPLRLDKVDRERDEIDAVAAALEDMRQALRTDRRRRDADRDELRRQVERRTASLRRAKDQAEAADRAKSRFLATMSHEIRTPLNGILGMAELLREASLGERDRQRLRALATAGEGLLAILNEVLHFARLEEAPDVPEAVDFSLRSLLEDVLTLLEPRARENATRLDLWLDPQVHDGHRGAEQFLRQVLTNLLGNAVKFTEAGEVRVRVERLARSAGSERLRLSVADDGIGIPEEMRERIFERFTQGGDAVTRRYGGTGLGLAISKRLVEALGGRIGVESRVGQGSTFWFEIELALASLSGATPPAASVSALEVLLVEDVALNREVAQGLLERDGHRVMLAEDAGPALALCRQRRFDLILLDMHLPGMAGLELCAGIRRQLDGLNRATPIFAFTASIQPDMVRRYFAAGMQGVLGKPLRMDELRRALGEVGTSVPALAVDAALDRQMLETHRRLLGRHKLAGLLGNLLGSLDEQLPLLAEALDQADLAEAANIAHRLSGSCHSMGLVALGAGLGELEREALGAAGVDPRAWGARLGSLRRDGAEALRRAGFLGEADSAAG

SEQ ID NO: 10088 - protein, 378 aa, Pseudomonas aeruginosa PAO1
MTRSAEPRVLQFCHGYDGPFLDCARQYASLFAGTPYKVTTVFLTGRSDPEVAARCASDEVLFLEYGSRDIRGLKLKAIRDLREIARSRDFRFCIAHRFKPIWIASLATRLPIVGVHHAFGDYQRLSRKVFAGLMSKRLSLLAVSDAVRDDIRRCLPKWPAERIETLYNRIDVAALQAEQVERLSARRQLRLPDEAWVVGNVGRLHPDKDQATLLRGFAAALPRLPQNSLLAILGSGRLEEQLKDLACELGIGERVLFLGQVEEARRYFKAFDAFALSSDHEPFGMVLLEAMVAGVPLIATACGGAREVVEGVGILFPLGDETALAEGLTHLAALDRRQREACARLMLERLETRFSDAAVRREFWRLPTIAGFASESAC

SEQ ID NO: 10089 - protein, 336 aa, Pseudomonas aeruginosa PAO1
MSRVTLSRYLIEQTRSHNTPADLRFLIEVVARACKEISHAVSKGALGGVLGSMGTENVQGEVQKKLDVMSNEILLEANEWAGNLAGMASEEMDHPYQIPGRYPKGAYLLVFDPLDGSSNIDVNVSVGTIFSVLRCPNEYLNQNDTLREEAFLQPGTTQVAAGYAIYGPQTMLMLTLGNGVKGFTLDRELGSFVLTHDNISVPESTAEFAINMSNQRHWEAPVKRYVEELLAGKEGPLGKNYNMRWIASMVADVHRILTRGGVFMYPRDAREPEKPGKLRLMYEANPMSFIIEQAGGAATNGTQRILDIKPENLHQRVAVFLGSKQEVERITGYHAE

SEQ ID NO: 10090 - protein, 245 aa, Pseudomonas aeruginosa PAO1
MAERKTLLLTGASRGIGHATVKYFNAAGWRVFTASRQSWASECPWADGEENHIHLDLEDIPGVEASLELIREKLGDGRLHALVDNAGISPKGEGGERLGVLETDYATWLRVFNVNLFSTALLARGLFAELKAAQGTVINVTSIAGSKVHPFAGVAYATSKAALSALTREMAHDFGPHGVRVNAIAPGEIDTSILSPGTEEIVERSIPLHRLGRPEEIASLIYFLCTSGASYVNGAEIHVNGGQHV

SEQ ID NO: 10091 - protein, 415 aa, Pseudomonas aeruginosa PAO1
MDTFSYRDAELFAEGVALSRIAERFGTPTYVYSRAHIEAQYRAYADALAGMPHLVCFAVKANSNLGVLNVLARLGAGFDIVSRGELERVLAAGGDPAKVVFSGVGKTRDDMRRALEVGVHCFNVESGEELERLQRVAAELGVKAPVSLRVNPDVDAQTHPYISTGLKENKFGIAIDEAEAVYARAAELDHLEVIGVDCHIGSQLTQLEPFLDALERLLGLVDRLAGKGIGIRHLDLGGGLGVRYRDEQPPLAGDYIRAIRERLHGRDLTLVFEPGRSIVANAGVLLTRVEYLKHTEHKDFAIVDAAMNDLIRPALYQAWMDVQAVRPRDAAPRRYDLVGPICETGDFLAKDRDLALAEGDLLAVRSAGAYGFVMSSNYNTRGRAAEVLVDGEQTHEVRRRETVQELYAGESLLPQ

SEQ ID NO: 10092 - protein, 112 aa, Pseudomonas aeruginosa PAO1
MKLVTAIIKPFKLDDVRESLSEIGVQGITVTEVKGFGRQKGHTELYRGAEYVVDFLPKVKIDVAIADDQLDRVIEAITKAANTGKIGDGKIFVVNLEQAIRIRTGETDTDAI

SEQ ID NO: 10093 - protein, 661 aa, Pseudomonas aeruginosa PAO1
METPTTPRSTLNPPVFYTSAALILALVLFTVLLQEEAQSLFNHVQQWIITNASWFYVLAVALILISVVFLAVSRYGDIKLGPDHSRPDYRNTTWFAMLFSAGMGIGLMFFGVAEPVMHFTTPPVGEPNTVQAAKEAMKLTFFHWGLHAWAIYAIVALILAFFSYRHGLPLTLRSALYPLIGERIYGPIGHAVDIFAIIGTVFGVATSLGYGVLQINSGLHHLFGWPVNQTVQIALIAATCGLATLSVASGLDRGIRILSELNLSLAVILLLFVLVLGPTVFLLQTYVQNTGAYLSDIVNKTFNLYAYEPTDWIGGWTLLYWGWWLSWSPFVGLFIARISRGRTIREFVCGVLFVPAGFTLLWMTVFGDTAIHMVLQEGFTQLAEVVNQDSSVALFAFLEHFPLGSVISLVAVLMVVVFFVTSADSGALVVDMLASSGKDHSPLWQRIFWSVLMGVVAIALLLADGLKALQTATIASALPFSIVLLASIWGLFKALHLDATKRGIRYQALTFSRPTTRSGASEGDGWQRRLRNIAMFPRRSHVNRFITDVARPACEDVAAELRKQGYEVQVQDGEDGRVRLEVSHGGEVDFIYEVRPRAFTTPSFVMRDTEDSSESRKYFRAEVHLQEGGQDYDIMGWSRDGVIGDILDQYERHMHFLHVVR

SEQ ID NO: 10094 - protein, 488 aa, Pseudomonas aeruginosa PAO1
MSSPSLVELKAILRLAGPLIAAQLAYVAMVFTDTVMMGKLGPDALAAGGLGAVSYAFVSTFCVGVVAAVGNLVAIRHGCDDAAGAAAAARSGLWVGAALALAAGLLLWNLRPLLLVFGQAPQTVDGAMQFLHSLTFALPGYMAFMVLRGFTSAIDRAGPVMAISVLGALANLALNYSFIEGLFGLPRLGLAGIGLVTALVMNCMPLLLALYIRLQPAYAEYSLLRGLGRPQRAMVEEILRLGLPIGGTYAVESGMFTVATLCMGIIGDHALAAHQIAIQAVYVAFMVPVGLSYATTYRIGQHFGAGRLLEARRAGRVGIGFGALCMLLFAGLFWWMPEAIIGLFLDRDAPANREVAAMAVSLLAIAAWFELFDGTQNVAMGAIRGLKDARTTFLVGLACYWLVGVPLACLLAFAAGWGAAGVWWGLAGGLACAAIGLTLAFEWKTARLLPKATASEASALNCRAAGRGAPSARLCPGNAPVPPTAAAD

SEQ ID NO: 10095 - protein, 497 aa, Pseudomonas aeruginosa PAO1
MTTLTRADWEARAKDLKIEGRAFVNGEYSNAASGETFDCLSPVDGRFLAKVASCDLADAEQAVKVARNAFDSGAWSRLAPAKRKQTMIRFADLLLENAEELALLETLDMGKPISDSLHIDVASAANSLRWSAEAIDKIYDEVAATPHAELGLVTREPVGVVAAIVPWNFPLLMSCWKLGPALATGNSVILKPSEKSPLTAIRIAQLAVEAGIPKGVFNVLPGYGHTVGKALALHMDVDTLVFTGSTKIAKQLMVYAGESNMKRVWLEAGGKSPNIVFADAPDLKAAAEAAAGAIAFNQGEVCTAGSRLLVERSIKDKFLPLVIEALKGWKPGNPLDPETNVGALVDTQQMNTVLSYIEAGHNDGAKLVAGGKRTLEETGGTYVEPTIFDGVTNAMKIAREEIFGPVLSVIEFEDAEEAVRIANDTPYGLAAAVWTSNLSKAHLTAKALRAGSVWVNQYDGGDMTAPFGGFKQSGNGRDKSLHAFDKYTELKATWIKL

SEQ ID NO: 10096 - protein, 402 aa, Pseudomonas aeruginosa PAO1
MQRLYRKRIVLGVGGGIAAYKSAELVRRLRDQGAEVRVVMTQGGREFITPLTLQALSGHPVHTDLLDPAAEAAMGHIELARWADLVLIAPATADLMARLVQGVANDLLTTLVLATDAQIALAPAMNQAMWRDTATQANAELLRQRGFHLFGPAAGSQACGDVGLGRMLEAEELAQRAADCFQRQALTGVHVLITAGPTQENIDPVRYITNHSSGKMGFALAEAAVEAGARVTLVTGPVHLPTPDRVQRVDVVSARDMLAACEAAMPCDLLIASAAVADYRPEVVAAHKLKKDPTSGEGLLLQLVRNPDILATLAQREDRPFSVGFAAETENLLDYAARKLKDKNLDLIVANDVANPSIGFNSDENAITVIDRDLHPSTFAQTSKGKIARQLVAFIADRLNQQ

SEQ ID NO: 10097 - protein, 490 aa, Pseudomonas aeruginosa PAO1
MARFEEQKLYIGGRYVEASSGATFETINPANGEVLAKVQRASREDVERAVQSAVEGQKVWAAMTAMQRSRILRRAVDILRERNDELAALETLDTGKPLAETRSVDIVTGADVLEYYAGLVPAIEGEQIPLRETSFVYTRREPLGVVAGIGAWNYPVQIALWKSAPALAAGNAMIFKPSEVTPLTALKLAEIYTEAGVPDGVFNVLTGSGREVGQWLTEHPLIEKISFTGGTSTGKKVMASASSSSLKEVTMELGGKSPLIIFPDADLDRAADIAVMANFFSSGQVCTNGTRVFIHRSQQARFEAKVLERVQRIRLGDPQDENTNFGPLVSFPHMESVLGYIESGKAQKARLLCGGERVTDGAFGKGAYVAPTVFTDCRDDMTIVREEIFGPVMSILVYDDEDEAIRRANDTEYGLAAGVVTQDLARAHRAIHRLEAGICWINTWGESPAEMPVGGYKQSGVGRENGLTTLAHYTRIKSVQVELGDYASVF

SEQ ID NO: 10098 - protein, 516 aa, Pseudomonas aeruginosa PAO1
MFFGSTALILVLTAALILYPDSAGALLGRIQEWLSHSFGWYYMLAIGAYLFFVAWVAFSRFGTLKLGEEHEKPDFSYGAWAGMLFSSGIGISLLYFAASEPIDHLYHPPEGVPGSPQAARQALQLTFLHWGLHGWAIYALVGLAVGYFAYRHRQPLALRSALYPILGERWVKGAAGHAVDCFGIFVTLLGLVTNLGIGALQVSSGLEYLTGMPHSKGTLLAVILAMSLVATLAAVSGVEKGIRRLSNLNIVLFSSLLLFVLVCGSTLELLNGFVQNLGDYLDGLVLKTFDLYVYTGAGAGKSEEWLGLWTLFYWAWWISWAPFVGMFIARISRGRSVRELVCGVLLIPLGFTLAWLSVFGNSALDLVMNHGATDLGKAALEQPSMSIYLLLEHYPLSKIVIGLSIFVGFVLFLTPADSGSVMLANLSRSGGELDEDAPNWLRILWSAVVTLVTIGLLFAGNFTAMQTVVVLAGLPFSAVLILFMFGLHKAMRADYEAQVGDRRTYQPVPAPTQPQT

SEQ ID NO: 10099 - protein, 260 aa, Pseudomonas aeruginosa PAO1
MNDFSKWTGQVALISGAGSELGIGFAIARRLAREGVRLLITASSERIRQRAEELSACGHDVRAASADLTDEAQVQGLLDWAEAQWGRVDILVNNAGMAQLDSAEPFSAVEATSLRDWQLSLSRNLTSAFLLTRGLLPGMRERGYGRIVNVASTTGTRGSNPGEAAYSAAKAGLVGWSMGLALEVAKSGITVNSVAPGWIATASSTAEERQAALASPSGRAGRPEEVAAAVAFLASPEASFVNGELLVVDGGNCLIENKRS

SEQ ID NO: 10100 - protein, 251 aa, Mesorhizobium loti
  unsure (1)..(251): unsure at all Xaa locations
MTNKLEGKIAVVTGGSSGIGLGIAKRFAAEGAHVYITGRRQAEIDKAVAAIGKHATGIQADSTSFTDLDRLTRRVKARSGRIDVLSVNAGGGSMLPLGQITEQHFDETFDRNVXAVLFTVQKALTLLADGASVILTGSTAGSTGAAAFSVYGASKAALRNFARSWIIDLKERQIRVNILSPGPTRTTGLAELAGPEAEQQKGLLDFLATQVPMGRLGDPDEIGKAAVFLASDDSSFVTGAELFVDGGTAQV

SEQ ID NO: 10101 - protein, 219 aa, Vibrio cholerae
MGTMNFQAAIFDMDGLLLDTERVCMRVFQEACTACGLPFRQEVYLSVIGCNAKTINGILSQAYGEDLPRLHNEWRQRYNAVVMHEAIPHKDGVIALLEWLKARSIPVAVATSTQKEVALIKLQLAGLDHYFANITTGCEVTQGKPHPEIYLLAAERLGVEPQQCLAFEDSNNGIKAAMAAQMHAFQIPDLVKPSPEVIALGHPICTSLNEVIDLLSPNH

SEQ ID NO: 10102 - protein, 450 aa, Vibrio cholerae
MESQRIALIEDDDIVRQATGQWLQLAGFDVAMFADGASALAAIEQQSFAAVVSDVRLPDTDGLSLLVALKNVQSLMPVILITGHGDVDMAVKALHQGAFDFIEKPFQPERLANTVAQAVSQYQNALSSQSRAHYLASAKGLEQILIGQCKSIQLLREQIAKVAAMDTNVIIYGETGCGKELVAQCLHQASERQRGQFVAINCGAIPENLFESELFGHEAGAFTGAVKRRIGKLELADKGTLFLDEIESMPLAMQVKVLRVLQDHVVERVGSNQPITIDLRVIAAAKEELRQHAEFRQDLFYRLNVAQLYLPPLRERGDDILLLFEHFCVQVKPTWRSLSEADRLALLTYRWPGNVRELRNVALRYALDDSISVGEILASCPGMTEEEASAGLPLAIQVHNFERKVIAQALHRHQGNISEVMKELDLPRRTLNQKMQKFGLLRGDFTAQEE

SEQ ID NO: 10103 - protein, 394 aa, Vibrio cholerae
MLTQEHINIIKSTIPLLESAGPALTQHFYQRMFSHNPELKHIFNMTHQKTGRQSVALFEAIAAYAKHIDNLAALTSAVERIAHKHTSFNIQPEHYQIVGHHLLETLRELAPDAFTQPVEEAWTAAYFFLAQVFIDREGALYLERKQALGGWRDGRTFVVREKQVESAYVTSFVLVPADGGAVLDYQPGQYIGIEVTPEGSDYREIRQYSLSHASNGREYRISVKREGVGSDNPGLVSHYLHNNVKVGDSVKLYAPAGDFFYVERERPVVLISAGVGATPMQAILHTLAKQNKSGVTYLYACNSAKEHTFAQETAQLIAQQGWMQQVWYRDESADDVLQGEMQLAELILPIEDGDFYLCGPIGFMQYVVKQLLALGVDKARIHYEVFGPHAQLAA

SEQ ID NO: 10104 - protein, 347 aa, Vibrio cholerae
MRIEQELKLGFKDVLFRPKRSTLKSRSQVNLTREFTFKHSGRQWSGVPVIAANMDSVGSFAMAKALAEHGVMTAVHKHYTVADWAEFVKSADKATLNNVMVSTGTSEADFQKTKDVMALSDELIFICIDIANGYSEHLVEYVQRVRAAFPDKVISAGNVVTGDMVEELILAGADIVKVGIGPGSVCTTRVKTGVGYPQLSAIIECADAAHGLGGRIIGDGGCTCPGDVAKAFGGGADFVMLGGMLAGHEEAGGELIVKDGETFMKFYGMSSKSAMDKHSGGVAGYRAAEGKTVLLPYRGSVHGTIQDILGGVRSTCTYVGAAELRELTKRTTFIRVQEQENNVYGRE

SEQ ID NO: 10105 - protein, 246 aa, Vibrio cholerae
MRKIALITGSKGGIGSAISTQLVSEGYRVIATYYTGNYQCALDWFNEKQFTEDQVRLLELDVTNTEECAERLAKLLEEEGTIDVVVNNAGITRDSVFKKMPHQAWKEVIDTNLNSVFNVTQPLFAAMCEKGFGRIINISSVNGLKGQFGQTNYSAAKAGMIGFSKALAAEGARYGVTVNVIAPGYTLTPMVEQMRAEVLQSIVDQVPMKRLAKPEEIANAVSYLASDAAAYITGETLSVNGGLYMR

SEQ ID NO: 10106 - protein, 1020 aa, Vibrio cholerae
MQTQIWHEVIRWRTGVNTAQYSPIRHAEEVNKKVFPMRLAKASIGRKLLFSFSAMALLVLLSALIGVLGFSLVAKTERDVVNNAIPSMIEARQVAELSHQIIASVQTLSNAKNEQEHQAAGQKVFSQLETLLTHIQQLGEEAFDSVLLDRLEQDVQNVIDTLAQLGRRVEHRLTLESQLSTSVKEMRKLAQELEQLTRTQVLNTSTIAIANVTHIYDLLQKQQQAQVYQALDNLVEVDLDLAERLHELHLLAFKVLNEIEETQTVTDLERILALDSEFAANLSIMQRRVQAVEDPTRSKQMVSLLRGLEKRRIVFELLKQRYSNEQAAQQLLHDTLTQFAKLNNTVNQLVDASNQVTTAAVSKLSNTLYDAQLILTVLGLLGLVIVVWIVWKVVYRSVIQRLDQHTAALLSVAKGQLDVDVSTQGNDELGQMGQAIAHARDTAKALKVVAESEVLAKRELQQHKEHLEELVEQRTCQLSEMNHKLNQEVLNHAKARQQAEQASRAKSAFLATMSHEIRTPMNGVLGTARLLQDTTLTSTQQHYVQVINRSGRSLLAILNDVLDYSKIEAGHLEIHHTHFDLYRLVSETHELMQSRAREKGITLTYHIDEDVTQYWQGDEIRIGQVLNNLVGNGIKFTDQGEVRIRIRLAPDGQGIRFAVEDSGIGIAEEEQATLFDAFTQADAGRRKLGGTGLGLAISRKLVQAMGGELQLASQLGQGSCFWFTLPLPVGEPVETPALAVDDVPVANVLLVEDNEVNCLVAQGFLTSLGHQVTLAKSVQEAKLCFQQQRFDIALLDIHLPDGNGVDLLRDLRQMEDSIHNAVIPFIAVSAHVFNEEVAGYLAAGFDGYLPKPLVKEQLAAMLRQQLTAKSGDDADMRDKAESHDTSSIFDNGQPQGEPSPEAQAVRKEWVAVMDHAKFEQDVQILGVEKMREIVGYFEQGCAEFFALCEAERDNDAQIKSQAHKLKGSAGALWLTQLYQLCQQIEKADSPAAAYQQTPLVDAVENAKQALRNALDLLSKE

SEQ ID NO: 10107 - protein, 857 aa, Vibrio cholerae
MNIRPSQIKHKQRIASFITHAVVVVMGVLIVSVLFQSYQISSRLMAQEGQRTSVQTSSLIQSLFDFRLAALRIHQDSTAKNASLINALVSRDSSRLDEFFSSVDELELSNAPDLRFISSHDNILWDDGNASFYGIAQQELNKLIRRVAISGNWHLVQTPSEGKSVHILMRRSSLIEAGTGQVVGYLYVGIVLNDNFALLENIRSGSNSENLVLAVDTTPLVSTLKGNEPYSLDYVVHSAKDAMRDSFIVGQTFLEVESVPTYLCVYSIQTNQNVLTLRDNFYFWMAFALISMIGVSIASRWWLQKRIQREIETLMNYTHKLMDLDTKSEFIGSKIYEFDYFGRTLEQSFRRLANKEKQFEDLFNFALSPTMLWNTSGRLIRMNPSAQIQFLREDAQNHFLFEILERQLLPTITNAAQGNNPSDVTTEVDGRVYRWNLSPIMVEGQIISIITQGQDITTIAEAEKQSQAARREAEESARVRAEFLAKMSHELRTPLNGVLGVSQLLKRTPLNDEQREHVAVLCSSGEHLLAVLNDILDFSRLEQGKFRIQKNEFRLKELVCAIDRIYRPLCNEKGLELVVNSNITTAAIVRSDQIRINQILFNLLNNAIKFTHQGSIRVELQLIEGDPLAQLVIQVVDTGIGIREQDLTVIFEPFMQAESTTTREYGGSGLGLTIVHSLVEMLSGQLHVSSEYGIGTRFEIQLPIELVEKPDAPQQLLPAPDPQPLFDKTLRVLLVEDNHTNAFIAQAFCRKYGLDVSWVTDGLQAIEELKIHDYDLVLMDNQLPYLDGVETTRTIKKVLHLPVVVYACTADGLEETRQAFFHAGAEYVLVKPLKEQTLHKALEHFKHHHGQKNAGLN

SEQ ID NO: 10108 - protein, 282 aa, Vibrio cholerae
MTKDREIRQTVPAQPTSDGDGVKIQRIAGFQRPNFSPFLMLDELKADSQADYIGGFPPHPHRGIETLTYMLQGHFQHRDQMGNVGELRSGGAQWMAAGHGVIHSEMPIMQEGQLHGFQIWINQPARNKMSPAKYQDFQPESIVERHHPQQGLLRVIAGSVEVEDQTITGPLTDTGVPATVVDWRAEAGQDISINTPPHFNAMLYVYRGSLNVGKQSVKTGHMAMLTAGEQLTLRAEQPCGSLLLMGQPIDEPVVHYGPFVMNSMAEIEQAIRDYNAGHFETY

SEQ ID NO: 10109 - protein, 803 aa, Vibrio cholerae
MPTLQAAMFLEKDMQKNTLWFDSLSMQDVDKVGGKNASLGEMVSNLANAGVSVPNGFATTAYAFNQFLDFEGLDERIHQLLDELDVDDVDALRKTGATIRQWILQAPFPAELEQEIRTNYNQLIDGNSELSVAVRSSATAEDLPDASFAGQQETFLNVKGIDAVLEATKHVYASLFNDRAISYRVHQGFDHRGIALSAGIQRMVRSDKAASGVMFTLDTESGFDKVVFITAAWGLGEMVVQGAVNPDEFYVHKPLLEAGYPAIVKKTFGSKLSKMIYANSQVIGKQVEVVDTSAHERNQFSLTDAEIQELAKQALIIEKHYQRPMDIEWAKDGIDGKLYIVQARPETVCSQSEQNVIERYELSHKASVLLEGRAIGQRIGSGTVRLVDSLDQMSLVQQGDVLVTDMTDPDWEPVMKKAAAIVTNRGGRTCHAAIIARELGIPAIVGCGDATRRLSDGAQVTVSCAEGETGYVYAGQLDFAVRRSSVDELPMLPTKVMMNVGNPDRAFDFAQIPNEGVGLARLEFIINKMIGIHPKALLNFDTQSAELQTQILDRIRGYRDPIDFYVSKLTEGIATIAAAFWPKRVIVRMSDFKSNEYSNLLGGSEFEPHEENPMLGFRGASRYISPVFEDCFELETQAIKRVRHEMGLKNVEVMIPFVRTTGEAEAVIDLLAKFGLRRGEQGLKVIMMCELPSNAVLADEFLKFFDGFSIGSNDMTQLTLGLDRDSGDVAHLFDERNPAVKIMLKMAIDAATRAGKYVGICGQGPSDHDDLAQWLMEQGISSVSLNPDTVIDTWLKLGAVSKC

SEQ ID NO: 10110 - protein, 487 aa, Pasteurella multocida
MLRVIKEALTFDDVLLVPAHSTVLPNTADLSTQLTKTIRLNIPMLSAAMDTVTETKLAISLAQEGGIGFIHKNMSIERQAERVRKVKKFESGIVSDPVTVSPTLSLAELSELVKKNGFASFPVVDDEKNLVGIITGRDTRFVTDLNKTVADFMTPKARLVTVKRNASRDEIFGLMHTHRVEKVLVVSDDFKLKGMITLKDYQKSEQKPQACKDEFGRLRVGAAVGAGPGNEERIDALVKAGVDVLLIDSSHGHSEGVLQRVRETRAKYPDLPIVAGNVATAEGAIALADAGASAVKVGIGPGSICTTRIVTGVGVPQITAIADAAEALKDRGIPVIADGGIRFSGDISKAIAAGASCVMVGSMFAGTEEAPGEIELYQGRAFKSYRGMGSLGAMSKGSSDRYFQSDNAADKLVPEGIEGRIPYKGFLKEIIHQQMGGLRSCMGLTGCATIDELRTKAQFVRISGAGIQESHVHDVTITKEAPNYRMG

SEQ ID NO: 10111 - protein, 370 aa, Pasteurella multocida
MGILFSDSLTDSQKQAIQNVFQQFQHPSLQKDLVSLNAIKKIEKGGETLRIEISMPFAWNTAFEQLKSALSAELLTLAECKDIKWQLNYQIATLKRANSHPAVKGVKNIIAVTSGKGGVGKSTISVNLALALQKQGARVGILDADIYGPSIPHMLGVADQRPTSPDNQHITPIQAHHIFANSIGFLMEPDNATIWRGPMASSALSQLLQETLWPDLDYLVIDMPPGTGDIQLTLSQQIPVTGAVVVTTPQDIALLDAIKGVAMFERVSVPVLGIIENMSMHICSNCGHQETIFGTGGAERIAQKYNVKVLGQQALHIRLREDLDKGIPTVVAAPESDIAQSFMQLAEKVATELYWQGSVIPSEIMFKEVK

SEQ ID NO: 10112 - protein, 618 aa, Pasteurella multocida
MKNIKYFAQKYVDWVIRLGRLRFSILGVIVLAILALCTQALLSLFIIGEVYWVDMIRSVVFGLISAPFVIYFFTVLVEKLERSRLGLAKMVENLRKEVSERVLAEKKLSIALDNIEKTSRDKTRLMATISHELRTPLNGIIGLSRILLDEKLTETQQNYLKTIHVSAISLGHIFSDIIDLEKIDARRIELNAKAVELNSFLNDISNVARLLAQQKKLAFQLVTDKNLPTWFMVDYARLSQILWNLIGNAVKFTQEGRITLNVKRVSEYQISFSVSDTGIGIPANELPRVFEMYYQVQSSGHKPLGSGIGLAISQTIAQLMGGDLYATSEMGKGSCFTLMLPVKEVEKPVRVQNQMPSTLNILLVEDIEVNVVVAKSVLEKLGYVVDVAMTGQQAIEKFEQQYYDLLLLDIQLPDMSGFAVAKYLREGYEDGRYDFLPPLIALTANVMHDKKEYQAQGMDDVLRKPLSIEELTACLVEYFGHDVSLCLETPTTHQITQDATHFDVKMLSELVEMLGTDFVLKNLALFKETMPEYMQALMTAYSVYQQDESQKADVLSCAHKIKGAAASVGLKRIQQIAAQAQDPEQGEWTENIHDWVQQLAQYWLLDVEALERYLNKSV

SEQ ID NO: 10113 - protein, 441 aa, Pasteurella multocida
MNIYTYICFLSAISIFIGFVTRKLSDKIQYTIAITATSIIVSVLFLIFGHLSWFKLDIIATQVMEQLDFKSFLLNGILGFLLFAGALGIKLPVLKNQKWEITVFALFSTLASTFIIGVLLYSVAYLIGLPIDLIYCILFGALISPTDPIAVLAIIKNLKAPKRLSMQVEGESLFNDGVGLVIFTTIFAVAFGGHAPTLAGITELFLQEAVGGILFGLVIGFVAHLLISSTDDGSLEILLTLTIPTAGFMLANMLHVSGALAMVVAGILIGNWTRHTGFSKQSQLYLDHFWEMIDHFLNSLLFLLIGLALLLVDFGAQGFILLILAIPICLIGRYISVWMPFKVMQRFRSYNPYTLRILTWGGLRGGLSLAMALSIPKGMLYLEHIGMDVRDLLLVMTYAVVTFSILVQGSTIETMIKKSKESILHQRGYVGLHPNKTSSED

SEQ ID NO: 10114 - protein, 614 aa, Pasteurella multocida
MQNYPLLSLINSPEDLRLLSKEQLPQICQELRAYLLESVSQSSGHLASGLGTVELTVALHYVYKTPFDQLIWDVGHQAYPHKILTGRRDQMSTIRQKNGIHPFPWREESEFDVLSVGHSSTSISAGLGIAVAAQRENAGRKTVCVIGDGAITAGMAFEAMNHAGALHTDMLVILNDNEMSISENVGALNNHLARLLTGSFYSSIREGGKKILSGMPPIKEFVKKTEEHVKGFVSPVGTMFEQLGFNYIGPIDGHNIEELISTLKNMRALKGPQFLHIMTKKGKGYAPAEKDPIGFHGVPKFDHLSGQLPKSNTTPTYSKIFGDWLCEMAENDPKLIGITPAMREGSGMVEFSNRFPQQYFDVAIAEQHAVTFAAGLAIGGYKPVVAIYSTFLQRAYDQVIHDVAIQNLPVLFAIDRAGVVGADGQTHQGAFDISFLRCIPNMVIMTPSDENECRQMLYTGYKLNQPAAVRYPRGNAIGVELTPLTMLALGKSNLIREGEKIAILNFGTLLPTAINVAEKLNATVIDMRFVKPIDVERIHQIAQTHDLIVTLEENVIQGGAGSAVAEVLHSQQHQTKLLQLGLPDFFIPQGTQQEILADLHLDEAGIETQIKNFL

SEQ ID NO: 10115 - protein, 464 aa, Pasteurella multocida
MKFIDFSAYKVEAKKLLLIALPILLAQIAQNSMGLVDTIMSGRVSSADMAAISVGASIWFPLVLFGHGLLLALPPTISYLNGSGKRDQIAHQVRQGIWIILFSCLPLGILIYYSNLVFDYMQVEDHLKEITIGYLHAMIWGLPAYLLMINFRCLNDGIAKTKPAMVITFLGLGLNIPLNYIFIYGKLGIPAFGAVGCGIATAIVNWFMCILMIAYCKNARNQRDLKVFAKILEKPNFTTLKKLLNLGFPIAVALFCEVALFALTALLLSPLGTDIVASHQIALNTSSFLFMLPMSLGMAATILVGQRLGEGAADKAKQVSYSALIVGLLIAVITATLTVIFRVEIAEIFVKDRDVIAMAGTLLLIAALYQFSDTVQVVAGGALRGYKDTKAILYITLFCYWVVGMPMGYTLARTDLLMPALGAEGFWIGFVVSLTIAATLLMIRMRKIQAQPDAILFAKLEKLK

SEQ ID NO: 10116 - protein, 204 aa, Pasteurella multocida
MHHLIIFAHPNSQTSFNRAILEATLQASQQLDVHTVVRDLYTLNFNPILSWEEMQAVYQEIIPAEVKFEHQLIEQANLITLVYPLWWMGFPAILKGYLDRVLSYGFAYKTENEQSVGLLGGKKMQHFITIGNNVEIYQNMGFAQSLKDCLVDGLFNYCGITDIQHELFGDIHLIDDHARHAMLQRVSEKTQENLTALLERKYDN

SEQ ID NO: 10117 - protein, 575 aa, Pasteurella multocida
MISGIPASPGIVFGKALVLKEEKIVLDMQKISESQIDSEIARFYQGRNAAVEQLSAIRDRAAKTLGEEKAAIFEGHLMILEDEELEEEIIDYLRTNKVNAGVAASKIIDQQVTMLSEIDDEYLRERAGDIRDIGNRLIKNILGMHIVDLGDINEEAILVAYDLTPSETAQLNLDKVLGFITDIGGRTSHTSIMARSLELPAIVGTNHVTSQVNTGDYLILDAVNNVVYVNPSQDEITRLKGLQQKLLEEKAELAKLKDLPALTLDGHRVDVVANIGTIRDVDGADRNGAEGVGLYRTEFLFMDREQLPTEEEQFVAYKDVVEAMNGRLVILRTMDIGGDKELPYLNLPKEMNPFLGWRAIRIALDRREILHAQLRAVLRASAFGKLAVMFPMIISVEEIRELKSVIETLKQELRNEGKAFDESIQIGVMVETPSAAVNAKFLAKEVDFFSIGTNDLTQYTLAVDRGNELISHLYNPMSPSVLSLIKQVIDASHAEGKWTGMCGELAGDEKAAVLLLGMGLDEFSMSAISVPRIKKLIRNVNYEDTKALAMKALQQPTAVEIEQLVEDFLAEKALN

SEQ ID NO: 10118 - protein, 333 aa, Pasteurella multocida
MKTLGQFIVEKQAEYPNAKGELSGILSSIRLVAKVIHRDINKAGLTNNIIGTSGAENVQGETQMKLDLFAHNTMKQALISREEVAGFASEEEENFVAFDTERGRNAKYVILTDPLDGSSNIDVNVAVGTIFSIYRRVSPIGTPVTLADFMQPGNRQVAAGYIVYGSSTMLVYTTGNGVNGFTYDPSLGVFCLSHENIQIPANGKIYSINEGQYLKFPQGVKKYIKYCQEEDKATHRPYTSRYIGSLVSDFHRNMLKGGIYIYPSATNYPNGKLRLLYEGNPMAFLAEQAGGMASDGYQRILDIQPTELHQRVPLFLGSKEMVEKAQDFMKTFG

SEQ ID NO: 10119 - protein, 276 aa, Pasteurella multocida
MTLAKDKLPATFPQPTEVQYLVCCDMDETYIPYHPDNQVTSGITELEHFLLEEGKKKGILLGWITGTNKTSALRKAKRTISQSPHFLCCSLGTEFYWITQGEFVPSTTWQQRIATSGYQQQKVDQIVEQILAQGIRLDRQPEDYQGPYKTSFYYLIRDEMEKDIAWIRSLAEQAQLRVLITRANPAAGDPENSYDVDFIPKCCGKDQAILFLMEELKLDKQQVLAFGDSANDFAMFAVAGNGYLVANADKHAIERYGKCLDKPYCHGILSVLRQLP

SEQ ID NO: 10120 - protein, 199 aa, Pasteurella multocida
MLDVKILAQYAGLIFDMDGTVVDTMPCHERAWLKVADKVGYPLSPSVMYELAGAPLRTIAQEMMLRANMPLTQLQEVMKLKRQFGHALIMAEATLLPAAEIVKSYHNQKPMALGTGSHREITHKLLNKLEIAHCFDAVVTSEDVAKHKPEPDTFLRCAELIGVNPQTCLVFEDADLGVQAGLAAGMHVFDVRTHTLITE

SEQ ID NO: 10121 - protein, 622 aa, Pasteurella multocida
MDQNPQSQLKLLIAQGKEQGYLTYAEVNDHLPEELVDAEQIEDIIQMINDMGIQVLESAPDADDLMLNETIADEDAVEEATQVLSSVEAEIGRTTDPVRMYMREMGSVELLTREGEIDIAKRIEEGINEVQSAIAFYPEAISYLLDQYALVEEGGVRLADLITGFVDPNAMTESDVAEIEDTFDEDEDSDSVSATLNEEEEEEEESEEESTTDDSDSDNSIDPEVAREKFLELKTQHAKAVAMIEKHGRTSKKSKDQIQALADVFTQFRLVPKQFDTLVNLMSNMMKSVRLQERSIQKIVVDKAKMPKEQFQKVFIGHENKDTWLVKALSSGKTWSEKLAKHEEEIRYYIDNILEIERQTNLTVSQIREVCERISAGELKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREASPEELAERMGMPEDKIRKVLKIAKEPISMETPIGDDDDSHLGDFIEDSTLELPLDSATAQSLKVATHEVLEGLTPREAKVLRMRFGIDMNTDHTLEEVGKQFDVTRERIRQIEAKALRKLRHPSRSETLRSFLDE

SEQ ID NO: 10122 - protein, 416 aa, Pasteurella multocida
MDYFQYQQAQLMAEQVPVKHIAQQYGTPLYIYSRATLERHWHAFNNALGDHPHLICFAVKSNPNIAILNIMARLGSGFDIVSQGELERVLAAGGEPSKIVFSGVAKTETEIARALEVGIRCFNVESVAELYRINQVAGEMGKTAPISLRVNPDVDARTHPYISTGLKENKFGISVAEARNVYQLANQLPHIQITGMDCHIGSQLTELQPFLDATDRLIVLMEQLKQDGIQLKHLDLGGGLGVPYTNENPPHPSEYASALLDKLKAYHELEIILEPGRAITANAGILVTKVEYLKHNEDRHFAIVDAGMNDMIRPALYQAYMNIIEVDRTLTRDKAVYDVVGPICETSDFLGKQRELAIAAGDYLAQRSAGAYGASMSSNYNSRSRTAEVMVDGDQVHLIRRRETLEELWALERLLP

SEQ ID NO: 10123 - protein, 264 aa, Pasteurella multocida
MPLAVWTDIRQEAKTLAENEPILASFFHATILKHHNLGNALSYILANKLANTIMPAIALREIIEEAYQADPDIIASAACDIRAVRQRDPAVELYSTPLLYLKGFHALQSYRITHYLWQQERKALAVYLQNQISVAFDVDIHPAAKIGCGIMFDHATGIVVGETSVIENDVSILQGVTLGGTGKECGDRHPKVREGVMIGAGAKILGNIEVGRYAKIGANSVVLQPVPEYTTAAGVPARVIARDQAAKPAFDMNQYFNDDHASKV

SEQ ID NO: 10124 - protein, 337 aa, Pasteurella multocida
MNRALAIEFSRVTEAAALAGFAWLGRGDKEAADNAAVQAMRLMLNQVEMDAEVVIGEGEIDEAPMLYIGEKVGNGKGEQISIAVDPIEGTRMTAMGQANALSVLAAGGKETFLKAPDMYMEKLVVGPEVKGMVDLNLPLEQNLRRVASKMGKLLSQLTVITLDKPRHHEMIKRMQQLGVKVLAIPDGDVAASILCCLPDGGVDMLYGIGGAPEGVIAAAAVRALGGDMQARLLPRDHVKGDTPENQALAAEEIRRCQEMGIEVNQVLKLEDLVRDDNLVFSATGITNGDLLKGIHRKGNLATTETLLIRGRSRTIRRIQSVHYLDRKDTALYRIIGA

SEQ ID NO: 10125 - protein, 486 aa, Pasteurella multocida
MIKHWINGKEVASEETFDNFNPATGEVICQVASGGEKEINAAVQAAKDAFPKWSKTPAKERARLMRKLGELIDQNVAKLAELETLDTGLPIHQTKNVLIPRASHNFDFFAEVCTRMNGHSYPVDDKMLNYTLYQPVGVCGLVSPWNVPFMTATWKTAPCLALGNTAVLKMSELSPLTANELGRLALEAGIPEGVFNVVQGLGSTAGHALVTHDDVRAISFTGGTATGKHILKHAGLKKYSMELGGKSPVLIFDDADLDRALDAALFTIFSLNGERCTAGSRIFIQETVYDEFVKQFAARAKRLIVGDPQDFNTQVGSMITRQHYDKVTGYIRIGLEEGATLLAGGLERPQNLPAHLQKGHFIQPTVFADVDNRMRIAQEEIFGPVVCLMKFKDEAEALRLANDVEYGLASYIWTKDIAKALRLSNGIEAGMVFVNSQNVRDLRQPFGGIKASGIGREGGEYSFEVFAELKNVCISMHDHPIPRWGL

SEQ ID NO: 10126 - protein, 486 aa, Pasteurella multocida
MGGISMQQFSLLKTKAYINGEYVQAKEHKTFAVTNPANQQIICELPDLSAEETEYAIACAAQAQKKWQKVTPKERANLLRRWYNLVIENQEELAQLLSLEQGKPINESRGEILYGASFIEWFAEEAKRIYGDVLPQDKENHRLLVIKQGIGVVAAITPWNFPNAMITRKAAPAFAAGCAMVLKPAQETPLSALALAELAHQAGLPAGLFNVITSTRSVEIGKVLTEHPTVRKVTFTGSTRVGKILMAQSASTVKKLSLELGGNAPSIVFDDADLENAIEGIIASKFRNSGQTCVCTNRIYVQAGIYDRFVELFSAKVAAFKVGSANEAGVNIGPLISQSAVNKIQEHIDDATAKGANLVIGGKLHTRGGTFFEPTVLRDVTQAMLVAKDETFAPLAPVFKFDTEAQVIEMANDTEFGLASYVYTQDISRIWRVSEALEYGIVGINEGLISNEMAPFGGVKESGLGREGSRYGIDEFLEIKYLCLKV

SEQ ID NO: 10127 - protein, 281 aa, Pasteurella multocida
MNKDTQTMMLVPQGSIEAYIRAANEYPMLTAEEEKELAERLYYQEDLEAAKKLILSHLRFVIHVARGYSGYGLPQADLIQEGNIGLMKAVKRFNPEVGVRLVSFAVHWIKAEIHEYVLRNWRIVKVATTKAQRKLFFNLRKTKQRLGWFNENEVEMVANELGVSPADVMEMESRMTGADVAFDLPTDDNEETYSPSLYLEDKGSNFAAELENENYEAQATEQLSVALEGLDERSLDIIKARWLDENKATLQDLAAKYNISAERVRQLETNALKKLKSAVNF

SEQ ID NO: 10128 - protein, 301 aa, Pasteurella multocida
MTNKQGYGYFCLLLATFFWGGNYLFGKILSTDIPPIVLNYARWFPAALILLLLFSKRSCQFTPVIRQHWRILIALSLLGIVIFPVFLYQGLQTTTSLNASIYLAVVPIFVLFLNRLVFGDPINFTGLTGALFSFVGVLWLLSRGDIQRLTQLEVNQGDLWALGSALSWSIYCCLIRLKPAQLPNTVLLTTLVCMAMLLFTPLFIWQYQQLPPAFFSTLTPTQYSIITYLIIGPSILSYGFWNYGISLVGADKGAAFTNATPLFAALLGVLVLNEALAFYHMISAGLIITGLLLCNRKSCSS

SEQ ID NO: 10129 - protein, 668 aa, Pasteurella multocida
MTFFKQLQQRSTLKAPIFFPSLFFIIFVTLYCSFFPQHAQGTLNVVKQQIFSHFSWFYVLAVSIFIVFLVLLCTSRLGDIRLGSDNEEPEYPFLSWIAMLFAAGMGIGLMYFGVAEPMLHYANPLHQGMTAAEKTKEAMLMTFYHWGIHAWAIYAVIGLALAYFGFRYKLPLTIRSGFYPLLKQRISGFWGHVIDVCALCSTIFGITTTLGYGAMQLDAGLNSLGWIDSRSFSTLSLLIILVMCFATISAITGVAKGVRRLSEINLFFALILMLFVIVLGPTLLLLTSFTENLGYYLSNLVSLSFRTFAYEPENQGWFSGWTVLYWAWWVSWAPFVGLFIAKISKGRTIREFILGVLFIPSLFNALWMTTFGNSAIWLDGETAGNLTALAGNTEALLFGFFDLLPFGNIASFIAIVIIALFFITSADSGIYVINSIASQGEENSVKWQSVFWAILLAVLAIALLRSDGLSALQTMTLVIALPFTMIMLLLCFGLWKGLMVDNQYFSKTFSQGSSNWTGKHWKLRLEKILSQSKRADVRNFIDEIAQPAFYELVAEFEKHGLTAQVDMIAGKKPKIEFVVMKENLRNFLYGIECQFRELSTLVVEDEAMPNIDSKRSYEPITYFIDGREGYDVQYMTKDELIADVLKQYERYMNLAMDKTNALMTYDVA

SEQ ID NO: 10130 - protein, 433 aa, Pasteurella multocida
MAKIVKVIGREIIDSRGNPTVEAEVHLEGGFVGLAAAPSGASTGSREALELRDGDKARFLGKGVLKAVAAVNNEIAQALVGKDATNQAEIDQIMIDLDGTENKSKFGANAILAVSLANAKAAAAAKGMPLFAWIAELNGTPGQYSMPLPMMNIINGGEHADNNVDIQEFMIQPVGAKTLKEALRIGAEVFHNLAKVLKGKGLSTAVGDEGGFAPNLESNAAALACIKEAVEKAGYVLGKDVTLAMDCASSEFYNKENGMYEMKGEGKSFTSQEFTHYLEELCKEYPIVSIEDGQDESDWEGFAYQTKVLGDKVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALGDKAPFLGLKAVKGQA

SEQ ID NO: 10131 - protein, 242 aa, Pasteurella multocida
MQGKIALVTGATRGIGRAIAEELSAKGAFVIGTATSEKGAESISAYLGEKGKGLVLNVSDLASIETTLEKIKADFGEIDILVNNAGITRDNLLMRMKDEEWFDIMQTNLTSVYHLSKAMLRSMMKKRFGRIITIGSVVGSMGNPGQTNYCAAKAGLIGFSKALAKEVASRGITVNVVAPGFIATDMTDVLTEEQKAGILSQVPAGRLGDPKDIAKAVAFLASDDAGYITGTTLHVNGGMYTN

SEQ ID NO: 10132 - protein, 515 aa, Pasteurella multocida
MKRRDFLRYGIGISLASSSLYSLANMMNHAQHGNMAMMHSVPTGLMPTEAMPSGLSLNGILPKLANQSTQAGLFTATLKAEPIKIRLADNKETEFWAYNGQLPGPQIEVFEGDTVEIEFINHLPQPSTVHWHGLDVPNEADGNPMDMVEPQGKKVYRFTLPQGSAGTYWYHPHPHDHVSEQVYKGLAGTFVVKAKNDPLAHLPEQHWVISDLRLNADGTIPANTMLDWMNGREGEFVLINGQYQPQIQVKTNERIRLWNATSARYFRLNIPGVKWIVVGTEGGLLEKPRAPVDELLLTPAERVEVIMVGETQGTVNLQSGYYDRRKMMVQEQPKDLTLATIQVKSEPVQLPESLRSLPNWDEPKQVRQIRFSEKMMNHTNMPMMNHGTHHATTTPTDNPIPPMMNGMFLINGQTFDMNRIDFVAKLNEVEQWEIFNESHMDHPFHLHGTQFEVIQHTLNGKTFKPEGRALKDVVNLRPYEKVIIRFKQGHTGLKMYHCHILEHENLGMMGMFKVE

SEQ ID NO: 10133 - protein, 405 aa, Pasteurella multocida
MSISYFMKKIVILGSTGSIGTSTLSVITHNPDKYQVFALVGGRNVELMFQQCLTFQPSFAALDDDVAAKMLAEKLKAHQSQTTVLAGQQAICELAAHPEADMVMAAIVGAAGLLPTLSAVKAGKRVLLANKEALVTCGQLFIDAVRESQAQLLPVDSEHNAIFQSLPPEAQRQIGFCPLSELGISKIVLTGSGGPFRYTPLEQFEQITPAQAVAHPNWSMGKKISVDSATMMNKGLEYIEARWLFNASAEEMEVIIHPQSIIHSMVRYIDGSVIAQMGNPDMRTPIAETMAYPSRTVAGVEPLDFYQLNGLTFIEPDYQRYPCLKLAIDAFSAGQYATTAMNAANEIAVASFLDNKIKFTDIARLNQLVVSKLQPQKIHCIEDVLEVDKKARELSQSIILSFSHP

SEQ ID NO: 10134 - protein, 112 aa, Pasteurella multocida
MKKIEAIIKPFKLDDVRESLSDVGITGMTVTEVRGFGRQKGHTELYRGAEYMVDFLPKVKMEIVVTDEQVDQCIEAIMETAQTGKIGDGKIFVYDVERVIRIRTGEENEDAI

SEQ ID NO: 10135 - protein, 241 aa, Rickettsia prowazekii
MSEIAIVTGGTRGIGKATALELKNKDLTVIANFFSNYDAAKEMESKYGIRTKCWNVADLEECKKAVNEIEEEFKKSVSILVNNAGITKDKMLHRMSNQDWTDVINVNLHSCFNMSSSVMKQMRNQNYGRIVNISSINAQAGQIGQTNYSAAKAGIIGFTKALARETASKNITVNCIAPGYIATEMVNTVPKDILTKIVNSIPKKRLGQPEEIARAVAFLVDKNAGFITGETISINGGHNMI

SEQ ID NO: 10136 - protein, 498 aa, Rickettsia prowazekii
MSTSKSENYLSELRKIIWPIEQYENKKFLPLAFMMFCILLNYSTLRSIKDGFVVTDIGTESISFLKTYIVLPSAVIAMIIYVKLCDILKQENVFYVITSFFLGYFALFAFVLYPYPDLVHPDHKTIESLSLAYPNFKWFIKIVGKWSFASFYTIAELWGTMMLSLLFWQFANQITKIAEAKRFYSMFGLLANLALPVTSVVIGYFLHEKTQIVAEHLKFVPLFVIMITSSFLIILTYRWMNKNVLTDPRLYDPALVKEKKTKAKLSFIESLKMIFTSKYVGYIALLIIAYGVSVNLVEGVWKSKVKELYPTKEAYTIYMGQFQFYQGWVAIAFMLIGSNILRKVSWLTAAMITPLMMFITGAAFFSFIFFDSVIAMNLTGILASSPLTLAVMIGMIQNVLSKGVKYSLFDATKNMAYIPLDKDLRVKGQAAVEVIGGRLGKSGGAIIQSTFFILFPVFGFIEATPYFASIFFIIVILWIFAVKGLNKEYQVLVNKNEK

SEQ ID NO: 10137 - protein, 318 aa, Rickettsia prowazekii
MANLHQQQIIDKIQNITFKDGTFLNEVISDIIIKGNNIGFSIDISGKNKLEAEEIRLKAINKLNNIKEVNKITIVFTQSKTIDKKAQKPKHFVENVKKIILVASGKGGVGKSTISALIAQQLSLENYRVGIVDADIYGPSIPHIFGINGIPKTVEGRIVPILAQNIQIISIGFFVKAHSAIIYRGPMASKIIYQLLSNTRWNNLDYLIIDMPPGTGDIHLSIIENYHLDGVIVVTTQQKISEIDVIRSIDLYRKLGLPILGIIENMIYMLESDHCGYLSKKYHIPLIAQIPIMPQIANACDKSLPLTNLLTLPLEKYL

SEQ ID NO: 10138 - protein, 497 aa, Rickettsia prowazekii
MNHNKYIVRLSFIILFLNIVINMLFYRYFMIKEMIIKQVALEHTKIVELYTDNIWNIHKNVISKLHKFDYLKLLQDQDFINFVKITAQWFTNLNINISLYDLKGNKFITSNMLHMYSVDNYKDDSLIEIVITKIDKIFLKSFTSAAPLRDAFKGITSHILLPKVVIENESDLTIEHASFVTSYIPVIDHNLDFPVDAVFEINTNITSQWKNITSLEQKVFITFIIIFIIFCTIIISNTNYARQIIEEQLETNRNLKAQIEKVEKTSSSNTKFFANISHELRTPLNAIIGFSEILMSERDTEKSKNYIKDIHDAGKHLLSMINDILDLSKASADKLKVDNIDLDLNKLISSSLILIKPRAYQAEVELISRLPKEHVVINADPKRLKQVLLNLLSNAVKFTNSGGSVTISLEKDELAKLVYIKVIDTGIGIEEKDIPKTLSAFGQIDSELSRKYEGTGLGLPLTKKLVELMNGKFDLQSKINKGTTVTITFKYDGSIEI

SEQ ID NO: 10139 - protein, 326 aa, Rickettsia prowazekii
MQITVREALRDAMQEEMLRDEKVFVIGEEVAEYQGAYKVTQGLLEQFGSKRVIDTPITEYGFAGLAVGAAFAGLRPIVEFMTFNFAMQAFDHIVNSAAKTHYMSGGQVKCPIVFRGPNGAASRVAAQHSQNYTACYSHIPGLKVVAPYSAEDHKGLMLTAIRDDNPVIFLENEILYGHSFDVPDIIEPIPFSKAKILKEGSNVTIVTFSIQVKLALDVVNILQNDNIDCELIDLRTIKPLDTDSIIESVKKTNRLVIVEEGWFFAGVGASIASIVMKEAFDYLDAPIEIVSGKDVPLPYAVNLEKLAMPSANDLIEAVKKVCYYSI

SEQ ID NO: 10140 - protein, 293 aa, Rickettsia prowazekii
MTNNINALAISSESGFYSYLQKINKIPSLTQEEEFLLAKSYLEENDLQAAHKLVTSHLKLVAKIASSYKTYGLPITELVSEGNIGLMQAVKKFNPELGFRLSTYAMWWIKASIQEYILKSWSLVKMGTTAAQKKLFFSLNKVKHKITNLYSRAITTDDFAQIADELGVSVNEVSEMNTRISGPDLSLNNSINSDDVESGELIELLPELRPTPEAMAINKQNYTSKRKLLSNAMQILNDRELRILKDRKLTDTPKTLDILSSEYNISKERIRQIENTAFEKIKKFILNNNREIA

SEQ ID NO: 10141 - protein, 507 aa, Rickettsia prowazekii
MNIVDSNCTIWHKARNSKFRHIVWPIRSYELTKFIPMTLLMFFILLNQNLVRSIKDSFVVTLISSEVLSFIKLWGEMPMGVLFVILYSKLCNIMTTEQVFRIITSTFLFFFAIFGFILFPYKEFFHPNPELINQYIIVLPHLKWFLIIWGQWSLVLFYIMGELWPVIVFTLLYWQLANKITKVEEAPRFYSFFTLFGQTNLLFSGTVIIYFAKSEHFLLPLFAHLNDTNEILLKSFITVILISGLICLALHKLIDKSVVEADKNIKFKNQRTDILKLSLLESAKIILTSRYLGFICLLVMSYSMSINLIEGLWMSKVKQLYPATKDFISYHGEVLFWTGVLTLVSAFLGSSLIRIYGWFWGAIITPIMMFVAGVMFFSFTIFEQHLGNIVNTLGYSSPLVIIVFIGGLWHVFAKSVKYSLFDATKEMVYIPLDNEIKTKGKAAVDVMGAKIGKSIGAIIQFISFSIFPNAVHNDIAGLLMVTFIIVCILWLYGVKVLSQNYNKMIKR

SEQ ID NO: 10142 - protein, 501 aa, Rickettsia prowazekii
MLPPKIFFEKVKEIIWPIERKELKLFIPMALMMLCILFNFGALRSIKDSLVVPSMGAEIISFLKLWLVLPSCVIFTILYVKLSNKLNFEYIFYSIVGTFLLFFLLFAYIIYPNQDIYHPNDAMINNLIASYPNLKWFIKIGSKWSYALMYIFSELWSAVVINLMFWQFANHIFDTAKAKRFYPVLGMVGNIGLIIAGSVLVFFSSGQYIIDSELLTDSYNSSSNNSIMLQPIISIIVTAGIIAMFLFRIINKFILTNSINVLDVKKVAAKTKTKLALIESIKLIIHSKYIGRIALLIICYGLLINIVEGPWKAKIKELHPNTVDYVNFMGMFNIWMGISCVTFMIIGSNILRRLGWLISALLTPIMLSITGFMFFIFIIFIEEIGTCFGDFNLLYVAIIVGAIQNILSKSSKYSLFDSTKEMAYIPLSLELRTKGKAAVEVIGTKFGKSLGAFIQSLIFIIIPTATFDSIIIYLLVIFIVMMNLWIWNIIKLNKEYIKLCQ

SEQ ID NO: 10143 - protein, 880 aa, Rickettsia prowazekii
MNKLIYYFGNNGSDGNASMNNILGNKGAGLAEMSNLKLPIPNGFTITTELCNYFYKHNNNFPKNFQNELQQAISKLEVTTGKIFGSTTSNPLLLSVRSGSTVSMPGMMDTILNLGMNNEVCNALADACGNKLFALDSYRRFLEMYGSTVLSIPSDLFEQIYENHKIQADIYKDSDITVELLEKIIDDFKRLHIKYDKQLINDPYEQLESAIKAVLYSWKNNRAIIYRKLNNISEDFGTAINIQEMVFGNLGKTSATGVAFTRSPSTGEKKLFGEFLINAQGEDIVSGTRTPMPIIANDSNSMQAMMPEVFKELSQIAKKLEEHYLDMQDIEFTIENNKLYILQTRTAKRTAIAAINIAVQMVKEKLISKEQALMRIDPESLNQLLHTRIDYSKGLTSIAEGLPASPGAATGIVVFSPYDAEKLSHHHKVILVRHDTSPEDINGMHVSSGILTIRGGMTSHAAVVARGMGKPCVCGTNNLSIDEQKQILIAGDIVIKQGDIITIDGGSGKIFLGEMPLIQPTFSEESKLILDWADEISSLKVRANAETVNDALVSIKFGAQGIGLCRSEHMFFDKNKIPLVREMIIAPDIERRQCALQKLLPLQTEDFKSLFRVMKNKPVNIRLLDPPLHEFLPTTEEDKKNLANSLNLPLSMIHQRLHAMHEVNPMLGHRGCRLGICLPEIYQMQIEAIFTAIFELHKKEHIESNLELMIPLISNVAEIKKLKMYIYEVVQELEQRYSYKFSFTLGTMIELPRAALESKKIAKEVDYFSFGTNDLTQTTYGISRDDIASFLPYYLEEKIFESDPFTTLDEEGVGELIEIAIKRGKSSNANLKLGACGEHAGNPTSIAFFHKANLNYVSCSPYRIPIARIAAAQAKIKQGS

SEQ ID NO: 10144 - protein, 512 aa, Rickettsia prowazekii
MTINASNIENSFSKINSHFSKLTDYIWPIKRHEISKFLFITLLMFCILFIQNLIRALKDSIVTTMIGAETISFLKFWGVMPSAFLITVIYVKLVNRMKAENIFYLIISIFLTFFALFAYVIFPNHEMLHLRPVTVHNLTASLPNLKWFILLLSKWSFSLFYIIAELWPNVVFALLFWQFVNNITTVEESKRFYPLFGLLSQTGIYLAGHFLENLSNINYYVTNKFALQSSFHTLSIQIILTIVLILGIVSIKTFWLLNHKVLDKKHMALLRFKTKNKSITIAKSFQMILSSRHIRLIATLLICYGIAINLVEGPWKAAATKIYKTPTEYAAFIGSYLSYTGVFTIFFVLLGSNIVRRMGWFTSAVITPSIVFITGILFFAVNNFEGFAGLIIANFILTDPALVAITIGAIQNVLSKSSKYTLFDSTKEMAYVPLEPEIKISGKAAADVIGTKLGKSGSAFLQSLIFIILPSASYQSISICLMIIFILTCVTWIWATKELNKEYKNSIKFSQK

SEQ ID NO: 10145 - protein, 500 aa, Rickettsia prowazekii
MLSTSPSRSFKNKFRAAFWPVHNYELGKFIPISALMFCILFNQNILRILKDSILISEISAEIAGFAKVYCVTPVAALFVIIYAKMINHLTFEKIFYYLSAFFISCFILFAFVIYPNIHIFHVHPDTLSDWMNKYPHFKWYISLVGNWGYIVYYSLAELWPNIFYVLLFWQFTNELTTTEEAKRFYTLFSLFGNSSLILVGFLMMNLSSEDTIIKKFISISDSKITLVQVSTTIIAIVAIICCLLVRFISKYIFTNPLFYHKTKSSRSTAQRMGLIKSFKYIVKSKYLWLLLICSAAFGFAINLVEAVWKAKIKELYPTVNTYAEFNSLYILWTGVAIIVMTIIGNNVMRMHNWFVAAVISPVIIMVTGVLFFGLIVFDQQILSLFDGAILMSPLALAVSIGGIQNILAKGTKYSIWDTSREMLYIPLDDELKTKGKAAVDVISAKVGKSSSGLVQSIIFTLVPNATFTSISPILMVVFTFVCFAWIYAVRKIYFEYQKIA

SEQ ID NO: 10146 - protein, 241 aa, Rickettsia prowazekii
MIDLTGKTSLITGASSGIGSAIARLLHKLGSKVIISGSNEEKLKSLGNALKDNYTIEVCNLANKEECSNLISKTSNLDILVCNAGITSDTLAIRMKDQDFDKVIDINLKANFILNREAIKKMIQKRYGRIINISSIVGIAGNPGQANYCASKAGLIGMTKSLSYEVATRGITVNAVAPGFIKSDMTDKLNEKQREAIVQKIPLGTYGIPEDVAYAVAFLASNNASYITGQTLHVNGGMLMV

SEQ ID NO: 10147 - protein, 148 aa, Rickettsia prowazekii
MEQALKQARLAFDKNEVPVGVVIVCRLNQKIIVSSHNNIEEKKNPLCHAEIIAINTACNLISSKNLNDYDIYVTLEPCAMCASAISHSRLKRLFYGASDSKHGAVESNLRYFNSNSCFYRPEIYSGILSEHSRFLMQEFFQRIRSAID

SEQ ID NO: 10148 - protein, 635 aa, Rickettsia prowazekii
MSNSNIDNDPAKIDSLLKKAKSKKIPVTYDDINKALPLNKNPSIRQLEEAILKFSDAGVDILESNEDDEIKLDIGMDEEFKLSTNVDNESEDEVEEENIGSTDDPVRLYLKDMGGVDLLTRENEVEIAKRIEEGRKTMTASLCRSPIAMRCFIVWYEDLVNEKMLLRDLIDLEANMLHDEVHENDEEHNSETEVEEHEDNHLSMSRVETQILHNIIDRMKKISFICEELLIEAKKCYEESFEPKVLQNSKKYNNNLELLINEVSEIHFNSKRTEEILGKMYGINRDLINKETAFLKLAEKYGVTRQNFLDEYIGSVINAAWKEKMLKNKKVAWKELITKESDYIDQMINELSVIESNTGLLVNDFKKLVNTIQKSERQTLQAKKDMIEANLRLVISIAKKYANRGLQFLDLIQEGNIGLMKAVDKFEYRRGYKFSTYATWWIRQAITRAIADQARTIRIPVHMIETINKILRTSRQMLNELGYEPTATEIANRLSMPLDKVRKVMKIAKEPISLENPVGDDSDGGQLGDFIEDKNAVAPIDAAIQSNLREVTTRVLATLTPREERVLRMRFGIGMNTDHTLEEVGQQFKVTRERIRQIESKALRKLQHPIRSKKLNSFRNGGKRGDGNPSDLLEA

SEQ ID NO: 10149 - protein, 253 aa, Chlamydia trachomatis
MKTHDLADTWQLYWSTKEIHHRDVLIESYLPLVKNVAHRLASGMPSHVKMEDLYALGVEGLIRAVERFDPEKSKRFESYALFIIKAAIIDGLRKQDWVPRSVYQRANRLADAMDSLRQTLGKEPTDGELCEYLNISQQELSHWFSSSRPALVLSLHDDFSCQDDDEGLALEERIADERAETGYDVIRKKEAISILTEALLALDEKERQVMALYYYDDLVLKEIGKILGVSESRVSQIHSKALLKLRGTLSSLL

SEQ ID NO: 10150 - protein, 528 aa, Chlamydia trachomatis
MTQTAEKPFGKLRSFLWPIHMHELKKVLPMFLMFFCISFNYTILRDTKDTLIVTAPGSGAEAIPFIKLWLVVPSAVVFMLIYAKLSNILNKQALFFAVLSPFVVFFALFPVVIYPCRHILHPTAFADTLQSILPSGFMGFIAMLRNWTFAVFYVLSELWGSVMLSLMFWGFANEITKISEAKRFYALFGVGANVALLISGPAIIWSSKLRASLGEGVDPWGVSLYFLMAMFLCSCAIIAACYWWMNRYVLTDPRFYNPAELKAKKSKPKMSMGESFSYLLRSPYMLLLALLVICYGICINLVEVTWKSQLKMQFPNPNDYSAFMGNFSFWTGVVSVFVMLFIGGNVIRRFGWLTGALVTPIMVLVTGAVFFALVIFRDHATGLVAALGTTPLMLAVVVGAIQNILSKSTKYALFDATKEMAYIPLDQEQKVKGKAAIDVVAARFGKSGGSLIQQGLLVVCGSIGAMTPFLAVALFAIIMVWLTSATKLNKLFLAASAAKEQELAEAAAAEKEASSAAKESAPAIEGVS

SEQ ID NO: 10151 - protein, 379 aa, Chlamydia trachomatis
MKHLALIGSTGSIGRQVLQVVRSIPDTFIIETLAAYGRNQEALISQIREFNPRVVAVREETTYKELRKLFPHIEILLGEEGLVSVATEPSVTMTIVASSGIDALPAVIAAIRQKKTIALANKESLVAAGELVTTLARENGVQILPIDSEHNALFQCLEGRDSSTIKKLLLTASGGPLRNKSKEELQKVSLQEVLRHPVWNMGPKITVDSSTLVNKGLEIIEAFWLFGLEAVEIEAVIHPQSLVHGMVEFCDGTILSVMNPPSMLFPIQHVLTFPERSPAIGPGFDFLSNRTLEFFPIDEDRFPSVHLAKRVLLEKGSMGCFFNGANEALVHRFLAGEISWHQIVPKLQALVDQHRVQSCLSLEEILSVDAEARARAQEC

SEQ ID NO: 10152 - protein, 248 aa, Chlamydia trachomatis
MSGLLVNKTAIVTGGSRGIGFSIAKLFAEQGANVQIWGINGEAGQAAAQTLSEQTGRQVSFALVDVSKNDMVSAQVQNFLAEYNTIDVIVNNAGITRDALLMRMSEEEWSSVINTNLGSIYNVCSAVIRPMIKARSGAIINISSIVGLRGSPGQTNYAAAKAGIIGFSKALSKEVGSKNIRVNCIAPGFIDTDMTKSLNDNLKNEWLKGVPLGRVGMPEEIAKAALFLASDGSSYITGQVLSVDGGMA

SEQ ID NO: 10153 - protein, 640 aa, Chlamydia trachomatis
MTYSLLPHIHSPQDLHALSLDKLPVLCDEIRNKIIESLSLTGGHLASNLGGVELTVALHYVFSSPDDQFIFDVGHQSYVHKLLTGRNTEAFSNIRHDNGLSGFTTPQESNHDIFFSGHAGNALSLALGLAKGSSNSSSHILPILGDAAFSCGLTLEALNNIPADLSKFIIVLNDNQMSISENVGNIPQGISHWMYPQKISKLSQKIHSWIQNLPSFLHKKKTLSHKVDIALKSLSHPLFEQFGLHYVGPIDGHNVKKLVQALQMIKDQPQPILFHVCTVKGNGLAEAERDPIRYHGVKAHFQNTSLKKTSGNVELQTPISFPQHAGNILCRLGKKYPQLQVVTPAMSLGSCLEDFRKQFPDRFTDVGIAEGHAVTFSAGIARSGTPVCCSIYSTFLHRAMDNVFHDVCMQELPVIFAIDRAGLAFHDGRSHHGIYDLGFLCSMPNMVICQPRNALVLERLFFSSLLWKSPCAIRYPNIPANEKASNSFFPFSPILPGEAEILCQGDDLLLIALGHMCNTALTVKEHLLDYGISTTVVDPIFIKPLDRKLLQSLLTHHSKVIILEEHSIHGGLGSEFLLFLNQHNIKADVLSLGVPDMFIPHGNPETILNLIGLTSDHITQRILSHFKFSTPIPIERFFKA

SEQ ID NO: 10154 - protein, 678 aa, Chlamydia trachomatis
MRHSVYQLDSAVENVFRLAWTLRFSERKMLLLSRQSGSGGSFQLSCAGHELAGVVAAKSLIPGKDWAFPYYRDQGFPLGLGCDLSEIFASFLARTTQNHSAGRMMPYHYSHKKLRICCQSSVVGTQFLQAAGRAWGVKNSGKSEVVYVSGGDGSTSQGEFHEMLNFASLHQLPLVIAIQNNQWAISVPFADQCGADLVALGNSYSGLATYEVDGGDVSALTQTFERAVSDARHRHIPALVIVNVVRLESHSNSDNQAKYRSEEDLSCCQAQDPLVRLEKSLLDDFGVAHEVIEQIKAELQETVNQACELAESAPFPCKGATKHEVFAPYNISLIDYENALETASLQKLEPRVMRDAITEALVEEMQRDPGVVVFGEDVAGNKGGVFGVTRTLTEQFGENRCFNTPLAEATIIGAAVGMAFDGFYKPVAEIQFADYIWPGINQLFSEAASIYYRSAGEWEMPIVIRTPCGGYIQGGPYHSQNIEAFLAHCPGLKVVYPSNAADAKALLKAAIRDPNPVVFLEHKALYQRRLFSTTPVFSSDYVLPFGQARIVHPGTDLTIVSWGMSLVMSVEVARDLLELGISVEVIDLRTIVPCDFATVCESVKKTGKLLVVHEASEFCGFGSELVALVAERAYRYLDAPIKRIGALHAPVPYSKVLENEVLPQKEKIFQEAKLLAEF

SEQ ID NO: 10155 - protein, 540 aa, Chlamydia trachomatis
MSSEVKSFSKFRGYFFPIYRSEFSKFIPLFFLAFFVGVNYALLKTTKDSLVLVGSRAGAEVIPFLKVWGIVPGAVIVTMIYGWMSRRYSRGTVFISLVGGFLGFFALFATVIYPIGDALHLNKLAAKLQSILPPGGRGFVVMVQYWSYSLYYVMSELWSSIVLSTLFWGVANHITSVREAGRFYALINTGLNLSSVFAGEVSLWLGRNPVIAFPMAVDPWHEVLLNITLLIVLAGGVILYLYQKLDRLMDETSMLKEGLAAEMSVAQLKKEKKRSKAKAKSLFALLLRSRYLLGIAVVVLSYNLVIHLFEVVWKDQVCRIYASRVEFNSYMSRITTLTGIVSALTGIFAAGQTIRRWGWTIGALVPPLTMLITGALFFGAIYAVKGDAMIFGGILGISPLVLTAWLGGVQNVFSRAIKFTYFDQTKEMAFIPLEDDEKNYGKAAIDGVISRVGKSGGSLVYQGLLIIFSSVAASLNAITIVLLLALGSWIFVIAWLGREYTAKTEALFRVNVSEEDVLQEEREASSLVDAESREEPVTTL

SEQ ID NO: 10156 - protein, 327 aa, Chlamydia trachomatis
MVAVKALLFACTLQTCVFKPCCDMAIFLIFLNAFIWSSSFALSKSAMEAAAPLFVTGSRMVLAGVVLFGLLLCKRESLRLPRPAIMPIVLLSVIGFYLTNVLEFIGLQGLSSSTACFIYGFSPFTAAFCSYVQLREVVTWKKLGGLSLGLVSYLVYLLFGGSEDVAEWGWQLGLPELLLIAATCLSSYGWTLLRKLGRRCESLSMTAINAYAMVIAGVLSLIHSAVTEVWNPVPVENPLLFLQAIGALVIFSNLICYNLFAKLLRSFSSTFLSFCNLVMPLFASFFGWLLLGESFPPGLLFAVGFMVLGCRLIYHEEFRQGYVLTSE

SEQ ID NO: 10157 - protein, 424 aa, Chlamydia trachomatis [sequence omitted]

SEQ ID NO: 10158 - protein, 571 aa, Chlamydia trachomatis
MRMDTLDSQAAEAAQEEEIQRKLEELVTLAKDQGFITYEEINEILPPSFDTPEQIDQVLIFLAGMDVQVLNQADVERQKERKKEAKELEGLAKRSEGTPDDPVRMYLKEMGTVPLLTREEEVEISKRIEKAQVQIERIILRFRYSTKEAVSIAQYLINGKERFDKIVSEKEVEDKTHFLNLLPKLISLLKEEDAYLEERLLALKDPALSKPDQARLNDELEKCRIRTQAYLRCFHCRHNVTEDFGEVVFKAYDSFLQLEQQINDLKARAERNKFAAAKLAAARRKLHKREVAAGRTLEEFKKDVRMLQRWMDKSQEAKKEMVESNLRLVISIAKKYTNRGLSFLDLIQEGNMGLMKAVEKFEYRRGYKFSTYATWWIRQAVTRAIADQARTIRIPVHMIETINKVLRGAKKLMMETGKEPTPEELGEELGFTPDRVREIYKIAQHPISLQAEVGDGGESSFGDFLEDTAVESPAEATGYSMLKDKMKEVLKTLTDRERFVLIHRFGLLDGRPKTLEEVGSAFNVTRERIRQIEAKALRKMRHPIRSKQLRAFLDLLEEEKIGSGKIKSYKN

SEQ ID NO: 10159 - protein, 163 aa, Chlamydia trachomatis
MCIEKDLFFMKKALDEARKAYEQDEVPVGCIIVHGDKIIARGHNSVEQLKDPTVHAEMICISAAAEYLENWRLKDTILYCTLEPCLMCAGAIQLARIPRIVWGAPDLRLGAGGSWLNVFLEKHPFHQVECCSGVCYQESEQLMKNFFLEKRKAKDEGRNSRAT

SEQ ID NO: 10160 - protein, 112 aa, Aquifex aeolicus VF5
MKKIEAIIKPFKLDEVKDALVEIGIGGMTVTEVKGFGQQKGHTEIYRGTEYVIDFLPKVKIEVVVRDEDVEKVVETIVKTAQTGRVGDGKIFIIPVEDVIRIRTGERGEQAI

SEQ ID NO: 10161 - protein, 476 aa, Aquifex aeolicus VF5
MIEKKMLIGGEWVDKEEKIEVIYPYTRKPIGRVPKGDEKDVEKAIERAKEGFKEIFSLTAYERYEILMRAAQLLKERAEEFAKTLVLEVGKTIREARTEVQRAIQTLIFSAEEAKRVNGETFPIDAHPNGKGKLGFYIRVPVGIVSAITPFNFPLNLSMHKVAPALAAGNAVILKPSERTPLTPLMLGEILLEAGVPPKALSVIPGYGDVGKAMTTHPDVRVVSFTGSRKVGDIIARQVGIKKLVLELGSNSAIILHKDGNLEKAVEKTVQGGYAIAGQVCISVQRVFVHEDLYDEFIKRLKERVSKLKVGDPMNEDTDLGPMIAPSELERIQEWISEAVQKGAKIEAGGLRCAEDETIFSPTIVSLVPEDSKLFKEEAFAPVVAVNPYKDIEEAIRWVNSSDYGLQVGVFTNDVKLAWKCIKEIEAGGVLINEGPTFRADHMPYGGVKYSGIGREGPKFAIEDYTEIKTVIFDLT

SEQ ID NO: 10162 - protein, 139 aa, Aquifex aeolicus VF5
MLSEETIRVIKSTVPLLKEHGTEITARMYELLFSKYPKTKELFAGASEEQPKKLANAIIAYATYIDRLEELDNAISTIARSHVRRNVKPEHYPLVKECLLQAIEEVLNPGEEVLKAWEEAYDFLAKTLITLEKKLYSQP

SEQ ID NO: 10163 - protein, 205 aa, Aquifex aeolicus VF5
MEELLAIVRKEKSYDVMKSLSEAEIPYVSWTVKGRGKEGGLRYKGLIKEKVLMPFLPKRAFLVFPEEGKVNEAVNLIVESAHTGAYGDGKVFLINQEVGVMKLVKAVIRPEKVYEVIKALESEGFKAMTMWDVVGRGKEGGILVGGTPYDELAKTLIMVAVKDEDVDKVIQSITKAAHTGAYGDGKVFVCSISKVWTIRTKEEEL

SEQ ID NO: 10164 - protein, 380 aa, Aquifex aeolicus VF5
MKLGVLGSTGSVGSQTLQVYENFRDEIELVGILANRASEKLLQQAKKYKPKYVVSYQEPAKEWLESLPEGVKYLKGDEGLKAIIEESERLMNAISGIYGIKPAYEVIKAGKTLLASNKESILCLGEIIRKNRERVIPVDSEHNALFQLLSSVKREEVKHVYLTASGGPFKDKSLEELKTASVEEALRHPRWNMGAKITIDSATLMNKGFEMLEAHFLFDFPIENIKVVIHPQSFVHGILELIDNSFLMHTSQTDMKIPIMHALFYPKRKEYPFKKVSLLELSPITFEKVDTTKFKAIDLAKWAGFMGGVYIPVLVGADEEAVNLFLNKKIGFLDIVDLIEQALSEVNIKDPQSVEEILEAVEWGRQKVREIYERKYAGKG

SEQ ID NO: 10165 - protein, 426 aa, Aquifex aeolicus VF5 [sequence omitted]

SEQ ID NO: 10166 - protein, 390 aa, Aquifex aeolicus VF5
MTKVVNYGEVQYGFAKRYFEEFLSERKGRIEKLLKPEKTPVLLMDIQGVKKKYLEVKYHFPEFNVYYAVKANDDESVIRALVEVGAGFEVASSQELEKVLRLGGKIEKVISSNPVKPPEFIEFAYQKGVRTFAVDSITEVKKIKDIAPRSKVYVRIAVPNEGSDWPLSRKFGVSVEEAVEILEYANDLGLVPYGITFHVGSQCNNLRNWFIAVKLSAQLWEKARAKGLKLQMLNMGGGIPVRYNYEALSVEDIAYYVKGLMRKYFPVQPYELQIEPGRGIVGDQGIMVTKVIGKAKRGSENWLYIDTGVFNGLAEALGGIRYPFFLEREGELKEWTIGGVSCDSMDVVAKNVYLPEPEVGDYLYILSAGAYTTVYASNFNGFPKPEVVPF

SEQ ID NO: 10167 - protein, 388 aa, Aquifex aeolicus VF5
MNILIGVCGGIASYKVCELVRELKRKGHSVKTILTPFAEKFMSPLTFQTLSGNKAYTDKDWEEEPLAHINLARWADVFLIAPATANTIAKIANGISDNLLTTTILAYGKPLLVAPAMNTVMYKSPSTQENLKKLKEWGHVIIEPEFGVLACKEVGEGKLASIDRLIDWIYYVSEEKPLKGKKVLITCGATKEFIDPVRFISNYSSGEMGFSLARIFRWKGAEVKVIAGTTTAKEPPEVEIIRVQTTEEMREKVLEHYDWADIVVMNAAVADFKPSKVSKEKIKKRDKILLELVKNPDILEELGRKKGYKILVGFALESDNLLEYAREKLERKNLDLIVANPVKVMGKKEHEGYLITKDQIVELPKGSKLENARFIVEFIIGNVLRGGE

SEQ ID NO: 10168 - protein, 628 aa, Aquifex aeolicus VF5
MLEKYEILKDYKGPFDIKNYDYETLQKLAQEVRDYIINVTSKNGGHVGPSLGVVELTIALLRVFNPPEDVIVWDIGHQGYPWKILTDRKEQFPTLRQYKGISGFLRREESIYDAFGAGHSSTSISAALGFRIGKDLKGEKEDYVIAVIGDGALTAGMAYEALNNAGHIRPDRFIVILNDNEMSISPNVGAISTYLNRIISGHFVQETRQKIKNFLQHFGETPLRIMKLTEEFLKGLISPGVIFEELGFNYIGPIDGHDIKALEDTLNNVKDIKGPVLLHVYTKKGKGYKPAEENPVKWHGVAPYKVESGEIIKKSSPPTWTSVFGKALVELAERDEKIVAITPAMREGSGLVEFAKRFPDRFFDVGIAEQHACTFAAGLAAEGLRPVAAYYSTFLQRAYDQVIHDVALQNLPVTFAIDRAGLVGDDGPTHHGVFDLSYLRCVPNMVVCAPKDEQELRDLLYTGIYSGKPFALRYPRGAAYGVPTEGFKKIEIGTWEELLEGEDCVILAVGYPVYQALRAAEKLYKEGIRVGVVNARFVKPMDEKMLRDLANRYDTFITVEDNTVVGGFGSGVLEFFAREGIMKRVINLGVPDRFIEHGKQDILRNLVGIDAEGIEKAVRDALKGGRLI

SEQ ID NO: 10169 - protein, 151 aa, Aquifex aeolicus VF5
MGKEYFLKVALREAKRAFEKGEVPVGAIIVKEGEIISKAHNSVEELKDPTAHAEMLAIKEACRRLNTKYLEGCELYVTLEPCIMCSYALVLSRIEKVIFSALDKKHGGVVSVFNILDEPTLNHRVKWEYYPLEEASELLSEFFKKLRNNII

SEQ ID NO: 10170 - protein, 418 aa, Aquifex aeolicus VF5
MEFDVKDLSLAEEGLKRIEWAEMDMPVLRQIRERFSKEKPLKGKKISACLHVTTETANLMRTLKEGGAEVYLTASNPLSTQDDVAAALVKYFEIPVFAIRGEDRETYYKHLRAVIEKEPDVVIDDGADLISTLHKEYPGLAEKVLGGMEETTTGVIRLRAMAEQGVLKFPIIAVNDAYTKHMFDNRYGTGQSTIDGILRATNRLLAGSYFVVAGYGWCGKGVAQRARGMGAIVIVTEVDPIKALEARMDGFLVMPMEEAAKLGDFFVTVTGNIHVIRREHFEVMKDGAIVANSGHFNVEIDIPALEEMAVEKREIRKEVTEYKLKDGRRIYLLAEGRLVNLAAAEGHPASVMDMSFSNQALSAEYIVKHHKELEKKVYRVPREIDEAVARLKLNALGIKIDELTEEQKKYLSSWEMGT

SEQ ID NO: 10171 - protein, 420 aa, Aquifex aeolicus VF5
MELLKEYNPYLEYRDGELFIEGVSLKELAQTFGTPLYVYSSNFIKERFEAYRKAFPDALICYAVKANFNPHLVKLLGELGAGADIVSGGELYLAKKAGIPPERIVYAGVGKTEKELTDAVDSEILMFNVESRQELDVLNEIAGKLGKKARIAIRVNPDVDPKTHPYIATGMQKSKFGVDIREAQKEYEYASKLENLEIVGIHCHIGSQILDISPYREAVEKVVSLYESLTQKGFDIKYLDIGGGLGIKYKPEDKEPAPQDLADLLKDLLENVKAKIILEPGRSIMGNAGILITQVQFLKDKGSKHFIIVDAGMNDLIRPSIYNAYHHIIPVETKERKKVVADIVGPICETGDFLALDREIEEVQRGEYLAVLSAGAYGFAMSSHYNMRPRAAEVLVENGSVKLIRKRENYDYIVEPSLDI

SEQ ID NO: 10172 - protein, 310 aa, Aquifex aeolicus VF5
MIPDTEQELINQYLKKISKIPLLTPEEEKELARRAKQGDKEALKKLVESNLRFVVSVAKQYIGYGLPFSELIAAGNLGLLEAAKRFDPDRGVKFISYAVWWIRQAIMQALSQQTGAVRIPLKQSHIINKISHIYGELSKKLEREPSPEEIAEELSKQMIAKELEKELGREPTEEEIEERFKKEGYKITPEEVEKYLQVCRVPLSLDAPVGENEDTFFIDFLSKHGTAEVEEKVIQEVIQKEIDDLLSKLTDKERKVIELRFGLKGNEPKTLREIGEILGLSRERVRQLETRALRKLRSLAMKRHLKDFLS

SEQ ID NO: 10173 - protein, 575 aa, Aquifex aeolicus VF5
MLGRESVKALIEMGKEKGYVTYDEINEVLEEDVTSSELFEELIDILHRMNIQVVESKEEYEEESEETQEEEEEVVVSGSLTSSSRDGDPVKLYLREMGKIPLLKREEEIYYARQIEIGRKIMRRGLMRTSFLVEKILDDWAKLCNGKLKIQEVMDLVEYENDDDFEDRFDEFKRFFIEKGYELAKAYRNLLDVREEYIKNPSEESRKKYLYAHARMNKIIKEMKIKYAKFERVTEEIIKIYKEYARKRKDLNARIRKLKALYKDPDYFAQNFLTDENLQKIVQEKNIPTEKVLNLINEYNSLKREVQRIQNLIGVFPEEELPKVMKIIEQGRKKVVQAKQVMIQSNLRLVVSIAKKYVNRGLHFLDLIQEGNIGLMKAVDKYDYRKGYKFSTYATWWIRQAITRAIADQARTIRIPVHMIETINKIIKASKKLFQENGREPTPEEIAEYLDIPVEKVKKVMKFSQEPISLETPIGDDDDTFLKDFIEDKSIPNPEEQVTRKLLREQLQKVLSTLSEKEREILMYRYGLVDGTEYTLEQVGKMFNVTRERIRQIENKALRKLRHPARAKYLKDFEF

SEQ ID NO: 10174 - protein, 248 aa, Aquifex aeolicus VF5
MEIKLQGKVSLVTGSTRGIGRAIAEKLASAGSTVIITGTSGERAKAVAEEIANKYGVKAHGVEMNLLSEESINKAFEEIYNLVDGIDILVNNAGITRDKLFLRMSLLDWEEVLKVNLTGTFLVTQNSLRKMIKQRWGRIVNISSVVGFTGNVGQVNYSTTKAGLIGFTKSLAKELAPRNVLVNAVAPGFIETDMTAVLSEEIKQKYKEQIPLGRFGSPEEVANVVLFLCSELASYITGEVIHVNGGMF

SEQ ID NO: 10175 - protein, 490 aa, Aquifex aeolicus VF5
MVEVEKKIKEGLTFDDVLLVPQYSEVLPHEVDVSTYLTKRIKLNIPIVSAAMDTVTEARLAIALAREGGIGIIHRNLPIKKQAEEVEKVKKSESGMIINPVTVKPDTRVKEALDIMAKYKISGVPVVDEERKLIGILTNRDLRFIKPEDYSKPVSEFMTKENLITAPEGITLDEAEEIFRKYKIEKLPIVDKEGKIKGLITIKDIVKRKKYPNACKDELGRLRVGAAVGTGEETLDRVAALVEAGVDVIVVDTAHGHSKRVLETVEKIKANFPEVDVIAGNVATAEGTKALIEAGADAVKVGVGPGSICTTRIVAGVGVPQLTAIMEAASAAREYDIPIIADGGIRYSGDIVKALAAGASAVMLGNLLAGTEEAPGETIYYQGRAYKVYRGMGSLGAMSSRLSSDRYGQEKMEKFVPEGIEGRVPYKGKLADVVYQLVGGLRSGMGYVGARNIKELQEKAKFVRITWAGYRESHVHDVQITREAPNYWVD

SEQ ID NO: 10176 - protein, 856 aa, Aquifex aeolicus VF5
MSVDKSKALVLWLDEVTIEDIPIAGGKNASLGEMIRNLSPLGVKIPYGYVVTANAYYYFLDYNNLRDKIRKILEGLNTDDLKDLQRRGHEVRELIRGGTFPPDLEEAIKDYYNKLSEKYKTHAVDVAVRSSATAEDLPDASFAGQQETYLNVVGAENVLVAIKNCFASLFTDRAIVYRERFGFDHFKVGIAVGVQKMVRSDMGASGVMFTLDTETGFKDVVVINAAYGLGELLVRGEVTPDEYIVFKPTLMKGYSAIIEKKLGRKDRKMIYGTGDERVKIVNVPKEDQKKFALNDDEILQLAKWGVLIEEHYSKKNGRWTPMDIEWAKDGILNELFVVQARPETVHSRKKENVVKIYKIKTPEEERKNRVIVKGIAVGDKIATGKARVLFDLKEADQFQEGEILVTDITDPDWEPVMKKAAAIVTNRGGRTSHAAIVARELGIPAVVGTGNATEKIKTGEEITVSCAEGETGYVYEGKIDYEVEEINLENIPKPKTKIMMNIGNPESAFRYASLPNDGVGLAREEFIIANYIKIHPLALLHYEDLKELYEKLERENLIDEKGFVQFKLIYHYANGRLANKLAKGKDKLRVNLRKILQDIENLTFGYEDKATYYIKKLSYGIAKIAAAFYPNPVIVRFSDFKSNEYANLIGGILFEPEEENPMLGWRGASRYYSDVFKEAFGMECKAIIRVRNKMGLTNTKVMIPFCRTPEEGEKVLQVMEEYGLRKGENGLEVYVMAELPSNIVLADRYAQIFDGFSIGSNDLTQLTLGLDRDSELVAHLYDERNEAVKRLIAQLIKTAKEYGRKVGICGQAPSDFPEFAQFLVEQGIDSISLNPDSVLKTMLAVVEMEKKLGVLK

SEQ ID NO: 10177 - protein, 383 aa, Mycobacterium tuberculosis H37Rv
MPAVQPWLYSNMPAIRGAVLDQIGVPRPYWRSKPISVVELHLDPPDRGEVLVRIEAAGVCHSDLSVVDGTRVRPVPILLGHEAAGIVEQVGDGVDGVAVGQRVVLVFLPRCGQCAACATDGRTPCEPGSAANKAGTLLGGGIRLSRGGRPVYHHLGVSGFATHVVVNRASVVPVPHEVPPTVAALLGCAVLTGGGAVLNVGDPQPGQSVAVVGLGGVGMAAVLTALTYTDVRVVAVDQLPEKLSAAKALGAHEIYTPQQATAGGVKAAVVVEAVGHPAALHTAIGLTAPGGRTITVGLPPPDVRISLSPLDFVTEGRSLIGSYLGSAVPSHDIPRFVSLWQSGRLPVESLVTSTIRLDDINEAMDHLADGIAVRQLISFTGDL

SEQ ID NO: 10178 - protein, 244 aa, Mycobacterium tuberculosis H37Rv
MTATVEIRRAADRAVTTTSWLKSRHSFSFGDHYDPDNTHHGLLLVNNDDQMEPASGFDPHPHRDMEIVTWVLRGALRHQDSAGNSGVIYPGLAQRMSAGTGILHSEMNDSATEPVHFVQMWVIPDATGITASYQQQEIDDELLRAGLVTIASGIPGQDAALTLHNSSASLHGARLRPGATVSLPCAPFLHLFVAYGRLTLEGGGELADGDAVRFTDADARGLTANEPSEVLIWEMHAKLGDSAT

SEQ ID NO: 10179 - protein, 487 aa, Mycobacterium tuberculosis H37Rv
MSDSATEYDKLFIGGKWTKPSTSDVIEVRCPATGEYVGKVPMAAAADVDAAVAAARAAFDNGPWPSTPPHERAAVIAAAVKMLAERKDLFTKLLAAETGQPPTIIETMHWMGSMGAMNYFAGAADKVTWTETRTGSYGQSIVSREPVGVVGAIVAWNVPLFLAVNKIAPALLAGCTIVLKPAAETPLTANALAEVFAEVGLPEGVLSVVPGGIETGQALTSNPDIDMFTFTGSSAVGREVGRRAAEMLKPCTLELGGKSAAIILEDVDLAAAIPMMVFSGVMNAGQGCVNQTRILAPRSRYDEIVAAVTNFVTALPVGPPSDPAAQIGPLISEKQRTRVEGYIAKGIEEGARLVCGGGRPEGLDNGFFIQPTVFADVDNKMTIAQEEIFGPVLAIIPYDTEEDAIAIANDSVYGLAGSVWTTDVPKGIKISQQIRTGTYGINWYAFDPGSPFGGYKNSGIGRENGPEGVEHFTQQKSVLLPMGYTVA

SEQ ID NO: 10180 - protein, 511 aa, Mycobacterium tuberculosis H37Rv
MRSVTCSATLVLPVIEPTPADRRPRHLLLGSAGHVSGRLDTGRFVQTHPAKDVSVPIATINPATGETVKTFTAATDDEVDAAIARAHRRFADYRQTSFAQRARWANATADLLEAEADQAAAMMTLEMGKTLAAAKAEALKCAKGFRYYAENAEALLADEPADAAKVGASAAYGRYQPLGVILAVMPWNFPLWQAVRFAAPALMAGNVGLLKHASNVPQCALYLADVIARGGFPDGCFQTLLVSSGAVEAILRDPRVAAATLTGSEPAGQSVGAIAGNEIKPTVLELGGSDPFIVMPSADLDAAVSTAVTGRVQNNGQSCIAAKRFIVHADIYDDFVDKFVARMAALRVGDPTDPDTDVGPLATEQGRNEVAKQVEDAAAAGAVIRCGGKRLDRPGWFYPPTVITDISKDMALYTEEVFGPVASVFRAANIDEAVEIANATTFGLGSNAWTRDETEQRRFIDDIVAGQVFINGMTVSYPELPFGGVKRSGYGRELSAHGIREFCNIKTVWIA

SEQ ID NO: 10181 - protein, 507 aa, Mycobacterium tuberculosis H37Rv
MTVFSRPGSAGALMSYESRYQNFIGGQWVAPVHGRYFENPTPVTGQPFCEVPRSDAADIDKALDAAHAAAPGWGKTAPAERAAILNMIADRIDKNAAALAVAEVWDNGKPVREALAADIPLAVDHFRYFAAAIRAQEGALSQIDEDTVAYHFHEPLGVVGQIIPWNFPILMAAWKLAPALAAGNTAVLKPAEQTPASVLYLMSLIGDLLPPGVVNVVNGFGAEAGKPLASSDRIAKVAFTGETTTGRLIMQYASHNLIPVTLELGGKSPNIFFADVLAAHDDFCDKALEGFTMFALNQGEVCTCPSRSLIQADIYDEFLELAAIRTKAVRQGDPLDTETMLGSQASNDQLEKVLSYIEIGKQEGAVIIAGGERAELGGDLSGGYYMQPTIFTGTNNMRIFKEEIFGPVVAVTSFTDYDDAIGIANDTLYGLGAGVWSRDGNTAYRAGRDIQAGRVWVNCYHLYPAHAAFGGYKQSGIGREGHQMMLQHYQHTKNLLVSYSDKALGFF

SEQ ID NO: 10182 - protein, 480 aa, Mycobacterium tuberculosis H37Rv
MAGVRHDDGSGLIAQRRPVRGEGATRSRGPSGPSNRNVSAADDPRRVALLAVHTSPLAQPGTGDAGGMNVYMLQSALHLARRGIEVEIFTRATASADPPVVRVAPGVLVRNVVAGPFEGLDKYDLPTQLCAFAAGVLRAEAVHEPGYYDIVHSHYWLSGQVGWLARDRWAVPLVHTAHTLAAVKNAALADGDGPEPPLRTVGEQQVVDEADRLIVNTDDEARQVISLHGADPARIDVVHPGVDLDVFRPGDRRAARAALGLPVDERVVAFVGRIQPLKAPDIVLRAAAKLPGVRIIVAGGPSGSGLASPDGLVRLADELGISARVTFLPPQSHTDLATLFRAADLVAVPSYSESFGLVAVEAQACGTPVVAAAVGGLPVAVRDGITGTLVSGHEVGQWADAIDHLLRLCAGPRGRVMSRAAARHAATFSWENTTDALLASYRRAIGEYNAERQRRGGEVISDLVAVGKPRHWTPRRGVGA

SEQ ID NO: 10183 - protein, 472 aa, Mycobacterium tuberculosis H37Rv
MSGTSSMGLPPGPRLSGSVQAVLMLRHGLRFLTACQRRYGSVFTLHVAGFGHMVYLSDPAAIKTVFAGNPSVFHAGEANSMLAGLLGDSSLLLIDDDVHRDRRRLMSPPFHRDAVARQAGPIAEIAAANIAGWPMAKAFAVAPKMSEITLEVILRTVIGASDPVRLAALRKVMPRLLNVGPWATLALANPSLLNNRLWSRLRRRIEEADALLYAEIADRRADPDLAARTDTLAMLVRAADEDGRTMTERELRDQLITLLVAGHDTTATGLSWALERLTRHPVTLAKAVQAADASAAGDPAGDEYLDAVAKETLRIRPVVYDVGRVLTEAVEVAGYRLPAGVMVVPAIGLVHASAQLYPDPERFDPDRMVGATLSPTTWLPFGGGNRRCLGATFAMVEMRVVLREILRRVELSTTTTSGERPKLKHVIMVPHRGARIRVRATRDVSATSQATAQGAGCPAARGGGPSRAVGSQ

SEQ ID NO: 10184 - protein, 501 aa, Mycobacterium tuberculosis H37Rv
MTTAQAAESQNPYLEGFLAPVSTEVTATDLPVTGRIPEHLDGRYLRNGPNPVAEVDPATYHWFTGDAMVHGVALRDGKARWYRNRWVRTPAVCAALGEPISARPHPRTGIIEGGPNTNVLTHAGRTLALVEAGVVNYELTDELDTVGPCDFDGTLHGGYTAHPQRDPHTGELHAVSYSFARGHRVQYSVIGTDGHARRTVDIEVAGSPMMHSFSLTDNYVVIYDLPVTFDPMQVVPASVPRWLQRPARLVIQSVLGRVRIPDPIAALGNRMQGHSDRLPYAWNPSYPARVGVMPREGGNEDVRWFDIEPCYVYHPLNAYSECRNGAEVLVLDVVRYSRMFDRDRRGPGGDSRPSLDRWTINLATGAVTAECRDDRAQEFPRINETLVGGPHRFAYTVGIEGGFLVGAGAALSTPLYKQDCVTGSSTVASLDPDLLIGEMVFVPNPSARAEDDGILMGYGWHRGRDEGQLLLLDAQTLESIATVHLPQRVPMGFHGNWAPTT

SEQ ID NO: 10185 - protein, 375 aa, Mycobacterium tuberculosis H37Rv
MKTKGALIWEFNQPWSVEEIEIGDPRKDEVKIQMEAAGMCRSDHHLVTGDIPMAGFPVLGGHEGAGIVTEVGPGVDDFAPGDHVVLAFIPSCGKCPSCQAGMRNLCDLGAGLLAGESVTDGSFRIQARGQNVYPMTLLGTFSPYMVVHRSSVVKIDPSVPFEVACLVGCGVTTGYGSAVRTADVRPGDDVAIVGLGGVGMAALQGAVSAGARYVFAVEPVEWKRDQALKFGATHVYPDINAALMGIAEVTYGLMAQKVIITVGKLDGADVDSYLTITAKGGTCVLTAIGSLVDTQVTLNLAMLTLLQKNIQGTIFGGGNPHYDIPKLLSMYKAGKLNLDDMVTTAYKLEQINDGYQDMLNGKNIRGVIRYTDDDR

SEQ ID NO: 10186 - protein, 489 aa, Mycobacterium tuberculosis H37Rv
MALWGDGISALLIDGKLSDGRAGTFPTVNPATEEVLGVAADADAEDMGRAIEAARRAFDSTDWSRNTELRVRCVRQLRDAMQQHVEELRELTISEVGAPRMLTASAQLEGPVGDLSFAADTAESYPWKQDLGEASPLGIATRRTLAREAVGVVGAITPWNFPHQINLAKLGPALAAGNTVVLKPAPDTPWCAAALGEIIVEHTDFPPGVVNIVTSSSHALGALLAKDPRVDMISFTGSTATGRAVMADAAATIKKVFLELGGKSAFVVLDDADLAAASAVSAFSACMHAGQGCAITTRLVVPRARYEEAVAIAAATMSSIRPGDPNDPGTVCGPLISARQRDRVQGYLDLAVAEGGRFACGGARPADREVGFYIEPTVIAGLTNDARVAREEIFGPVLTVIAHDGDDDAVRIANDSPYGLSGTVYGADPQRAARIASRLRVGTVNVNGGVWYCADAPFGGYKQSGIGREMGLLGFEEYLEAKLIATAAN

SEQ ID NO: 10187 - protein, 502 aa, Mycobacterium tuberculosis H37Rv
MDITIVGKYLSTLPEDDDHPYRTGPWRPQTTEWDADDLTTVTGEVPADLDGIYLRNTENPLHPAFATYHPFDGDGMIHVVGFRDGKAFYRNRFIRTDGFLAENEAGGPLWPGLAEPVQLAKREHGWGARGLMKDASSTDVIVHRGIALTSFYQCGDLYRIDPYSANTLGKESWHGRFPFDWGVSAHPKVDNKTGELLFFNYSKQEPYMRYGVVDQNNELVHYVDVPLPGPRLPHDMAFTENYVILNDFPLFWDPRLLERDVHLPRFYPEIPSRFAVVARRGNDIRWFEADPTFVLHFTNAYEQGDEIVLDGFYEGDPQPLDTGGTKWEKLFRFLALDRLQSRLHRWRLNMVTGAVHEEQLSESITEFGTINADYAASSYRYTYAATGKPSWFLFDGLVKHDLLTGNHECYSFGDGVYGSETAMAPRVGSSAEDDGYLVTLTTDMNDDASYCLVFDAARPGDGPICKLALPERISSGTHSAWVPGAELRRWDHAESPAAAVGL

SEQ ID NO: 10188 - protein, 593 aa, Mycobacterium tuberculosis H37Rv
MSAKERGDQNAVVDALRSIQPAVFIPASVVIVAMIVVSVVYSSVAENAFVRLNSAITGGVGWWYILVATGFVVFALYCGISRIGTIRLGRDDELPEFSFWAWLAMLFSAGMGIGLVFYGVAEPLSHYLRPPRSRGVPALTDAAANQAMALTVFHWGLHAWAIYVVVGLGMAYMTYRRGRPLSVRWLLEPVVGRGRVEGALGHAVDVIAIVGTLFGVATSLGFGITQIASGLEYLGWIRVDNWWMVGMIAAITATATASVVSGVSKGLKWLSNINMALAAALALFVLLLGPTLFLLQSWVQNLGGYVQSLPQFMLRTAPFSHDGWLGDWTIFYWGWWISWAPFVGMFIARISRGRTIREFIGAVLLVPTVIASLWFTIFGDSALLRQRNNGDMLVNGAVDTNTSLFRLLDGLPIGAITSVLAVLVIVFFFVTSSDSGSLVIDILSAGGELDPPKLTRVYWAVLEGVAAAVLLLIGGAGSLTALRTAAIATALPFSIVMVVACYAMTKAFHFDLAATPRLLHVTVPDVVAAGNRRRHDISATLSGLIAVRDVDSGTYIVHPDTGALTVTAPPDPLDDHVFESDRHVTRRNTTSSR

SEQ ID NO: 10189 - protein, 263 aa, Mycobacterium tuberculosis H37Rv
MILDMFRLDDKVAVITGGGRGLGAAIALAFAQAGADVLIASRTSSELDAVAEQIRAAGRRAHTVAADLAHPEVTAQLAGQAVGAFGKLDIVVNNVGGTMPNTLLSTSTKDLADAFAFNVGTAHALTVAAVPLMLEHSGGGSVINISSTMGRLAARGFAAYGTAKAALAHYTRLAALDLCPRVRVNAIAPGSILTSALEVVAANDELRAPMEQATPLRRLGDPVDIAAAAVYLASPAGSFLTGKTLEVDGGLTFPNLDLPIPDL

SEQ ID NO: 10190 - protein, 429 aa, Mycobacterium tuberculosis H37Rv
MPIIEQVRAREILDSRGNPTVEVEVALIDGTFARAAVPSGASTGEHEAVELRDGGDRYGGKGVQKAVQAVLDEIGPAVIGLNADDQRLVDQALVDLDGTPDKSRLGGNAILGVSLAVAKAAADSAELPLFRYVGGPNAHILPVPMMNILNGGAHADTAVDIQEFMVAPIGAPSFVEALRWGAEVYHALKSVLKKEGLSTGLGDEGGFAPDVAGTTAALDLISRAIESAGLRPGADVALALDAAATEFFTDGTGYVFEGTTRTADQMTEFYAGLLGAYPLVSIEDPLSEDDWDGWAALTASIGDRVQIVGDDIFVTNPERLEEGIERGVANALLVKVNQIGTLTETLDAVTLAHHGGYRTMISHRSGETEDTMIADLAVAIGSGQIKTGAPARSERVAKYNQLLRIEEALGDAARYAGDLAFPRFACETK

SEQ ID NO: 10191 - protein, 328 aa, Mycobacterium tuberculosis H37Rv
MELVRVTEAGAMAAGRWVGRGDKEGGDGAAVDAMRELVNSVSMRGVVVIGEGEKDHAPMLYNGEEVGNGDGPECDFAVDPIDGTTLMSKGMTNAISVLAVADRGTMFDPSAVFYMNKIAVGPDAAHVLDITAPISENIRAVAKVKDLSVRDMTVCILDRPRHAQLIHDVRATGARIRLITDGDVAGAISACRPHSGTDLLAGIGGTPEGIIAAAAIRCMGGAIQAQLAPRDDAERRKALEAGYDLNQVLTTEDLVSGENVFFCATGVTDGDLLKGVRYYPGGCTTHSIVMRSKSGTVRMIEAYHRLSKLNEYSAIDFTGDSSAVYPLP

SEQ ID NO: 10192 - protein, 490 aa, Mycobacterium tuberculosis H37Rv
MTRITRANGCPDGTLENAVVALDGGANYPREILGNKGHGIDMMRRHHLPVPPAFCITTEVGVRYLAAPGSTIAAIWDDVLDRMSWLETETSCTFGRGPNPLLVSVRSGATQSMPGMMDTILDVGMTDAVERVLARPGAADFAHDTRRRFTSMYRRIVGSAGPITDDPYAQLRASIEAVFASWNSPRAVAYRDHHGLDDQGGTAVVVQAMVFGNLTANSGAGVLSSRNPITGANEPFGEWLPGGQGDDVVSGLVAVAPITALRDQQPAVYDQLMAAARSLERMAGDVQEIEFTVEDSQLWLLQTRGAERSAQAAVRLALQLHHEGLIDDTETLRRVTPTHIETLLRPSLQTETRLAAPLLAKGLPACPGVVSGTAYTEVDEALDAADRGEPVILVRDHTRPEDVMGMLAAQGIVTEVGGAASHAAVVSRELGRVAVVGCGPGVAAALAGKEITVDGYEGEVRQGVLALSAWSESDTPELRELADIAQRISS

SEQ ID NO: 10193 - protein, 390 aa, Mycobacterium tuberculosis H37Rv
MPSRLHSAVMSGTRDGDLNAAIRTALGKVIDPELRRPITELGMVKSIDTGPDGSVHVEIYLTIAGCPKKSEITERVTRAVADVPGTSAVRVSLDVMSDEQRTELRKQLRGDTREPVIPFAQPDSLTRVYAVASGKGGVGKSTVTVNLAAAMAVRGLSIGVLDADIHGHSIPRMMGTTDRPTQVESMILPPIAHQVKVISIAQFTQGNTPVVWRGPMLHRALQQFLADVYWGDLDVLLLDLPPGTGDVAISVAQLIPNAELLVVTTPQLAAAEVAERAGSIALQTRQRIVGVVENMSGLTLPDGTTMQVFGEGGGRLVAERLSRAVGADVPLLGQIPLDPALVAAGDSGVPLVLSSPDSAIGKELHSIADGLSTRRRGLAGMSLGLDPTRR

SEQ ID NO: 10194 - protein, 447 aa, Mycobacterium tuberculosis H37Rv
MNELLHLAPNVWPRNTTRDEVGVVCIAGIPLTQLAQEYGTPLFVIDEDDFRSRCRETAAAFGSGANVHYAAKAFLCSEVARWISEEGLCLDVCTGGELAVALHASFPPERITLHGNNKSVSELTAAVKAGVGHIVVDSMTEIERLDAIAGEAGIVQDVLVRLTVGVEAHTHEFISTAHEDQKFGLSVASGAAMAAVRRVFATDHLRLVGLHSHIGSQIFDVDGFELAAHRVIGLLRDVVGEFGPEKTAQIATVDLGGGLGISYLPSDDPPPIAELAAKLGTIVSDESTAVGLPTPKLVVEPGRAIAGPGTITLYEVGTVKDVDVSATAHRRYVSVDGGMSDNIRTALYGAQYDVRLVSRVSDAPPVPARLVGKHCESGDIIVRDTWVPDDIRPGDLVAVAATGAYCYSLSSRYNMVGRPAVVAVHAGNARLVLRRETVDDLLSLEVR

SEQ ID NO: 10195 - protein, 247 aa, Mycobacterium tuberculosis H37Rv
MASLLNARTAVITGGAQGLGLAIGQRFVAEGARVVLGDVNLEATEVAAKRLGGDDVALAVRCDVTQADDVDILIRTAVERFGGLDVMVNNAGITRDATMRTMTEEQFDQVIAVHLKGTWNGTRLAAAIMRERKRGAIVNMSSVSGKVGMVGQTNYSAAKAGIVGMTKAAAKELAHLGIRVNAIAPGLIRSAMTEAMPQRIWDQKLAEVPMGRAGEPSEVASVAVFLASDLSSYMTGTVLDVTGGRFI

SEQ ID NO: 10196 - protein, 418 aa, Mycobacterium tuberculosis H37Rv
MVDHKRIPKQVIVGVSGGIAAYKACTVVRQLTEASHRVRVIPTESALRFVGAATFEALSGEPVCTDVFADVPAVPHVHLGQQADLVVVAPATADLLARAAAGRADDLLTATLLTARCPVLFAPAMHTEMWLHPATVDNVATLRRRGAVVLEPATGRLTGADSGAGRLPEAEEITTLAQLLLERHDALPYDLAGRKLLVTAGGTREPIDPVRFIGNRSSGKQGYAVARVAAQRGADVTLIAGHTAGLVDPAGVEVVHVSSAQQLADAVSKHAPTADVLVMAAAVADFRPAQVATAKIKKGVEGPPTIELLRNDDVLAGVVRARAHGQLPNMRAIVGFAAETGDANGDVLFHARAKLRRKGCDLLVVNAVGEGRAFEVDSNDGWLLASDGTESALQHGSKTLMASRIVDAIVTFLAGCSS

SEQ ID NO: 10197 - protein, 247 aa, Mycobacterium tuberculosis H37Rv
MTATATEGAKPPFVSRSVLVTGGNRGIGLAIAQRLAADGHKVAVTHRGSGAPKGLFGVECDVTDSDAVDRAFTAVEEHQGPVEVLVSNAGLSADAFLMRMTEEKFEKVINANLTGAFRVAQRASRSMQRNKFGRMIFIGSVSGSWGIGNQANYAASKAGVIGMARSIARELSKANVTANVVAPGYIDTDMTRALDERIQQGALQFIPAKRVGTPAEVAGVVSFLASEDASYISGAVIPVDGGMGMGH

SEQ ID NO: 10198 - protein, 518 aa, Mycobacterium tuberculosis H37Rv
MPAPSAEVFDRLRNLAAIKDVAARPTRTIDEVFTGKPLTTIPVGTAADVEAAFAEARAAQTDWAKRPVIERAAVIRRYRDLVIENREFLMDLLQAEAGKARWAAQEEIVDLIANANYYARVCVDLLKPRKAQPLLPGIGKTTVCYQPKGVVGVISPWNYPMTLTVSDSVPALVAGNAVVLKPDSQTPYCALACAELLYRAGLPRALYAIVPGPGSVVGTAITDNCDYLMFTGSSATGSRLAEHAGRRLIGFSAELGGKNPMIVARGANLDKVAKAATRACFSNAGQLCISIERIYVEKDIAEEFTRKFGDAVRNMKLGTAYDFSVDMGSLISEAQLKTVSGHVDDATAKGAKVIAGGKARPDIGPLFYEPTVLTNVAPEMECAANETFGPVVSIYPVADVDEAVEKANDTDYGLNASVWAGSTAEGQRIAARLRSGTVNVDEGYAFAWGSLSAPMGGMGLSGVGRRHGPEGLLKYTESQTIATARVFNLDPPFGIPATVWQKSLLPIVRTVMKLPGRR

SEQ ID NO: 10199 - protein, 479 aa, Mycobacterium tuberculosis H37Rv
MMRFLDGHPPGYDLTYNDVFIVPNRSEVASRFDVDLSTADGSGTTIPVVVANMTAVAGRRMAETVARRGGIVILPQDLPIPAVKQTVAFVKSRDLVLDTPVTLAPDDSVSDAMALIHKRAHGVAVVILEGRPIGLVRESSCLGVDRFTRVRDIAVTDYVTAPAGTEPRKIFDLLEHAPVDVAVLTDADGTLAGVLSRTGAIRAGIYTPATDSAGRLRIGAAVGINGDVGAKARALAEAGVDVLVIDTAHGHQVKTLDAIKAVSALDLGLPLAAGNVVSAEGTRDLLKAGANVVKVGVGPGAMCTTRMMTGVGRPQFSAVLECASAARQLGGHIWADGGIRHPRDVALALAAGASNVMIGSWFAGTYESPGDLMRDRDDQPYKESYGMASKRAVVARTGADNPFDRARKALFEEGISTSRMGLDPDRGGVEDLIDHITSGVRSTCTYVGASNLAELHERAVVGVQSGAGFAEGHPLPAGW

SEQ ID NO: 10200 - protein, 255 aa, Mycobacterium tuberculosis H37Rv
MSVLDLFDLHGKRALITGASTGIGKRVALAYVEAGAQVAIAARHLDALEKLADEIGTSGGKVVPVCCDVSQHQQVTSMLDQVTAELGGIDIAVCNAGIITVTPMLDMPLEEFQRLQNTNVTGVFLTAQAAAKAMVKQGQGGVIINTASMSGHIINVPQQVSHYCASKAAVIHLTKAMAVELAPHKIRVNSVSPGYILTELVEPYTEYQPLWEPKIPLGRLGRPEELAGLYLYLASEASSYMTGSDIVIDGGYTCP

SEQ ID NO: 10201 - protein, 260 aa, Mycobacterium tuberculosis H37Rv
MSGRLIGKVALVSGGARGMGASHVRAMVAEGAKVVFGDILDEEGKAVAAELADAARYVHLDVTQPAQWTAAVDTAVTAFGGLHVLVNNAGILNIGTIEDYALTEWQRILDVNLTGVFLGIRAVVKPMKEAGRGSIINISSIEGLAGTVACHGYTATKFAVRGLTKSTALELGPSGIRVNSIHPGLVKTPMTDWVPEDIFQTALGRAAEPVEVSNLVVYLASDESSYSTGAEFVVDGGTVAGLAHNDFGAVEVSSQPEWVT

SEQ ID NO: 10202 - protein, 361 aa, Mycobacterium tuberculosis H37Rv
MSQTVRGVIARQKGEPVELVNIVVPDPGPGEAVVDVTACGVCHTDLTYREGGINDEYPFLLGHEAAGIIEAVGPGVTAVEPGDFVILNWRAVCGQCRACKRGRPRYCFDTFNAEQKMTLTDGTELTAALGIGAFADKTLVHSGQCTKVDPAADPAVAGLLGCGVMAGLGAAINTGGVTRDDTVAVIGCGGVGDAAIAGAALVGAKRIIAVDTDDTKLDWARTFGATHTVNAREVDVVQAIGGLTDGFGADVVIDAVGRPETYQQAFYARDLAGTVVLVGVPTPDMRLDMPLVDFFSHGGALKSSWYGDCLPESDFPTLIDLYLQGRLPLQRFVSERIGLEDVEEAFHKMHGGKVLRSVVML

SEQ ID NO: 10203 - protein, 542 aa, Mycobacterium tuberculosis H37Rv
MNGRRTIGEDGLVFGLVVIVALVAAVVVGTVLGHRYRVGPPVLLILSGSLLGLIPRFGDVQIDGEVVLLLFLPAILYWESMNTSFREIRWNLRVIVMFSIGLVIATAVAVSWTARALGMESHAAAVLGAVLSPTDAAAVAGLAKRLPRRALTVLRGESLINDGTALVLFAVTVAVAEGAAGIGPAALVGRFVVSYLGGIMAGLLVGGLVTLLRRRIDAPLEEGALSLLTPFAAFLLAQSLKCSGVVAVLVSALVLTYVGPTVIRARSRLQAHAFWDIATFLINGSLWVFVGVQIPGAIDHIAGEDGGLPRATVLALAVTGVVIATRIAWVQATTVLGHTVDRVLKKPTRHVGFRQRCVTSWAGFRGAVSLAAALAVPMTTNSGAPFPDRNLIIFVVSVVILVTVLVQGTSLPTVVRWARMPEDVAHANELQLARTRSAQAALDALPTVADELGVAPDLVKHLEKEYEERAVLVMADGADSATSDLAERNDLVRRVRLGVLQHQRQAVTTLRNQNLIDDIVLRELQAAMDLEEVQLLDPADAE

SEQ ID NO: 10204 - protein, 310 aa, Mycobacterium tuberculosis H37Rv
MVATRGRPCPTNFSRPQRPRVAGNGTKSQRCRGRLTTSMLGVAPEAKGPPVKVHHLNCGTMNAFGIALLCHVLLVETDDGLVLVDTGFGIQDCLDPGRVGLFRHVLRPAFLQAETAARQIEQLGYRTSDVRHIVLTHFDFDHIGGIADFPEAHLHVTAAEARGAIHAPSLRERLRYRRGQWAHGPKLVEHGPDGEPWRGFASAKPLDSIGTGVVLVPMPGHTRGHAAVAVDAGHRWVLHCGDAFYHRGTLDGRFRVPFVMRAEEKLLSYNRNQLRDNQARIVELHRRHDPDLLIVCAHDPDLYQLARDTA

SEQ ID NO: 10205 - protein, 229 aa, Mycobacterium tuberculosis H37Rv
MLTAMRGDIRAARERDPAAPTALEVIFCYPGVHAVWGHRLAHWLWQRGARLLARAAAEFTRILTGVDIHPGAVIGARVFIDHATGVVIGETAEVGDDVTIYHGVTLGGSGMVGGKRHPTVGDRVIIGAGAKVLGPIKIGEDSRIGANAVVVKPVPPSAVVVGVPGQVIGQSQPSPGGPFDWRLPDLVGASLDSLLTRVARLEALGGGPQAAGVIRPPEAGIWHGEDFSI

SEQ ID NO: 10206 - protein, 302 aa, Mycobacterium tuberculosis H37Rv
MELVSDSVLISDGGLATELEARGHDLSDPLWSARLLVDAPHAITAVHTAYFRAGAQIATTASYQASFEGFAARGIGHDDATVLLRRSVELAQAARDEVGVGGLSVAASVGPYGAALADGSEYRGYYGLSVAALMKWHLPRLEVLVDAGADMLALETIPDIDEAEALVNLVRRLATPAWLSYTINGTRTRAGQPLTDAFAVAAGVPEIVAVGVNCCAPDDVLPAIAFAVAHTGKPVIVYPNSGEGWDGRRRAWVGPRRFSGSSGQLAREWVAAGARIVGGCCRVRPIDIAEIGRALTTAPPRG

SEQ ID NO: 10207 - protein, 638 aa, Mycobacterium tuberculosis H37Rv
MLQQIRGPADLQHLSQAQLRELAAEIREFLIHKVAATGGHLGPNLGVVELTLALHRVFDSPHDPIIFDTGHQAYVHKMLTGRSQDFATLRKKGGLSGYPSRAESEHDWVESSHASAALSYADGLAKAFELTGHRNRHVVAVVGDGALTGGMCWEALNNIAASRRPVIIVVNDNGRSYAPTIGGVADHLATLRLQPAYEQALETGRDLVRAVPLVGGLWFRFLHSVKAGIKDSLSPQLLFTDLGLKYVGPVDGHDERAVEVALRSARRFGAPVIVHVVTRKGMGYPPAEADQAEQMHSTVPIDPATGQATKVAGPGWTATFSDALIGYAQKRRDIVAITAAMPGPTGLTAFGQRFPDRLFDVGIAEQHAMTSAAGLAMGGLHPVVAIYSTFLNRAFDQIMMDVALHKLPVTMVLDRAGITGSDGASHNGMWDLSMLGIVPGIRVAAPRDATRLREELGEALDVDDGPTALRFPKGDVGEDISALERRGGVDVLAAPADGLNHDVLLVAIGAFAPMALAVAKRLHNQGIGVTVIDPRWVLPVSDGVRELAVQHKLLVTLEDNGVNGGAGSAVSAALRRAEIDVPCRDVGLPQEFYEHASRSEVLADLGLTDQDVARRITGWVAALGTGVCASDAIPEHLD

SEQ ID NO: 10208 - protein, 528 aa, Mycobacterium tuberculosis H37Rv
MAATKASTATDEPVKRTATKSPAASASGAKTGAKRTAAKSASGSPPAKRATKPAARSVKPASAPQDTTTSTIPKRKTRAAAKSAAAKAPSARGHATKPRAPKDAQHEAATDPEDALDSVEELDAEPDLDVEPGEDLDLDAADLNLDDLEDDVAPDADDDLDSGDDEDHEDLEAEAAVAPGQTADDDEEIAEPTEKDKASGDFVWDEDESEALRQARKDAELTASADSVRAYLKQIGKVALLNAEEEVELAKRIEAGLYATQLMTELSERGEKLPAAQRRDMMWICRDGDRAKNHLLEANLRLVVSLAKRYTGRGMAFLDLIQEGNLGLIRAVEKFDYTKGYKFSTYATWWIRQAITRAMADQARTIRIPVHMVEVINKLGRIQRELLQDLGREPTPEELAKEMDITPEKVLEIQQYAREPISLDQTIGDEGDSQLGDFIEDSEAVVAVDAVSFTLLQDQLQSVLDTLSEREAGVVRLRFGLTDGQPRTLDEIGQVYGVTRERIRQIESKTMSKLRHPSRSQVLRDYLD

SEQ ID NO: 10209 - protein, 323 aa, Mycobacterium tuberculosis H37Rv
MADAPTRATTSRVDSDLDAQSPAADLVRVYLNGIGKTALLNAAGEVELAKRIEAGLYAEHLLETRKRLGENRKRDLAAVVRDGEAARRHLLEANLRLVVSLAKRYTGRGMPLLDLIQEGNLGLIRAMEKFDYTKGFKFSTYATWWIRQAITRGMADQSRTIRLPVHLVEQVNKLARIKREMHQHLGREATDEELAAESGIPIDKINDLLEHSRDPVSLDMPVGSEEEAPLGDFIEDAEAMSAENAVIAELLHTDIRSVLATLDEREHQVIRLRFGLDDGQPRTLDQIGKLFGLSRERVRQIERDVMSKLRHGERADRLRSYAS

SEQ ID NO: 10210 - protein, 260 aa, Mycobacterium tuberculosis H37Rv
MTSLDLTGRTAIITGASRGIGLAIAQQLAAAGAHVVLTARRQEAADEAAAQVGDRALGVGAHAVDEDAARRCVDLTLERFGSVDILINNAGTNPAYGPLLEQDHARFAKIFDVNLWAPLMWTSLVVTAWMGEHGGAVVNTASIGGMHQSPAMGMYNATKAALIHVTKQLALELSPRIRVNAICPGVVRTRLAEALWKDHEDPLAATIALGRIGEPADIASAVAFLVSDAASWITGETMIIDGGLLLGNALGFRAAPSTEH

SEQ ID NO: 10211 - protein, 258 aa, Mycobacterium tuberculosis H37Rv
MMDLSQRLAGRVAVITGGGSGIGLAAGRRMRAEGATIVVGDVDVEAGGAAADELSGLFVPTDVCDEDAVNGLFDGAAETYGRIDIAFNNAGISPPEDNLIENTELAAWQRVQDVNLKSVYLCCRAALRHMVLAGKGSIVNTASFVAVMGSATSQISYTASKGGVLAMSRELGVQFARQGIRVNALCPGPVNTPLLQELFAKNPERAARRMVHVPLGRFAEPDEIAAAVAFLASDDASFITASTFLVDGGISSAYVTPL

SEQ ID NO: 10212 - protein, 455 aa, Mycobacterium tuberculosis H37Rv
MSTTQLINPATEEVLASVDHTDANAVDDAVQRARAAQRRWARLAPAQRAAGLRAFAAAVQAHLDELAALEVANSGHPIVSAEWEAGHVRDVLAFYAASPERLSGRQIPVAGGVDVTFNEPMGVVGVITPWNFPMVIASWAIAPALAAGNAVLVKPAELTPLTTMRLGELAVEAGLDEDLLQVLPGKGTVVGERFVTHPDIRKIVFTGSTEVGKRVMAGAAAQVKRVTLELGGKSANIVFHDCDLERAATTAPAGVFDNAGQDCCARSRILVQRSVYDRFMELLEPAVHSIVVGDPGSRATEMGPLVSRAHRDKVAGYVPDDAPVAFRGTAPAGRGFWFPPTVLTPKRGDRTVTDEIFGPVVVVLTFDDEADAISLANDTAYGLSGSIWTDDLSRALRVARAVESGNLSVNSHSSVRFNTPFGGFKQSGVGRELGPDAPLQFTETKNVFIAVGEEM

SEQ ID NO: 10213 - protein, 436 aa, Mycobacterium tuberculosis H37Rv
MATGGRVVIRRRGDNEVVAHNDEVTNSTDGRADGRLRVVVLGSTGSIGTQALQVIADNPDRFEVVGLAAGGAHLDTLLRQRAQTGVTNIAVADEHAAQRVGDIPYHGSDAATRLVEQTEADVVLNALVGALGLRPTLAALKTGARLALANKESLVAGGSLVLRAARPGQIVPVDSEHSALAQCLRGGTPDEVAKLVLTASGGPFRGWSAADLEHVTPEQAGAHPTWSMGPMNTLNSASLVNKGLEVIETHLLFGIPYDRIDVVVHPQSIIHSMVTFIDGSTIAQASPPDMKLPISLALGWPRRVSGAAAACDFHTASSWEFEPLDTDVFPAVELARQAGVAGGCMTAVYNAANEEAAAAFLAGRIGFPAIVGIIADVLHAADQWAVEPATVDDVLDAQRWARERAQRAVSGMASVAIASTAKPGAAGRHASTLERS

SEQ ID NO: 10214 - protein, 112 aa, Mycobacterium tuberculosis H37Rv
MKLITAIVKPFTLDDVKTSLEDAGVLGMTVSEIQGYGRQKGHTEVYRGAEYSVDFVPKVRIEVVVDDSIVDKVVDSIVRAARTGKIGDGKVWVSPVDTIVRVRTGERGHDAL

SEQ ID NO: 10215 - protein, 282 aa, Mycobacterium tuberculosis H37Rv
MTGESGAAAAPSITLNDEHTMPVLGLGVAELSDDETERAVSAALEIGCRLIDTAYAYGNEAAVGRAIAASGVAREELFVTTKLATPDQGFTRSQEACRASLDRLGLDYVDLYLIHWPAPPVGKYVDAWGGMIQSRGEGHARSIGVSNFTAENIENLIDLTFVTPAVNQIELHPLLNQDELRKANAQHTVVTQSYCPLALGRLLDNPTVTSIASEYVKTPAQVLLRWNLQLGNAVVVRSARPERIASNFDVFDFELAAEHMDALGGLNDGTRVREDPLTYAGT

SEQ ID NO: 10216 - protein, 492 aa, Mycobacterium tuberculosis H37Rv
MATIHPPAYLLDQAKRRFTPSFNNFPGMSLVEHMLLNTKFPEKKLAEPPPGSGLKPVVGDAGLPILGHMIEMLRGGPDYLMFLYKTKGPVVFGDSAVLPGVAALGPDAAQVIYSNRNKDYSQQGWVPVIGPFFHRGLMLLDFEEHMFHRRIMQEAFVRSRLAGYLEQMDRVVSRVVADDWVVNDARFLVYPAMKALTLDIASMVFMGHEPGTDHELVTKVNKAFTITTRAGNAVIRTSVPPFTWWRGLRARELLENYFTARVKERREASGNDLLTVLCQTEDDDGNRFSDADIVNHMIFLMMAAHDTSTSTATTMAYQLAAHPEWQQRCRDESDRHGDGPLDIESLEQLESLDLVMNESIRLVTPVQWAMRQTVRDTELLGYYLPKGTNVIAYPGMNHRLPEIWTDPLTFDPERFTEPRNEHKRHRYAFTPFGGGVHKCIGMVFDQLEIKTILHRLLRRYRLELSRPDYQPRWDYSAMPIPMDGMPIVLRPR

SEQ ID NO: 10217 - protein, 368 aa, Mycobacterium tuberculosis H37Rv
MKTTAAVLFEAGKPFELMELDLDGPGPGEVLVKYTAAGLCHSDLHLTDGDLPPRFPIVGGHEGSGVIEEVGAGVTRVKPGDHVVCSFIPNCGTCRYCCTGRQNLCDMGATILEGCMPDGSFRFHSQGTDFGAMCMLGTFAERATVSQHSVVKVDDWLPLETAVLVGCGVPSGWGTAVNAGNLRAGDTAVIYGVGGLGINAVQGATAAGCKYVVVVDPVAFKRETALKFGATHAFADAASAAAKVDELTWGQGADAALILVGTVDDEVVSAATAVIGKGGTVVITGLADPAKLTVHVSGTDLTLHEKTIKGSLFGSCNPQYDIVRLLRLYDAGQLMLDELVTTTYNLEQVNQGYQDLRDGKNIRGVIVH

SEQ ID NO: 10218 - protein, 495 aa, Mycobacterium tuberculosis H37Rv
MTGNLVTKNSLTPDVRNGIDFKIADLSLADFGRKELRIAEHEMPGLMSLRREYAEVQPLKGARISGSLHMTVQTAVLIETLTALGAEVRWASCNIFSTQDHAAAAVVVGPHGTPDEPKGVPVFAWKGETLEEYWWAAEQMLTWPDPDKPANMILDDGGDATMLVLRGMQYEKAGVVPPAEEDDPAEWKVFLNLLRTRFETDKDKWTKIAESVKGVTEETTTGVLRLYQFAAAGDLAFPAINVNDSVTKSKFDNKYGTRHSLIDGINRGTDALIGGKKVLICGYGDVGKGCAEAMKGQGARVSVTEIDPINALQAMMEGFDVVTVEEAIGDADIVVTATGNKDIIMLEHIKAMKDHAILGNIGHFDNEIDMAGLERSGATRVNVKPQVDLWTFGDTGRSIIVLSEGRLLNLGNATGHPSFVMSNSFANQTIAQIELWTKNDEYDNEVYRLPKHLDEKVARIHVEALGGHLTKLTKEQAEYLGVDVEGPYKPDHYRY

SEQ ID NO: 10219 - protein, 502 aa, Mycobacterium tuberculosis H37Rv
MTTLWQPHRNDYSPIPGRGVHARRGARRPRPRGGRAERPGTGQLTRSGRRALLVGLTAASVGVLYGYDLSAIAGALLSLSEEFELTTREQELLTTTAVLGQIAGALGGGILANAIGRKKSVVLIVAGYAVFALLGATSVSVPMLVVARLLLGVTIGLSVVVVPVYVAESAPAAVRGSLVTAYQLATLSGIVVGYLVGYLLAGSHGWRAMFGLAAAPATLLLPLLWRMPDTARWYLLKGRIADARSALRRIQPEADIDAELADMAAAVDERGGGIGEMVRRPYLRATLFVIALGFLVQITGINAIIYYSPRLFAAMGFAGYFAMLALPAMVQVAGLAAVCASLFLVDRLGRRPILLSGIATMITADAVLITVFANDSDGGTGLVLGFAGVLLFIIGFNFGFGSLVWVYAAESFPSRLRSMGSSPMLTSTLTANAIVAAFSLTMLRVLGGAGVFAVFGTFAVVAFVVVYRFAPETKGRKLEEIRHFWENGGRWPAERSPAADEP

SEQ ID NO: 10220 - protein, 536 aa, Mycobacterium tuberculosis H37Rv
MFDTGHQTYPHKLLTGRGKDFATLRQADGLSGYPNRHESPHDWVENSHASVSLAWVDGIAKALALQGQCDRRVIAVIGDGALTGGVAWEGLNNLGAATRPVIVVLNDNGRSYDPTAGALAAHLEELRVGTPRGPNLFENMGFTYIGPVDGHNIPDTCAVLRKAAAAARPVVVHAVTSKGRGYPPAEADERDHMHACGVVDIATGLASTPSQRSWTDVFEDEIARIADDRSDVVGLTAAMRLPTGLGALSRRYPHRVFDSGIAEQHLLASAAGLAAAGTHPVVAVYSTFLHRAFDQLLFDIGLHRLPVTLVLDRAGVTGPDGPSHHGLWDLALLACVPGFQIACPRDAPRLRQQLRTAIATAAPTAVRFPKGAPGEPITAEHTIGGLDVLHTPPPHWRPDVLLVAVGAMSRPCMDAARCLSEEQIGVTVVDPQWVWPISPALTELAGRHRITVCVEDAIADVGIGAHLSHHIGRTHPRTRTYTLGLPPAYIPHASRDHILSSHGLTGPAIRIRCKSLLNALHEVPGPEDHPDSGDSY

SEQ ID NO: 10221 - protein, 375 aa, Mycobacterium tuberculosis H37Rv
MVEIGMGRTARRTYELSEISIVPSRRTRSSKDVSTAWQLDAYRFEIPVVAHPTDALVSPEFAIELGRLGGLGVLNGEGLIGRHLDVEAKIAQLLEAAAADPEPSTAIRLLQELHAAPLNPDLLGAAVARIREAGVTTAVRVSPQNAQWLTPVLVAAGIDLLVIQGTIVSAERVASDGEPLNLKTFISELDIPVVAGGVLDHRTALHLMRTGAAGVIVGYGSTQGVTTTDEVLGISVPMATAIADAAAARRDYLDETGGRYVHVLADGDIHTSGELAKAIACGADAVVLGTPLAESAEALGEGWFWPAAAAHPSLPRGALLQIAVGERPPLARVLGGPSDDPFGGLNLVGGLRRSMAKAGYCDLKEFQKVGLTVGG

SEQ ID NO: 10222 - protein, 529 aa, Mycobacterium tuberculosis H37Rv
MSRGMSGLEDSSDLVVSPYVRMGGLTTDPVPTGGDDPHKVAMLGLTFDDVLLLPAASDVVPATADTSSQLTKKIRLKVPLVSSAMDTVTESRMAIAMARAGGMGVLHRNLPVAEQAGQVEMVKRSEAGMVTDPVTCRPDNTLAQVDALCARFRISGLPVVDDDGALVGIITNRDMRFEVDQSKQVAEVMTKAPLITAQEGVSASAALGLLRRNKIEKLPVVDGRGRLTGLITVKDFVKTEQHPLATKDSDGRLLVGAAVGVGGDAWVRAMMLVDAGVDVLVVDTAHAHNRLVLDMVGKLKSEVGDRVEVVGGNVATRSAAAALVDAGADAVKVGVGPGSICTTRVVAGVGAPQITAILEAVAACRPAGVPVIADGGLQYSGDIAKALAAGASTAMLGSLLAGTAEAPGELIFVNGKQYKSYRGMGSLGAMRGRGGATSYSKDRYFADDALSEDKLVPEGIEGRVPFRGPLSSVIHQLTGGLRAAMGYTGSPTIEVLQQAQFVRITPAGLKESHPHDVAMTVEAPNYYAR

SEQ ID NO: 10223 - protein, 460 aa, Mycobacterium tuberculosis H37Rv
MSRSHPSVPAHSIAPAYTGRMFTAPVPALRMPDESMDPEAAYRFIHDELMLDGSSRLNLATFVTTWMDPEAEKLMAETFDKNMIDKDEYPATAAIEARCVSMVADLFHAEGLRDHDPTSATGVSTIGSSEAVMLGGLALKWRWRQRVGSWKGRMPNLVMGSNVQVVWEKFCRYFDVEPRYLPMERGRYVITPEQVLAAVDENTIGVVAILGTTYTGELEPIAEICAALDKLAAGGGVDVPVHVDAASGGFVVPFLHPDLVWDFRLPRVVSINVSGHKYGLTYPGVGFVVWRGPEHLPEDLVFRVNYLGGDMPTFTLNFSRPGNQVVGQYYNFLRLGRDGYTKVMQALSHTARWLGDQLREVDHCEVISDGSAIPVVSFRLAGDRGYTEFDVSHELRTFGWQVPAYTMPDNATDVAVLRIVVREGLSADLARALHDDAVTALAALDKVKPGGHFDAQHFAH

SEQ ID NO: 10224 - protein, 314 aa, Mycobacterium tuberculosis H37Rv
MNSRAPRNLAVSSPSAQVTGRMVQNGENLFQFRREGPQVQLSFQDRTYLVTGGGSGIGKGVAAGLVAAGAAVMIVGRNPDKLAAAVKDIEALKTGAIGYEPADITDEEQTLRVVDAATAWHGRLHGVVHCAGGSQTIGPITQIDSQAWRRTVDLNVNGTMYVLKHAARELVRGGGGSFVGISSIAASNTHRWFGAYGVTKSAVDHMMKLAADELGPSWVRVNSIRPGLIRTDLVVPVTESPELSADYRVCTPLPRVGEVEDVANLAMFLLSDAASWITGQVINVDGGHMLRRGPDFSPMLEPVFGADGLRGVVG

SEQ ID NO: 10225 - protein, 259 aa, Mycobacterium tuberculosis H37Rv
MTLAEAADAINFGLAGRVVLVTGGVRGVGAGISSVFAEQGATVITCARRAVDGQPYEFHRCDIRDEDSVKRLVGEIGERHGRLDMLVNNAGGSPYALAAEATHNFHRKIVELNVLAPLLVSQHANVLMQAQPNGGSIVNICSVSGRRPTPGTAAYGAAKAGLENLTTTLAVEWAPKVRVNAVVVGMVETERSELFYGDAESIARVAATVPLGRLARPADIGWAAAFLASDAASYISGATLEVHGGGEPPPYLGASSANK

SEQ ID NO: 10226 - protein, 262 aa, Mycobacterium tuberculosis H37Rv
MNLSVAPKEIAGHGLLDGKVVVVTAAAGTGIGSATARRALAEGADVVISDHHERRLGETAAELSALGLGRVEHVVCDVTSTAQVDALIDSTTARMGRLDVLVNNAGLGGQTPVADMTDDEWDRVLDVSLTSVFRATRAALRYFRDAPHGGVIVNNASVLGWRAQHSQSHYAAAKAGVMALTRCSAIEAAEYGVRINAVSPSIARHKFLDKTASAELLDRLAAGEAFGRAAEPWEVAATIAFLASDYSSYLTGEVISVSCQHP

SEQ ID NO: 10227 - protein, 470 aa, Mycobacterium tuberculosis H37Rv
MQGQLSRTRVYTVPVPGSAQSAYACGVERLLASYRSIPATASIRLAKPTSNLFRARVKHDARGLDASGLTGVIGIDPEARTADVAGMCTYEDLIAATLHYGLSPLVVPQLRTITLGGAVTGLGIESASFRNGLPHESVLEMDILTGAGELLTVSPGQHSDLYRAFPNSYGTLGYSTRLRIQLEPVRPFVALRHIRFSSLTAMVAAMERIIDTGGLDGESVDYLDGVVFSADESYLCIGMQTSVPGPVSDYTGQDIYYRSIQHEAGIKEDRLTIHDYFWRWDTDWFWCSRSFGAQNPRLRRWWPRRYRRSSVYWRLMALDQRFGIADRFENSRGRPARERVVQDIEVPIERTCEFLEWFGENVPISPIWLCPLRLRDHAGWPLYPIRPDRSYVNIGFWSSVPVGATEGATNRKIENKVSALDGHKSLYSDSFYTREEFDELYGGETYNTVKKAYDPDSRLLDLYAKAVQRR

SEQ ID NO: 10228 - protein, 152 aa, Mycobacterium tuberculosis H37Rv
MTTDEDLIRAALAVAATAGPRDVPVGAVVVGADGTELARAVNAREALGDPTAHAEILAMRLAAGVLGDGWRLEGTTLAVTVEPCTMCAGALVLARVARLVFGAWEPKTGAVGSLWDVVRDRRLNHRPEVRGGVLARECAAPLEAFFARQRLG

SEQ ID NO: 10229 - protein, 681 aa, Helicobacter pylori J99
MKKKANEEKAPKRAKQEAKTEATQENKAKESNKENKNNKAKEGKIKEAKTKESKVKETAKEPIPVKKLSFNEALEELFANSLSDCVSYESIIQISAKVPTLAQIKKIKELCQKYQKKLVSSSEYAKKLNAIDKIKNTEEKQKVLDEELEDGYDFLKEKDFLEWSRSDSPVRMYLREMGDIKLLSKDEEIELSKQIRLGEDIILDAICSVPYLIDFIYAYKDALINRERRVKELFRSFDDDDENSVSDPKKDDDSEEDEENEERKKVVSEKDKKRVEKVQESFKALDKAKKEWLKALEAPIDEKEDELVRSLTLAYKRQTLKDRLYDLEPTSKLINELVKTMETTLKSGDGFEKELKRLEYKLPLFNDTLIANHKKILANITNMTKEDIIAQVPEATMVSVYMDLKKLFLTKEASEEGFDLAPNKLKEILEQIKRGKLISDRAKNKMAKSNLRLVVSIAKRFTSRGLPFLDLIQEGNIGLMKAVDKFEHEKGFKFSTYATWWIKQAISRAIADQARTIRIPIHMIDTINRINKVMRKHIQETGKEPDLEVVAEEVGLSLDKVKNVIKVTKEPISLETPVGNDDDGKFGDFVEDKNIVSSIDHIMREDLKAQIESVLDQLNEREKAVIRMRFGLLDDESDRTLEEIGKELNVTRERVRQIESSAIKKLRSPQYGRILRNYLRI

SEQ ID NO: 10230 - protein, 812 aa, Helicobacter pylori J99
MRYIKFFKELNNKNVNLVGGKNASIGEMFQELVPIGIKVPDGFAITSEAYWYLLEQGGAKQKIIELLENVDATEIDVLKIRSKQIRELIFGTPFPSDLRDEIFQAYEILSQQYHMKEADVAVRSSATAEDLPDASFAGQQDTYLNIKGKTELIHYIKSCLASLFTDRAISYRASRGFDHLKVALSVGVQKMVRADKGSAGVMFSIDTETGFKDAVFITSAWGLGENVVGGTINPDEFYVFKPTLEQNKRPIIKRQLGNKTQKMVYAPRGSEHPTRNIKTTKKEWQSFSLSDEDVLILAKYAIEIEKHYSKEAKQYRPMDIEWAKDGESGEIFIVQARPETVQSQKTKEENQVFEKFKFKNPNEKKEIILQGRAIGSKIGSGKVRIINDLEHMNSFKEGEILVTDNTDPDWEPCMKKASAVITNRGGRTCHAAIVAREIGVPAIVGVSGATDSLYTGMEITVSCAEGEEGYVYAGIYEHEIERVELSNMQETQTKIYINIGNPEKAFSFSQLPNHGVGLARMEMIILNQIKAHPLALVDLHHKKSVKEKNEIENLMAGYANPKDFFVKKIAEGIGMISAAFYPKPVIVRTSDFKSNEYMRMLGGSSYEPNEENPMLGYRGASRYYSESYNEAFSWECEALALVREEMGLTNMKVMIPFLRTIEEGKKVLEILRKNNLESGKNGLEIYIMCELPVNVILADDFLSLFDGFSIGSNDLTQLTLGVDRDSELVSHVFDERNEAMLKMFKKAIEACKRHNKYCGICGQAPSDYPEVTEFLVKEGITSISLNPDSVIPTWNAVAKLEKELKDHGLTAR

SEQ ID NO: 10231 - protein, 426 aa, Helicobacter pylori J99 [sequence omitted]

SEQ ID NO: 10232 - protein, 368 aa, Helicobacter pylori J99
MLTQEDVLNALKTIIYPNFEKDIVSFGFVKNITLHDNQLGLLIEIPSSSEETSAILRENISKAMQEKGVKALNLDIKTPPKPQAPKPTTKNLAKNIKHVVMISSGKGGVGKSTTSVNLSIALANLNQKVGLLDADVYGPNIPRMMGLQNADVIMDPSGKKLIPLKAFGVSVMSMGLLYDEGQSLIWRGPMLMRAIEQMLSDIIWGDLDVLVVDMPPGTGDAQLTLAQAVPLSAGITVTTPQIVSLDDAKRSLDMFKKLHIPIAGIVENMGSFVCEHCKKESEIFGSNSMSGLLEAYNTQILAKLPLEPKVRLGGDKGEPIVISHPTSVSAKIFEKMAKDLSAFLDKVEREKLADNKDIQPTQTHAYSH

SEQ ID NO: 10233 - protein, 368 aa, Helicobacter pylori J99
MVVLGSTGSIGKNALKIAKKFGVKIEALSCGKNIALINEQIKVFKPKKVAILDPNDLNNLEPLGAEVFVGLDGIDAMIEECVSNLVINAIVGVAGLKASFKSLQRNKKLALANKESLVSAGHLLDISQITPVDSEHFGLWALLQNKTLKPKSLIISASGGAFRDTPLDLIAIQNAQNALKHPNWSMGDKITIDSASMVNKLFEILETYWLFGASLKIDALIERSSIVHALVEFEDNSVIAHLASADMQLPISYAINPKLASLSASIKPLDLYALSAIKFEPISVERYTLWRYKDLLLENPKLGVVLNASNEVAMKKFLNQEIAFGGFIQIISQALELYAKKSFKLSSLDEVLALDKEVRERFGSVARV

SEQ ID NO: 10234 - protein, 405 aa, Helicobacter pylori J99
MFNYEELFQTYKTPFYLYDFDKIKQAFLNYKEAFKGRKSLICYALKANSNLSILSLLANLGSGADCVSIGEIQRALKAGIKPYKIVFSGVGKSAFEIEQALKLNILFLNVESFMELKTIETIAQSLGIKARISIRINPNIDAKTHPYISTGLKENKFGVEEKEALEMFLWAKKSAFLEPVSVHFHIGSQLLDLDPITEASQKVAKIAKSLIALGIDLRFFDVGGGIGVSYENEETIKLYDYAQGILNSLQGLDLTIICEPGRSIVAESGELITQVLYEKKAQNKRFVIVDAGMNDFLRPSLYHAKHAIRVITPCGGREISPCDVVGPVCESSDTFLKDANLPELEPGDKLAIEKVGAYGSSMASQYNSRPKLLELALEDHKIRVIRKREALEDLWRLEIEGLEGV

SEQ ID NO: 10235 - protein, 618 aa, Helicobacter pylori J99
MILQNKTFDLNPNDIAGLELVCQTLRNRILEVVSANGGHLSSSLGAVELIVGMHALFDCQKNPFIFDTSHQAYAHKLLTGRFESFSTLRQFQGLSGFTKPSESAYDYFIAGHSSTSVSIGVGVAKAFRLKQTLGMPIALLGDGSISAGIFYEALNELGDRKYPMIMILNDNEMSISTPIGALSKALSQLMKGPFYQSFRSKVKKILSTLPESVNYLASRFEESFKLITPGVFFEELGINYIGPINGHDLGTIIETLKLAKELKEPVLIHAQTLKGKGYKIAEGRYEKWHGVGPFDLDTGLSKKSKSATLSPTEAYSNTLLELAKKDEKIVGVTAAMPSGTGLDKLIDAYPLRFFDVAIAEQHALTSSSAMAKEGFKPFVSIYSTFLQRAYDSIVHDACISSLPIKLAIDRAGIVGEDGETHQGLLDVSYLRSIPNMVIFAPRDNETLKNAVYFANEHDSSPCAFRYPRGSFALKEGVFEPSGFVLGRSELLKKEGEILLIGYGNGVGRAHLVQLALKEKNIECALLDLRFLKPLDHNLSAIIAPYQKLYVFSDNYKLGGVASAILEFLSEQNILKPVKSFEITDEFIMHGNTALVEKSLGLDTESLTDAILKDLGQER

SEQ ID NO: 10236 - protein, 247 aa, Helicobacter pylori J99
MQFTGKNVLITGASKGIGAEIAKTLASMGLKVWINYRSNAEVADALKNGLEEKGYKAAVIKFDAASESDFVEAIQTIVQSDGGLSYLVNNAGVVRDKLAIKMKTEDFHHVIENNLTSAFIGCREALKVMSKSRFGSVVNVASIIGERGNMGQTNYSASKGGMIAMSKSFAYEGALRNIRFNSVTPGFIETDMNANLKDELKADYVKNIPLNRLGSAKEVAEAVAFLLSDHSSYITGETLKVNGGLYM

SEQ ID NO: 10237 - protein, 481 aa, Helicobacter pylori J99
MRILQRALTFEDVLMVPRKSSVLPKDVSLKSRLTKNIGLNIPFISAAMDTVTEHKTAIAMARLGGIGIVHKNMDIQTQVKEITKVKKSESGVINDPIFIHAHRTLADAKVITDNYKISGVPVVDDKGLLIGILTNRDVRFETDLSKKVGDVMTKMPLVTAHVGISLDEASDLMHKHKIEKLPIVDKDNVLKGLITIKDIQKRIEYPEANKDDFGRLRVGAAIGVGQLDRAEMLVKAGVDALVLDSAHGHSANILHTLEEIKKSLVVDVIVGNVVTKEATSDLISAGADAVKVGIGPGSICTTRIVAGVGMPQVSAIDNCVEVASKFDIPVIADGGIRYSGDVAKALALGASSVMIGSLLAGTEESPGDFMIYQGRQYKSYRGMGSIGAMTKGSSDRYFQEGVASEKLVPEGIEGRVPYRGKVSDMIFQLVGGVRSSMGYQGAKNILELYQNAEFVEITSAGLKESHVHGVDITKEAPNYYG

SEQ ID NO: 10238 - protein, 425 aa, Helicobacter pylori J99
MNFLEDLFYPLRLLENKRVLLLVSGSIAAYKSLELVRLLFKSGASIQVVMSKGAQKFIKPLSFEALSHHKVLHDRNEKWYYNHQNKLHHNHIACAASADLLIFAPLSANSLSKIAHALADNTISATFLACASPKILAPSMNTNMLNSPIIQSNLKRLKDSNHIILDTQNALLACNTKGDGAMAEPLEILFKATQTLLKDAYFENREVIVMGGASVEKIDSVRVISNLSSGIQASALALALYFKGAKVTLIASNFPTPLPKEIASVLVSDTASYENALNEAAKNLQKHALKPLLFNLAAISDYLPKTSFNHKLKKSELGETLNVECVQNKDLLASVNPNQFVKIGFKAEDDQQNAIKNAQNLLKPSQDNGKDCSVAALNLIKDSRPFGSLDNELWLFSHKKTQKIPSMNKLEASFKILDFIKDNAL

SEQ ID NO: 10239 - protein, 325 aa, Helicobacter pylori J99
MKVFDYEDVQLIPNKCIVNSRSECDTTVILGKHAFKMPIVPANMQTIINESIAEFLAENGYFYIMHRFNGSARIPFVKKMKERQLISSISVGVKKEECLFVEELAKQGLTPDYITIDIAHGHSNSVIEMIQRIKTRLPETFVIAGNVGTPEAVRELENAGADATKVGIGPGKVCITKIKTGFGTGGWQLAALRWCAKAARKPIIADGGIRTHGDIAKSIRFGATMVMIGSLFAGHEESSGETKIENGIAYKEYFGSASEFQKGEKKNIEGKKIWIQHKGSLKNTLIEMHQDLQSSISYAGGRDLEAIRKVDYVIVKNSIFNGDTI

SEQ ID NO: 10240 - protein, 230 aa, Helicobacter pylori J99
MALYDRANSRNAYAEDSVLHESELVSFVKTTYKFFAGSLLLATVGALLGLMNFQAVVQYKWVFFIAEIVAFFGLMFSKSKPGLNLFMLFAFTSLSGVTLVPLLGMVIAKAGLGAVWQALGMTTIVFGLMSVYALKTKNDLANMGKMLFIALIVVVVCSLINLFLGSPMFQVVIAGASAILFSLYIAYDTQNIVKGMYDSPIDAAVSLYLDFLNVFISILQIIGIFSDRDK

SEQ ID NO: 10241 - protein, 171 aa, Helicobacter pylori J99
MLDLSYSLERVLQEDPAARNKWEVLLLYPGIHALLCYRLAHALHKRRFYFIARALSQLARFITGIEIHPGAKIGRGLFIDHGMGVVIGETTEIGDDVTIYHGVTLGGTGKFKGKRHPTLGNRVVVGAGAKVLGAICVGDDVRIGANAVVLSDLPTGSTAVGAKAKTITKDR

SEQ ID NO: 10242 - protein, 485 aa, Bacillus halodurans
MWENKFQKEGLTFDDVLLVPAKSEVLPRDVSVKTKLTETLQLNIPIISAGMDTVTEAKMAIAIAREGGLGIIHKNMSVEEQAEQVDRVKRSESGVITNPFFLTPDRQVFDAEHLMGKYRISGVPIVDEDQKLVGILTNRDLRFIEDYSTLIDDVMTKENLVTAPVGTTLKEAEEILQKHKIEKLPLVDESGTLKGLITIKDIEKVIEFPNSAKDSQGRLIVGAAVGVSADTDVRVAALVEAGVDVIVIDTAHGHSKGVLEKVKAIREQYPDLTIIAGNVATAEATRDLIEAGANVVKVGIGPGSICTTRIVAGIGVPQITAVYDCANEARKHGVPIIADGGIKYSGDIVKALAAGGHAVMLGSLLAGVSESPGEREIFQGRQFKVYRGMGSLGAMEKGSKDRYFQENNQKLVPEGIEGRIPYKGPLHDTIHQLVGGIRAGMGYCGTKTIDELRENTQFIRITGAGLRESHPHDVQITKEAPNYTL

SEQ ID NO: 10243 - protein, 159 aa, Bacillus halodurans
MQKDDLYYMREALVQADEAERLGEVPIGAVIVKDGVVVAKAYNLREINQQAIAHAELLAIEKACKALGTWRLTGCTLYVTLEPCPMCAGAIVQSRIERVVYGATDPKAGCAGTLMNLLNEERFNHQTIVESGVLEEECSQRLTAFFRKLRERKKRGSDT

SEQ ID NO: 10244 - protein, 229 aa, Bacillus halodurans
MKRIFKTLLNDIDVVFEQDPAARSRLEVIFTYSGVHAIWAHRLAHWLWRKKLYFVARFLSQVSRLITGIEIHPGAKIGQRLFIDHGMGVVIGETCEIGDNVTIYQGVTLGGTGKEKGKRHPTVEDHVLIASGAKVLGSFTIGKNSRIGAGSVVLNEVPPNSTVVGIPGKVVIRDGIKVNRDLDHHLLPDPVSDKFRELEKQLEALQKEIEELRKNNLPKSASNHSVKEG

SEQ ID NO: 10245 - protein, 490 aa, Bacillus halodurans
MKRDHYRMVINGERVDSDETFETFNPAKGEILATVAKASREHAEKAVQAARHAFDHGKWRKYPVGKRARVLNQIAAIMRERFQELVEIEVLNSGKAISAAQAQINQAIEDFEFYAGAIVGHRGTVNNVPNGFLNYTQKEPVGVCAQIIPWNYPLMMAAWKVAPALAAGCSVVVKPASLTPITAILLNEICHEAGVPEGVVNTVAGAGSVVGDYLVGHEDVNKVAFTGSTPIGKDIMEKASHTLKRVTLELGGKSPNLVFADADMEAAVAGSLFGIYFNTGQSCEARSRLFVHEEIYDEFIEEFITRAKKLQLGDPFDKGTHVGSIISRDQLEIIDSYVRSAEEEGATIALGGKERRVEGFENGHWYEPTVITNVTPDMKAVQEEIFGPVVVVETFQDEREVIKRANDTKFGLGSAIWTKDQGRATRVAHQLEAGIVMVNCPFSAFPGTPFGGYKESGFGRELCVETLDLYMEDKSILSYYGPKPINPFGV

SEQ ID NO: 10246 - protein, 328 aa, Bacillus halodurans
MGSQQQTMLQAINQTLDDLLATNDDVMLLGEDIGINGGVFRATDGLYEKYGKDRVVDTPLAESGIIGSAIGLAMNGKRPIVEIQFLAFIYPGFEQLISHAARMRYRTRGQYNVPMVIRTPYGAGIRGPELHSESVEAFFAHTPGLKVVAPSNPYDAKGLLTAATSDPDPVIFLEDTKLYRAFKEDVPNTLYEIPLGQAKVVQEGEDVTVIAWGGMVREALQAAKEAEKAHGWSCEIIDLRTIAPIDRETIIESVKKTGRAIIIHEAHKTAGLGGEITALINEEALIYLKAPVKRIAGFDIPVPQFLSENQYLPTIERMFRGIEETVSF

SEQ ID NO: 10247 - protein, 350 aa, Bacillus halodurans
MLTEEKVLAALNRVKDRDLNKSIVETGGIRELKISGANVSVKVALAQTGTREQMEIQQEIVNVLKGEGAESVGLRFDQLDETEIEKLGGLPKQEFHGPPLLHPNTSTTFIAVTSGKGGVGKSTVSVNLATTLARLGKKVGIIDADIYGFSVPDMMGIEERPKVVGEQIFPVERFGVKVISMGFFVEDNAPVIWRGPMLGKMLNNFFAEVEWGDLDYLILDLPPGTGDVALDIHTMLPHSKEILVTTPHATAAFVAARAGAMALKTHHEIIGVVENMAYFESKITGEKEYVFGQGGGERLAEELKTEVLGRIPLGQPEIDEDDFAPSVYGATHPIGEIYTAIAKRVIDKTT

SEQ ID NO: 10248 - protein, 311 aa, Bacillus halodurans
MNQTISAQLKIMFAMVIVGSSVVAGKMLVESFPVFLASELRFLIAALILVPMLLKKEGIPTFSKKEVGILFLQALSGVFLFSIFMLYGLMYTTAMEGGIIMSTLPAVVALMAFITLKEKLTRLTIIGILLAVGGTLAINTSGTLSDVERGVAPLLGNLLIIGAVISEALFIIFGKSISQRVSPLAISTMVSVFGVVLFLPFAIYEATRFPLTDVSLNDWLIIFYFGVVVTVIAFVLMYQGIEKVPASTVGVLTGVLPISAVLLSALILKESFSTFHVAGMGLVLAAILLISIDSNVEKKEVASLKKKKGIS

SEQ ID NO: 10249 - protein, 498 aa, Bacillus halodurans
MQKISTNDSKLNPRLVAFLNGGPKKLFINGEWVDSFSGQSFETMNPATGETLALVAEAGSEDIDFAVKAARKAFDEGPWSKMSAAERSRLIYKLADLIEDHKEALAQLETLDNGKPIRETANADIPLVIEHFRYFAGWATKIVGQTIPVQGHYFNYTRHEAIGVVGQIIPWNFPLLMAAWKLGAALATGCTVVLKPAEQTPLSALYLGELINEAGFPKGVVNIVPGFGHSAGTPLVNHPAVDKVAFTGSTDVGKLIMKQASESLKRVTLELGGKSPNIILPDADLSKAVPGSLMGIMFNQGQVCCAGSRLYVQKKQYDHVVADLVSLTNEIQQGDGLLEQTTMGPLISNQQQSRVKNYIDRGVEEGAELLTGGNIPYDQGYFVAPTIFADVDHSMTIAKEEIFGPVVAAMPFDSIDDLIDKANDSDYGLAAGVWTQDIKKAHYIAHRIKAGTIWVNCYNVFDAASPFGGYKQSGIGREMGSYALENYTEVKSVWVNMD

SEQ ID NO: 10250 - protein, 507 aa, Bacillus halodurans
MSLVEIFRFRNERIKILHLTWIAFFISFFTWFNMAPLATTMMESMDWLTREHIAALAIINVALTIPARLIIGMLLDRFGPRIVYSSLLVLMAIPAFMFAFGDTWTQLMISRLLLSSIGASFVVGIRMVAEWFPPKDVGFAEGIYGGWGNFGSAVAAMVLPWFAITMFGGPEGWRYAMAFTGVVCLIYGVIYYLFVRDTPEGKTFVRAKRTGAMEVSSWKDLIWLIVWTIPLHAALGVLAWRLEGMGFLSETILYTIYLVLAVALVYQVYTILKVNVPLLKKGIPEDDRYSFKNVAALNSTYFANFGAELAIISMLPMFFQLTFSLTPAQAGLIASSFAFINLFARPLGGILSDRMGSRRNIMLVYMAGITIGLVGMGFMDSNWPLVVAILITVFTSVFIQGAEGATFAVIPMIKKRMTGQVAGMAGAYGNVGATIYLTLYTFVTPQQFFFILAGGALASFVICYFWLEEPENSFASEYALSSVDEQVVQEAEVSEAEESVVVQKKVL

SEQ ID NO: 10251 - protein, 458 aa, Bacillus halodurans
MKPTETLQEKGKLFLVVMMPILITQIGLYAMNFFDTVMSGQAGANDLAGVAIGSSLWVPVFTGLNGVLLALTPIIAQSIGAEKRDDVPYVFLQGLYLSIAISIAVILIGAVVLDPILSAMSLEDEVGRIAKEYLIGLAFGIVPLFIYTTIRCLIDSLGETRVTMFITLLSLPINIFFNYVLIFGKLGFPRLGGVGAGYASAITYWFILAVAIVVVVKVRPFTDFQLFKKLYHVSLKKWKEILLLGLPIGFTIFFETSIFAAVTLLMSTFDTATIAAHQAAVNFASFLYMIPLSIAFTLTIAVGYEVGAKRVEDARQYSRLGITFALIMGLVAGVIIYVLRAPVASLYTNDSQVAWLIQQFLIYSIFFQLSDALATPIQGVLRGHKDVNVPFVMALVSFWIIGLPTGYLLANFSPLGPYGYWIGLITGLASCAIALSWRLKQMQRKFERAARLSQNGNS

SEQ ID NO: 10252 - protein, 252 aa, Bacillus halodurans
MDLQLKDKVVLVTGGSKGIGKGIAQAFVEEGAKVAIVARDAHGLQEAKRQLGNVLTIQADVTDKNEREKVFSQLLETYGTIDILVNNAGGSNGGLISETELSLFEEAFSLNYFSAVHFSQLALPVMKAKQSGAIINISSIFGRESGGKATYNSAKAAMISFTKSLADEVIRDGIRVNGIAPGSILHPTGNWQKRLEENREKMEQFIDQNIPAGRFGTVEEIANVAVFLASEKASWVVGATLNVDGGQSYSNF

SEQ ID NO: 10253 - protein, 411 aa, Bacillus halodurans
MSTATLSQETKQIVKATVPILAEHGEAITKHFYKRMFSHHPELLNIFNQTHQKQGRQPQALANSIYAAAEHIDNLEAILPVVSRIAHKHRSLNIKPEQYPIVGENLLAAMREVLGDAASDDVLEAWREAYELIADVFIQVEKKMYEEASQAPGGWREFRSFVVEKKQRESATITSFYLKPEDGKALASYKPGQYITVKVTIPGHEHTHMRQYSLSDAPEKGYYRITVKREEGDGDLPPGIVSNYLHQHIHEGDVLEITAPAGDFTLQEEGERPIVFISGGVGITPLMSMFNTLMQRGVKREVIFIHAAINGFYHAMHDHLAQTASQQENVHYAVCYERPTPGDRMNPFMKKEGFIDESFLRSILHDREADFYFCGPVPFMKTIAQILKDWDVPEQQVHYEFFGPAGTLASS

SEQ ID NO: 10254 - protein, 281 aa, Bacillus halodurans
MLPINENLKGKVAVITGGSGVLCRAMAYELGRQGVKVAILNRNRDTGNEVAETIREAGGDALAISCDVLEVDQVKAAEKQIRKEFGACDILINGAGGNHPDGTTDEEIVRMENVAKKTKTFFDLTVEGFQRVFELNLISAMVSSQVFAKGMTHRKGAVIINMSSMSGPTPMTKVPAYSAAKAGIDNFTKWLAVHMVEVGIRVNAIAPGFFLTDQNKKLLLQDDGSWTERSKKILSHTPMRRFGKPEDLLGTVIWLADETMSGFVTGVTVPVDGGFMAYSGV

SEQ ID NO: 10255 - protein, 372 aa, Bacillus halodurans
MAEKPLRPLAEGELSIDQVKEQLVELGKKRGVLTYAEITEKLAPYDQDSDQMDEFFEYLGEQGVEILNDNEEVPSLQQVEKEEEEFDLNDLSVPPGVKINDPVRMYLKEIGRVPLLTAEEEIELATRIEQGDEEAKRRLAEANLRLVVSIAKRYVGRGMLFLDLIQEGNMGLIKAVEKFDYNKGFKFSTYATWWIRQAITRAIADQARTIRIPVHMVETINKLIRVQRQLLQDLGREPSPEEVAEEMDLTPEKVREILKIAQEPVSLETPIGEEDDSHLGDFIEDQDALAPSDAAAYELLKEQLEDVLDTLTDREENVLRLRFGLDDGRTRTLEEVGKVFGVTRERIRQIEAKALRKLRHPSRSKRLKDFLE

SEQ ID NO: 10256 - protein, 566 aa, Bacillus halodurans
MKEGNYTYTTEKPGSVFSISAVLIGLFVLWGAVSPSSLEWAAGIGLGWMIENFGWFYMLTTAFFVIFSIVIAISPYGRLRLGKQNDRPEYSWYSWIGMLFAAGIGVGFVFWGVAEPVLYYLDTPVGYIPGTREAAIAGLRYGVYHWALHPWAIFSIVGLTLAYVQFRKGRPALISSAFYPLFGEKVNGFAGRSIDILAVIATCTGVATTFGLSAMQITGGLSYISSIPNSVWTQLTIIAIVTCLFMISAGKGVNKGIKTLSNINLAVAAILLVFVIAVGPTLFIAENIVTTLGGYISNVIPMSLTMTPFYESEWLGTNTIFFWAWHIAWAPFMGLFIARISRGRTIREFMAGVLIVPSLLALIWFTTFGGTALNLEMYGPGGIAELVTSQVELALFATLGELPLSAVTNVIAVLLILIFFITSADSASYVLGAMTSKGSLEPKLSVKMVWGFLIAGTASVLLLSGGGGLQALQTASIIAALPFAVIMIMMIISLLFMFAKDDRAERKQKQTKQLSTLKEEIRDEMYDDMKQEVYEEVKEQVYEDVYEEVKEEVKDEILDELDQESK

SEQ ID NO: 10257 - protein, 252 aa, Bacillus halodurans
MDVEVKQNEKEQPFTDEEIKQLIAQSQAGDQEARDQIVSRNTRLVWSVVQRFLNRGYEADDLFQIGCIGLIKSVDKFDLSYDVKFSTYAVPMIIGEIQRFLRDDGTVKVSRSIKELGNKIRKLKDDMTKTLGRTPTVNEIAEQLEITPEEVVFAGDASRSLSSIHETVYENDGDPITLLDQLEDQSETRWFDKIALKEAIHNLEERERLIVYLRYYKDQTQSEVAQRLGISQVQVSRLEKKILETMKANIAE

SEQ ID NO: 10258 - protein, 439 aa, Bacillus halodurans
MFFHGTSRVNGKGHLEIGGVDTVELANLYGTPLFVYDVALIRERAKDFKQAFADEGVQAQVAYASKAFSCIAMFQLAEELGLSLDVVSGGELYTAQQAGVSMERIHFHGNNKSRAEIEMAVEAGIGCFVVDNFYELDLLADICEQKRATANILLRITPGVEAHTHDYISTGQEDSKFGFDLVSGQATLAVKKALAVDSIHLLGVHSHIGSQIFETTGFVMAVEKIFEHLVTWREDHGFEPSVLNLGGGFGIRYIEGDTPRPVGDYVKEMIRAVKQQIAEHEMSMPEIWIEPGRSLVGDAGTTLYTIGSRKEIPNVRHYLSVDGGMSDNLRPALYQAEYEGALANRVNEQPVGMFSVAGKCCESGDMLIWDLPLPEANHEDILAVFCTGAYGYSMANNYNRIPRPPVVFVEDGDAQLVIQRERYEDLVRLDMPLVKKVKV

SEQ ID NO: 10259 - protein, 661 aa, Bacillus halodurans
MLLLSLIALTSNFCWWGFFVVTGIKVLFYPFDLIISTTCFAAVWFRRYFTIQRKTDKLVDQLKRANKTKDDFLANTSHELRNPLHSILNLSEGILEREKRSLNEKSVADLKIVLSVGRRMSFMLNDLLDAMSLKENTPRLMLQHLSIHTIANGVLEMFRFMVEGKPIRLNNQIPENIPNVLADESRVIQILFNLVHNAVKFTREGEISLEAYVKDDRVYIAIRDTGIGMDKDALKRVFDPYEQVRSEETMVEGGFGLGLSISQKLVELHGGILTVRSTPGQGSVFTFSLQISKQTGLADDNHLLVQSDRENELAAATLSKPTISPVAYRPRILVVDDEPVNLKVIASILANEAYEVKTVISGEEAIAVLDTKEWDLVVADVMMPKMSGYELTKNIRQRFTLTELPILLITARSRPEDIENGFRAGANDYLTKPVNLLELRARIKALTEAKQSIRDQLRMEGAWLQAQIQPHFLFNTLNAILALSEIDIKRMQKLLEVFADFLKNKFTFTNLDELAPIEIELSTVQSYLYIEKERFAQRLNVRWEVEDCKALMIPLFTIQPLVENAVKHGLNRSSGGEITIKIKNEDTYVKVTVTDNGVGMDENIVQHLLTERPSARSGIGLRNTDMRLKRHYGKGLHIESKLGVGTSVSFLVQKQMVQADV

SEQ ID NO: 10260 - protein, 594 aa, Bacillus halodurans
MLWRSVVGKLWFTIILLVSFVLTVLMVMLLQFFERFHVNEAESQLLNHANMIATIYEEYDDRVTARMTITEYANAFEKKVVIIEDRANYWSTGEAGLVNLPLEVFVEHPMLSQVFQGERAVVTEDDFSEFYRGDSDTGMMIVGIPLHLDDGNDAVFLYQPLATIEETSAETKRIVYFSAGIAIVLTTVFAFFLSSRITSPLRKMRQVALEVAQGKFNTKVPILTHDEIGQLAIAFNRMRRELNRNVTELNQEKEQLSRILSSMADGVITLDKRGKVMVTNPPAERFIQAWHYEQGLVPSEKNELPQAIHQLYQQVVALESEQMTELDVQGRSWAILMTPLYDNSYVRGAVAVIRDMTEERRHDKLRKDFIANVSHELRTPISMLQGYSEAIIDDIAGTDQEKKELAKIIYDESLRMGRLVNELLDLARMEAGHIDLSYEEIEVKTFCERITRKFQGLAKEQQLTLDFIYRGDEGKRIQVDPDRLEQVLTNLLSNAIRHTDPGGTVQLACHVMENGVKIDVTDTGTGIPEEDLPYVFERFYKADKARTRGRSGTGLGLAIVKNIVDAHSGEISVHSKQQEGTTFTAFFPNARTIL

SEQ ID NO: 10261 - protein, 618 aa, Bacillus halodurans
MTNLVEALKTNILVGDGAMGTLLYEQGIDRCFEELNVTDPEKIVAAHVAYVEAGADVIQTNTYAANRMKLAKYQLDDQVLEINRAAVRLARKAAKQETFVLGTIGGIRSVQFEEVEIQEVQDVFLEQMKALVSEGVDGLLLETFYDLEEAKLAVSLARSLTDLPVIAHLSIAEIGVLQGGKLLEEAFAELEGLGADLVGINCRMGPYQMLRSLETVQLLDRAYYSAYPNASLPDYRDGRLYYHSNPEYFYEMGKRFVQQGVRLLGGCCGTTPEHVRAFAKVVKGLKPVVSKPVRLEIKETLSSTGQKTAREPLAEKVKKQPSIIVELDPPKNLAIDRFVEGAAALKNAGVDAVTMADNSLASPRVDNLALGAIIQQQVGARPLVHVTCRDRNLIGLQSHLMGLHALGMTDLLAITGDPTKVGDFPGATSVYDVTSFQLISLIKQLNEGISFSGKELGQKANFSVGAAFNPNVRHLERAVQRMEKKIEAGADYFMTQPIYNEKQIEDIYEATKHIEKPIYIGIMPLINGRNAEFLHNEVPGIKLTDQIRERMARAGEDRQKGEREGLAIAKSLLDVATHYFNGIYLITPFLRYGMTVDLTHYVKETHHQIRQPERSVQK

SEQ ID NO: 10262 - protein, 306 aa, Bacillus halodurans
MNRWLTYFLVFFVMVLWGLNVVMLKLLVTSFPPVTMTALRIFVAGFVVLLVLLLLKTFRQLTATEWKYVILAAIFGVLGHHFFLSIGLTMTSASNAVLILALLPLTTSLLAILLLGDMLTRWRGFGIFLGLIGVCTIVLFGEGGLAGIRTGDGVIFLAMMIQALSFVYIKKATDTLDAKQVTGMMLLIGSLLLFVTSFIIEPNGLASMGDKALWIWWVFVISAVFATGLGHIIYNQAIHQLGTGETAIFNNLVPFFGLLFSALFLGEAIALAQIAGLLFIVAGVILGTGHVDAWMQKRKRRFDQVG

SEQ ID NO: 10263 - protein, 247 aa, Bacillus halodurans
MLLRDKVAIVTGATRGIGKEIVKTFVEQGAFVYGIYASNHEAAREIEKTLNQGEKCVSYVSGSVDDQLFIHSLFKSVVDKHNRLDILVNNAGITRDQFLFQMDDQSWQQVLQVNFGGTYTCCHAALPYMERKKQGKIVNVVSVTGVVGREAQTNYGASKGAIIGLTRLLARKYSEKGISINAIAPGMIETEMIKQVPEEKLKNFLRFTNAKKLGSTKEVARNVLYLSSDLSDYVTDTVLKVDGGFLR

SEQ ID NO: 10264 - protein, 366 aa, Bacillus halodurans
MKIQAAVLHNKGEPFSIEEVELAEPKADEILVKIVASGVCHTDAVAREQLIPIPLPAVLGHEGSGVVEAVGTHVTSVKPGDHVVLTFTTCGECENCQSGHPSFCTEFAPLNFFGKMSDRTNRIQQNGKDVSTFFGQASFGTYAIANARNVVKVDPDVDLALLGPLACGIQTGAGTVLNKLRPEFGSSVAIFGCGAVGLSAVMAAKIVGCQKIIAIDIHDSRLALAKELGATHVFNGNDSRLVEAIQAVTNGGTNYAVETTGISHVFHQSIKALTTLGVVAVVGVGGDVTVNMNDDILSQGKTITGVIEGDVVPQLFIPKLIDYYKAGHFPFDRLVKLYELDEINQAFEDSKNGSAVKPIIKMNHHI

SEQ ID NO: 10265 - protein, 914 aa, Bacillus halodurans
MQRIFDSFLLYANGELVEERRAPTITESVARSSLIPSIVRVTPDENGWIHLMIAVSSSENIYDGGVLKSIRFGTEVAMNREHWSTSAAQLMVAAIMFIHGIYACILFFIRPKKIELLYFMVAVLLSAFSVLVSDERLLLQWVPLNYEWFIKLAYLSYTGLSLFFLLFVRYLFSNYKRNQSVRWISGFCALYALFILIAPATTIREWTIMLLFVLAIPFTTIILLVVQVILKKERDSLFLLLAAISVASSILWSSFTGRVKSFEWGILSQIDYSFYPVDLTLAFLCFSTFWFIRFFRANDDKADLVTKLQKEHVKKDQFLANTSHELRNPLHGMINIAQGVVEQEGGRLAPESRQNLELLMTVGRRMSYLLNDLIDVTKMKQKKVTLTKQPTNLLAAVTTVVNVQRFMVEAKNLRIEVNIPHDFPLVYADETRLGQILFNLVHNAIKYTEEGTIVIEAKVKKKRAVIRVKDTGIGMDEETQKRIFHPYEQGAKEHYHENGGFGLGLSICRDLVSMHNGTLAVQSAPSKGSIFTFTLPLASSSEREEKQRDAGQEVVRFREHKIDEEVAASHLPTSAPVRTEGLERKPKILIVDDDAVNLHVLKNIICSEAYTIEAVTSGEEVLDRLDQGWDLILADVMMPSMSGYELTREIRNQFSISELPVLLLTARGQPEEVYTGFMSGANDYLVKPIDALELKVRIRAVIELKHSIQERLRMEAAWLQAQIQPHFLFNTLNTIASLSEIDTKRMAALLEKFGQFLRKSFDGQNIHSLVPITHELALTESYVYIEQERFGERLKVHWDKDEHVVCNLPPLSIQPLVENALKHGVLKKPEGGNVHIRIKKQEETVKIMITDDGVGMDKATLNNVLTRKPDQVSGIGMLNTDLRLKQLFGKGLFVESQPGKGTSISFYVPLNKLE

SEQ ID NO: 10266 - protein, 500 aa, Bacillus halodurans
MKKSYGVMGGVLAVFFAIAGCSSDDHSEMDHGNNQQDEQNEGTFEDGKKVFNLEVTETHWMFNDEVMMDAWTYNGTLPGQEIRVQEGDEVVINVKNSLNVPTALHLHGFPVPNEMDGVPGVTQNAIMPGEEFTYEYQANVPGTYWYHSHQDGATQVDRGLYGVFIVEPVDPESYDTDVAIVIDEFASMGMGMGMDHSTMDHGDMEHDGNDDMSHSEMMNEMYDTMVINGKADPQIESINVVEGNRVKLRFVNAGLFTQVVSIPEHSFKITHYDGQPVNEPDVLQDTAFRIAPAERYDLEIIMDNPGAWGIQVFAEENQERLQALIPLVYEEYEDEELQTVDSISSFFDLTTYGIPKELDIGDITKEYDMLLGSDDGGDTFTINGKKFPNHEIYDVEEGDMVKFTIINDTDFDHPMHLHGDFFHVISKGGKAIQGSPVLKDTLNVRPGETYEIVFEAKNPGNWMFHCHEFHHASGGMVAEIHYEGFELPFTPDPNIPNMPE

SEQ ID NO: 10267 - protein, 257 aa, Bacillus halodurans
MKNQTIIVTGGSNGMGKAMAARFASLGANVVITGRDQERLETAKSEVAQDSGRVLTVQMDVRNPDDVERMVKDTLSEFGAIDGLVNNAAGNFLCAAEDLSLNGWKSVIDIVLNGTWHCTQAVGKEWIKDGRKGHILNMVATYAWTAGAGVVHSASAKAGVLAMTRTLAVEWGTKYGIRLNAIAPGPIEGTGGAEKLILNETFQKAVLQTVPLKRFGTLEEIAGLAAYLFSEEATYMNGECISLDGGQWLRGTLFPFS

SEQ ID NO: 10268 - protein, 276 aa, Bacillus halodurans
MANNLQATTTLHNGVKMPWFGLGVFKVSEGDEVIQSVKDAIRAGYKSIDTAAVYGNEEGVGKAIAESGVPREELFITSKVWNADQGFDSTISAFNTSLKKLGLDYLDLYLVHWPVKGKYVETWKALEKLYQDGLVRAIGVSNFQVHHLKDVLEAGSIVPMVNQVEYHPHLTQTELHDFCKQNKIQLEAWSPLKQGQLLNDPTIVAIAEAHQKTPAQIILRWDLQNEVVTIPKSVKKDRIISNADIFDFQLTEEDMQKINELNKNERVGPDPDNFDF

SEQ ID NO: 10269 - protein, 464 aa, Bacillus halodurans
MEQKQQSERLGTEAIPKLLRSLSIPAMIGMFVMALYNVVDTIFISYAVGIEGVAGVTIAFPIMMIMMSMAGALGIGGASVISRRLGERRGEEANQVFGNILTVILVLSVIGFISAFTLLGPALQLFGATSVTQGYATDYLFPILLGSIFFFFAFAANNIIRSEGNATFAMVTMIVPAVLNILLDVLFIFGLNMGVLGASIATVIAQASVTGLVLRYFLTGKSTLSLHWSDLRMKGSVIKEVCLVGLPAFVQQSSASLMMIAINSMLLRFGSDFYVGVFGLVQRIMMFVMMPMMGIMQAMQPIVGYNYGAKQYSRLRETVMLGFKVATIFSIGIFALLMLFPEALLRVFTADREVIQAGVSAMHILFCVTFLIGAQIVAGGLYQSLGKPKQALILSLSRQIIFLIPLVLILPHIFGLSGVWWAFPIADVLSFILTVVLLYRDRNVFFLKTKEERELDLVKTASST

SEQ ID NO: 10270 - protein, 250 aa, Bacillus halodurans
MQLFSLEGKIALVTGASRGLGQGMAVGLAEAGADVIGAGISDMSETRQQIESLGRTFYELKADLFEEGAGKQLIADAIEKAGRIDILVNNAGIIRRNEAEAFTDKDWNDVINVNLNAVFQMCREAGNHMIENGFGRIINIASMLSFQGGLRVPAYTASKHAIAGLTKSLANEWSKKGVNVNAIAPGYMVTDNTAALRADEVRNAYITSRIPKGEWGTPADLKGPVVFLASEASSYVNGHILCVDGGWMSS

SEQ ID NO: 10271 - protein, 242 aa, Bacillus halodurans
MKQRRVLVTGASGGIGAAISKALAAPHTTLYLHYYQNERSIDDVRLACEQLQAEVVTVKADLSHAAGVEELLTQCGSAIDVFVHSAGQSVEKLFLDTSTSDIMRTFQQHLFSFMELSRGFLPHMLRNRYGKIVAVSSVWGETGAAYEVVYSAAKSGMNGFVKALAKEMAPNGIQVNGVAPGAINTSMLSSYTEEEVLALTEEIPAGRLGTPMEVAETVAFLCSERATYIHGHVLSVNGGWYC

SEQ ID NO: 10272 - protein, 365 aa, Bacillus halodurans
MDVLANHRDKFRLVAMSVGKNLTLAEEQIHQFKPPLVSVMTDEDRKTLASKVPEGTRVVCGEEGLIEVATAEKAEILVNAVIGSVGLAPTLAAIEAKKTIALANKETLVTAGHLVTEKAREHGVKLLPVDSEHSAIFQALQGERMDRLHRIIITASGGSFRDKSRDELNGVTVEDALKHPNWSMGAKITIDSATMMNKGLEVIEAHWLFNLPYEKIDVLLHKESIIHSMVEFVDRSVIAQLGTPDMRVPIQYALSYPDRLEFHEGQQLNLWEVGKLHFAPLDMERFRCMAFAYESGKQGGTMPTVLNAANEEAVELFLNNQLSFLGIEDVIEKALERHERIDSPSLADILHVDQETRAFVHSLIK

SEQ ID NO: 10273 - protein, 246 aa, Bacillus halodurans
MLQGKTAIVTGASRGIGRATAMELARHGANVVVNYAGNKEKAEKVVAEIKELGVEAIAIQADVADSESVQAMVKETIDTFGAVDILVNNAGITRDNLFMRMKEEDWDAVIDTNLKGVFHCSKAVTRPMMKQRFGRIINVSSVVGAIGNAGQANYVAAKAGVIGLTKTLARELANRNITVNAVAPGFIETDMTGELPEDVKAQMLGQIPLARLGQPEEVAKAVRFLASDDASYLTGQTIHVNGGMVM

SEQ ID NO: 10274 - protein, 261 aa, Bacillus halodurans
MTRNKVEICGVDTSKLPVLKNQEMRELFARLQSGDTSARETLVNGNLRLVLSVIQRFNNRGEYVDDLFQVGCIGLMKSIDNFDLSQNVKFSTYAVPMIIGEIRRYLRDNNPIRVSRSLRDIAYKALQVRDQLMGEKQREKEPTVQEIAKELGVPKEDVVFALDAIQDPVSLFEPIYNDGGDPIYVMDQISDDRNKDVQWVDEIALKEAMVRLNDREKLILNMRFYQGKTQMEVAEEIGISQAQVSRLEKAAIQQMSKHAQS

SEQ ID NO: 10275 - protein, 504 aa, Bacillus halodurans
MGKYKVFIISVAIAAIFIAWGLIAPKNLAAVTKVIDSFILNELGWFYLLSATGFLAFAIFLIFSKYGNIRLGKQEEKPEYSYLTWFAFLFTAGMGIGLVFWGVAEPVYHYFDPPIAVPETAQAAGEAMRYSFFHWGLHPWAIYTIVALAIAYFTFRKGESGVLSSSFRPLIGDRVEGWIGTVINVIVVFATIFGVATSLGFGAAQISGGLNHLVPAVGDYSPYMVQLIVIFVVTILFMVSSQTGLNRGIRHLSRINIVLATLLMLLVLILGPTSYLLGVFTQTLGSYIQNLPGMSFRLDVYNPETNWVEGWTIFYWAWWISWAPFVGSFIARVSKGRTIREFVIGVLAVPALYGALWFSVFGGTGIYFQREGIADINGMMADHGMEIALFGLLEQFPLGTFLSVIALLLIASFFITSADSATVVLGIQSTDGDLNPSNVVKFVWGLIISASAAILLLNQEGLGALQTAAIIAALPFTVIMIVLIFSMVKSFRREIIPARQPKKR

SEQ ID NO: 10276 - protein, 325 aa, Bacillus halodurans
MAQMTMIQAITDAMRNELKRDENVLVFGEDVGQNGGVFRATEGLQKEFGEDRVFDTPLAESGIGGLAIGLGLTGFRPVMEVQFFGFVFEVFDSVAGQMARMRYRSGGKYHSPITVRSPFGGGVKTPELHADNLEGLMAQTPGVKVVIPSTPYDAKGLLISAIRDNDPVIYLEHMKLYRSFRAEVPEEEYTIPLGKADVKREGKDVSIITYGAMVHSSLKAAEELEKEGISAEVIDLRTISPIDIDTILESVKKTSRVIVVQEAQKQAGIGAHVASEIQERAILHLEAPIMRVSAPDTVYPFAAAEDVWLPDFKDIVEKAKAVIEF

SEQ ID NO: 10277 - protein, 240 aa, Bacillus halodurans
MKMMDANEIIQFISNSQKTTPVKVYIKGDLEGIDFGANTKSFINGQTGVLFGEWSEIDAALKANEAKIKDVVVENDRRNSAIPLLDLKNIKARIEPGAIIRDQVEIGDNAVIMMGASINIGSVIGEGTMIDMNVVLGGRATVGKNCHIGAGSVLAGVIEPPSAKPVVVEDDVVIGANCVILEGVTVGKGAVVAAGAVVTEDVPPNTVVAGTPARVIKEIDEKTKGKTEIKQELRRLNEDN

SEQ ID NO: 10278 - protein, 327 aa, Bacillus halodurans
MAVMSYIEAVTLALKEEMERDENVFVLGEDVGARGGVFRATNGLYEQFGEARVLDTPLAESAIAGVGIGAAMYGMRPVAEIQFADFIMPAVNQIVSEAAKIRYRSNNDWQCPITIRAPYGGGIHGALYHSQSVEAMFANTPGLKIVMPSTPYDVKGLLKAAIRSDDPVLFFEHKRAYRLIKGEVPENDYTLPIGKADVKREGDDVTVITYGLAVHFALQAAERLEKDGISTHILDLRTVYPLDKDAIIEAASKTGKILLVTEDNKEGSIMSEVAAIIAEHCLFDLDAPIQRLAGPDVPAMPYAPTMEKHFMINPDKVEKAIRELAEF

SEQ ID NO: 10279 - protein, 629 aa, Bacillus halodurans
MDLEKLHDPSLIKSMTKQELEQLAEEIRQFLIEKLSITGGHLGPNLGVVELTLALHSLFDSPKDKLIWDVGHQAYVHKILTGRAGQFDQLRQYKGLCGFPKRDESEHDVWETGHSSTSLSAAMGMATARDLKGTDENVIAIIGDGALTGGMALEALNHIGHEQKDLIVVLNDNEMSIAPNVGALHNVLGRLRTAGKYQKAKEDLEMLIKKIPAFGGKLAQAAERVKDSLKYLLVSGIFFEEMGFTYLGPVDGHDLDDLMENLKYAKKTKGPVLIHVLTKKGKGYAPAENDEKGTWHGVGHYKIESGELVKKPAPPSYSGVFAETLKKIARNDPRIVALTAAMPGGTKLDQFAKEFPDRMFDVGIAEQHATTMAGGLATQGLKPVFAVYSTFLQRGYDQVVHDICRQNLNVFFAIDRAGLVGADGETHQGVFDIAYLRHLPNMKILMPKDENELQHMVYTAIQYEGGPIAVRYPRGNGYGIKMDEVLKEIPIGSWEVLQEGTDACILTFGTMIPVAEQASKELSQQGYSIRLINARSVKPLDEAMLHEIAKSGRPVLTLEETAVQGSFGSAVLEFFHDHGYHNVVTQRMGIPDRFIEHGSVSELLEEIGLTSSQVANQLSKLLPRKQKRA

SEQ ID NO: 10280 - protein, 572 aa, Bacillus halodurans
MHHKITGIAASSGVAIAKAFIHLEPNVDIEKTSITDVSTEIEKLTAALEKSKEELRAIKDQTEASMGADKAEIFAAHLLVLDDPELVDGIKGKIENEQMNAEYALKEVSDMFVSMFESMDNEYMKERAADIRDVSKRVLGHLIGVETGSLATIAEETVIIAEDLTPSDTAQLNKQFVKGFATDIGGRTSHSAIMSRSLEIPAVVGTKEVTEKIQHGDMVIVDGIEGIVIVNPTEEEVKAYEEKRAAFEKQKQEWAKLVGEPSTTKDGAHVELAANIGTPKDVDGVLANGGEGIGLYRTEFLYMDRDQLPTEEEQFEAYKEVVQRMDGKPVVIRTLDIGGDKELSYLQLPKELNPFLGFRAIRLCLEKQDIFRTQLRALLRASTYGNLKVMFPMIATLEELRQAKAIMQEEKDKLLSEGVDVSDSIEVGIMVEIPSTAVAANLFAKEVDFFSIGTNDLIQYTMAADRMNERVSYLYQPYHPAILRLVDMVIKAAHSEGKWVGMCGEMAGDEVAIPLLLGLGLDEFSMSATSILPARSQLLKLSKEELKPFAQKALMLDTAEEVEQLVKKTYLK

SEQ ID NO: 10281 - protein, 589 aa, Bacillus halodurans
MTKFRYRLVLAVLTVTLLVMAGLGLVIGQIFKNVYLENLTDRLKKETYLAASMVENEAVLFNEVQTLTEEISQKLDARVTIILADGTVVGESAADPAEMENHADRPEFTELEEGIVRYSTTVETELLFYAVPIQNEANETIGYVRLGLPIEAVNSVNRTLWAILIVSFTIAFLVIVSVTYRIANQMIRPIESATVVANKLAEGDYQARTSEESRDEVGQLNRSINVLAYNLEQLTKRHQVQKERLETLIENMGSGLILINTRGDISLINKTCHDIFQEDTDLWLHQLYHDVIKHKEIIKIVQDIFLTEKRQRRQVKLPIHLEYRHFDVHGAPIVRENGKLKGIALVFHDITELKKLEQVRKDFVANVSHELKTPVTSIKGFTETLLDGAMHDEQLRDQFLHIIWKESERLQSLIHDLLELSKIEQNYFQLNWQQTNLFAVVSEVMTLLKGKAEEKGIDISLSAEGSFDLEGDPERLKQIAINLVNNAITYTSNGGRIDLALKDHGDVVEFEVNDTGIGIRESEIPRIFERFYRVDRARSRNSGGTGLGLAIVKHLVEAHQGKILVESEFGKGTTFTIQFHRYRDDEEKS

SEQ ID NO: 10282 - protein, 323 aa, Bacillus halodurans
MDRELALEIVRVTEAAALSSAQWLGRGMKNEADDAATTAMRTMFDSVNCKGTVVIGEGELDEAPMLYIGEEVGSGHGPEVDIAVDPLEGTNIVAKGHPNAMAVIAVADKGTLLHAPDMYMEKIAVGPKAAGLIRLDDPIEKTIDIVAKMTNKRVRDVTVIIQERERHDELIERIRNKGARVKLFGDGDVGAAIATALPQTGIDLFIGTGGAPEGVISAAAIKALGGDMQARLVPMNDEEFERCKRMGLEDPRQVLSLDDLVRGDDAIFAATGVSSGELLEGVRFLGGDLVETDSIVMRAKTRTVRYIKAHHRLDHKPHLIIND

SEQ ID NO: 10283 - protein, 429 aa, Bacillus halodurans [sequence omitted]

SEQ ID NO: 10284 - protein, 321 aa, Bacillus halodurans
MERSLSMELVRVTEAAALASARWMGRGNKEEADRAATEAMRDVFDTIPMKGTVVIGEGEMDEAPMLYIGEKLGNGYGPRVDVAVDPLEGTNIVASGLWNALAVIAVADHGNLLHAPDMYMEKIAVGPEAVGTVDIDAPVIDNLRAVAKAKNKDVEDLVVVTLNRKRHDKLIDEIRQAGARIKLIPDGDVAAAINTAFDDTGVDLLLGSGGAPEGVLAAVGLKCLGGELQGKLLPQTDEELARCKAMGIEDVNKVFSLDELVKGDDCIFAATGVTDGELLKGVHYKGSTATTQSLVMRAKSGTVRFVDGKHSMKKKPDLVIK

SEQ ID NO: 10285 - protein, 278 aa, Bacillus halodurans
MIQSIQDRVKLANGVEMPWFGLGVYKAAEGEEVIGAVRAALKAGYRSIDTASLYQNEVGVGQAIRESGIPRDEIFVTTKVWNTEQGYDETLAAFERSRKRLGLEVIDLYLIHWPVREKFLDTWRALETLYKERKVRAIGVSNFNIHHLETVMNISDINPMVNQVEFHPFLTQKPLLTFCKAHDIQLEAWRPLTKGEIFTHPVVQALAKKYGKTPAQIVLRWNLEHRVVTIPKSVREERIQENANIFDFHLSPEDVEALDGLNEDRRLGQDPDSFSFDF

SEQ ID NO: 10286 - protein, 226 aa, Bacillus halodurans
MDCPFEAVIFDMDGVIADTVGLHYEANQHIAKKLSVTFSEEMNQSLQGLSREKTVRAICDLTGEEVSDEQVKQLSELRNEQYQRLIAELTPADALPGIYSFIRELKEKKVSIALASASTNAPRVLSRLQLIDAFDVIVDVQKVRRGKPDPEIFLTAAQLLGVSSNRCVAIEDGEAGLTGILQTDMFAVGVGTHSAMKKAHWQVASTEELSIKSLINAVEKTRNKDI

SEQ ID NO: 10287 - protein, 517 aa, Bacillus halodurans
MESKELWKNPVFYLSASFILLLVLLGVTMPSRFGAAASALFDLTAINFGWFYLFSVFILIVFLLFLAVSKYGLIRLGGEDERPEFPFFTWIGMLFSAGFGVGLVFWGVAEPMSHFFTPPFQTVDGQTEAAARVAMGYSFFHWGISQWSVFAIVGLVIAFLQFRKNKDGLVSTALAPAVGQRPAVRHTIDCLAIIATVLGIATSLGLGILQVNGGLHAVFGVGNATWIQMVIIGVIFVAYMLSSTTGLNKGIRYLSNLNLGLALLLLLFVLFLGPTRFILESFTLAIGDYISNFIQYSLRMEPYVGGTWVRDWTIFYWAWAIAWSPYVGAFVARVSRGRTIREFIVGVMIVPPLIACLWIATFGGTALWSDLNVQAGIADVVNEDLTLALFQTYEFLPLTTVASIVSLFLIVTFLVTSADSATFILASMSSFGRTNPPRLAKMTWGVLMSAIAAALLYAGGLDALQTASLVAALPFTIILLILLYAIVKLLRQEPLPIRKADLKRFRRLEKAANKKEK

SEQ ID NO: 10288 - protein, 246 aa, Bacillus halodurans
MRLNGKVAMITGAGRGIGAATAKKFAREGAKVIVCDVREEEVAKTVAEIQDGGGEALGSVVDVTQRKDVKNVINQVIERFETLDVVVNNAGITADAQLTNMTDAQWDDVIDVNLKGVFIVTQEVTTIMKEQKRGVILNASSVVGSYGNFGQTNYAASKWGVNGMTKTWAKELGRYNIRVNAVAPGFILTPMTEKMPEKVLKVMEEKAVLNRLGTVEEVANGYAFLASDEASFITGTILAIDGGVVI

SEQ ID NO: 10289 - protein, 490 aa, Bacillus halodurans
MDFHTDTIILLAGLLFIVGVITAKFSTRLGVPALVLFILVGMLVGSDGLGLIHFDFSQAHFAQLIGIFALVIILFEGGLQTKWKTVQSVAVPSLSLATFGVLITSTLVAVAAKYVLGVSWLEAYLFGAIVGSTDAAAVFAVLKEQNIKDRLATTLEAESGTNDPMAVFLTLSLIELITIGSMNPLHLFGSFLWQMGAGLILGFGLGKLGSYSINKINLDSSGLYPVFALAFALLTYSVTAMIGASGLLAVYVAALVIGNQDLTYRHSIFRFNEGFAWMMQMLMFIILGLLVFPNQLFEASIFIKGILLSLILMLVARPVAVFLTTIKMRFDWKEKLFLSWAGLRGAVPIVLATFPMTAGLENSPLFFNVVFFVVLTSALIQGSTIAHFANKLQLTGPQKTTPLHSLELVSIGKANAEIVELEMKQDTPVIGKTLEEINLPKDVLVNAIIRDEQLITPYGKTTIQADDILYVLVSKKKKRQLKELFQAKES

SEQ ID NO: 10290 - protein, 284 aa, Buchnera aphidicola str. APS (Acyrthosiphon pisum)
MINKVQILSVTPPGNLDAYIRIANLWPMLSIEEEKKLTKRLRYNGDLDAAKTLILSHLRFVIHISRNYSGYGLLQSDLIQEGNIGLMKAVRRFNPEIGVRLVSFAVHWIKSEIHEYVLRNWRIVKVATTKSQRKLFFNLRKTKKRLGWFNEEEIQIVARELGVSSRDVREMESRMSAQDVAFNPSPEEHCDSKTNSSIQYLQDKTSNFANGVEQDNWEEHAANKLSSALLRLDERSRHIIHARWLDKNKKNTLQNIANNYGISAERVRQLEKNAMKKLKLAIEA

SEQ ID NO: 10291 - protein, 274 aa, Buchnera aphidicola str. APS (Acyrthosiphon pisum)
MCILKISRIWNKILYDVSFLLKKEPILSDFYQSSILQHQSFTSSLSYILSNKLSTSMISEKKIQGIFDDVYLNDRSILNFIVQDIKAVLKRDPAVNDYLTPLLYLKGFHALEAYRISHYLWNTGKKSLSLYLQSRISSEFSVDIHPAAFIGSGVMLDHATGIVIGEGVTIENDVSILHSVTLGGTGKNFSQNRHPTIRKGVVIGAGAKILGNIEVGSGAKIGAGSIVLKNVPSDVTVVGVPAKIVSQVSSKKYYSQKKKNSLKYINIFQHGDGI

SEQ ID NO: 10292 - protein, 612 aa, Buchnera aphidicola str. APS (Acyrthosiphon pisum)
MDQNPQSQLKLLVTHGKEQGYLTYSEVNDHLPEDIIDSEQIDDIIQMINDMGIPVVEEAPDADDLILNEINTDTDEDAVEAATQVLSSVESELGRTTDPVRMYMREMGTVELLTREGEIDIAKRIEEGINQVQCSVSEYPEAITYLLEQYDRVKTGQIRLSDIITGFVDPNAEEIFPPTAIHIGSELLDEQQNNEEDEENNQEDHEDDHSIDPELANEKFSELRIQYNNTNNTIKNKNRTHKDSLLEIYNLSEVFKQFRLVPKQFDHLVNNMRHMMERVRKQERIIIKLCVEICKMPKKNFIKIFPIKKINYLWFIREQNTNQPWSENLKKVKEDVFISVKKLIKIEEETGLTIEQVKDINKRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEIGREPTPEELSEKMLIPEDKIRKVLKIAKEPISMETPIGDDDDSHLGDFIEDTTLELPLDSATSESLRSATHDVLSGLTAREAKVLRMRFGIDMNTDHTLEEVGKQFDVTRERIRQIEAKALRKLRHPSRSEVLRSFLDD

SEQ ID NO: 10293 - protein, 571 aa, Buchnera aphidicola str. APS (Acyrthosiphon pisum)
MISGILASPGIAFGTALLLKEDEIVINRKIINIKNITKEIERFFEGRRKSIQQLTEIKTKTKEKFGEKKESIFEGHIMLLEDEELEQEVISLIKEKNMSAAAATELIIEGQAKALEKLKDEYLKNRAIDVRDIGNRLLKNILNLNIIDLNNINNEVILIAKDLTPSETAQINLKYILGFITDLGSRTSHTSIMARSLEIPAIVGTGNITKIVKNNDFIILDSINNQILINPSHKLINQTEVIKKKYLTKKNQLINLKNLQAITTDGHAIKIGSNIGNVEDIKSAKKNGAECIGLYRTEFLFMGRNCLPDENEQFQAYKTIAELMKNKSVIIRTMDIGGDKDLPYMNLPKEENPFLGWRAIRISMDRKEILHTQLNAILRASAFGKIYILFPMIISVEEIRILKSEVRKLQIQLKNNNIPFDKNIKIGIMIETPASAIIAEYLIKEVDFFSIGTNDLTQYTLAVDRGNDLISHLYNPMNPSVLKLIQQVINVSHTHGKWTGMCGELAGDERATILLLGMGLDEFSMSSISIPKIKEIIRKTSFSSAKKLAQKALTLPTNREILNLVENFVNH

SEQ ID NO: 10294 - protein, 349 aa, Buchnera aphidicola str. APS (Acyrthosiphon pisum)
MRIEEDIKLGFKDVLIRPKRSILKSRSQVNLARCFSFKYSASIWSGIPIIAANMDTIGTFEMVKSLSKFNILTAVHKYYSFEEWKNFVCLSSKEILNHVIVSIGTSNIDFLKIKKIFLLSSELKYICIDVANGYSEHIVSFLKLVRDYFPDKIICAGNVVTGEMVEELILSGADIVKVGIGPGSVCTTRVKTGVGYPQLSAIIECADAAHGLNGQIISDGGCTVSGDIAKAFGGGADFVMLGGMLSGHKECSGDIIEEKSKKYMIFYGMSSVSAMQRYEGKIAGYRASEGKTVKIPFRGGVDSTIRDILGGLRSSCTYVGAEKLKELTKRTTFIRVTEQENCIFNAFKE

SEQ ID NO: 10295 - protein, 398 aa, Buchnera aphidicola str. APS (Acyrthosiphon pisum)
MKKITILGSTGSIGINALSIIQKNPDLFKVIALVANKNFSIMLRQCELFSPDWVAMRDEKSAHILRKKLKHSKINTQVLTGEKDICALAALEETDHVISAIVGMAGLLPTLSAIHAGKTILLANKESLITSGYFFMKALSSSGAKIIPIDSEHNAIFQVLPLEIQKNLGKTTLEKNSIKHLVLTGSGGPFYKFSSSDLSNVTPDQACSHPNWLMGKKISVDSATMMNKGLEYAEARWLFNALESEIKILIHPESIIHSMVQYYDGSLLAQLSVPDIRTSISYAMSWPDRICTEVDYLNFYKINNLTFFEPDFTQFPCLKLAIDAFSQGQASMTVLNAANEIAVSSFLDSKISFTKIYEINMEILMSSCFSEPKCIQDILEIDRKVRILAKNKVSSLIF

SEQ ID NO: 10296 - protein, 244 aa, Buchnera aphidicola str. APS (Acyrthosiphon pisum)
MNINRQTAFITGANQGIGKAIAKKLIKKGIQVIGTSTTEDGVKRINDYLEGNGFGFVLNLKNIDSITEKIQEIYKKKHSIDILINNAGIKEDNLLVNMKSTEWDDVIKTNLSSVFHLVKSVIRSMIKKRQGRIITIGSVIAYTGNKGQVNYSASKSGLIGFHKSLALEVASKGITVNIVSPGLIKTNFTEKLNSIQYQKYLSNIPMKRFGQKEEVADAVIFLASKKASYITGHTLHVNGGMYMI

SEQ ID NO: 10297 - protein, 434 aa, Buchnera aphidicola str. APS (Acyrthosiphon pisum) [sequence omitted]

SEQ ID NO: 10298 - protein, 415 aa, Buchnera aphidicola str. APS (Acyrthosiphon pisum)
MPKPLNNTENNLNTNRIKDLIKKYSPPFWVYDADIIYKKINLLRKFDVIRFAQKSCSNINILRLMKNKNVKIDAVSLGEIERALLSGFKPSTNEIIFTADILDEETLLKVAKYKIPVNAGSLDMLKQLGKISPGHHVWLRINPRFGYGHSKKTNTGGENSKHGIWHPEQAIPIIKKYKLKLIGLHMHIGSGVNYLHLKKVSQAMIKYAFQLNQKISSISVGGGLPIPYKFNDQPIDIKKYFMLWDIARKKISKFLGEKIELEIEPGRFLVAESGILISKVWATKKMGNKNFVLVDVGFNDLMRPTMYGSYHHISVIYGDDRKMNEKETIDTVVAGPLCESGDIFTQKEGGTVQTRKLPTIKVGDYLIFHDTGAYGAAMSSNYNTRPLIPEILLKNNDSIVIRRRQTIEEILNLEK

SEQ ID NO: 10299 - protein, 608 aa, Buchnera aphidicola str. APS (Acyrthosiphon pisum)
MNFNFNKYPILSFANSVENLRLLSVEQLPQLCFELREYLLDVVSISKGHFASGLGVVEITVALHYVYNTPFDNLLWDTGHQAYPHKILTGRGEKINSIRKKNGLHSFPCREESEYDSLSVGHSSTSISAGLGMSIAAEKEGRNRKTICIIGDGAMTAGMAFEAINHAGEIQSNLLVILNDNQMSISRNVGALNKHLKILRSVQNTQKNRKKIRLLNKKLFFKDKRIQNHSISFNSIFSNLGCKYLGPFDGHNIFSIINTLKKIKNKKGTYLLHLVTKKGKGYLPAELNPIKWHTISSRDSSVSKSLSYSDVFGTWLCEIAAFDKKLIAITPAMCEGSGMVKFSRLFPNQYFDVAIAEQHAVTFAAGLAISGYKPVVSIYSTFFQRAYDQLIHDIALQKLSVLFAVDRAGIVGNDGQTHQGVFDLAYLRCIPGIVIMTPSNENECRQMLYTGYMHNKGPSVVRYPKGYGVGELLMPMNRIPIGKSLIKRRGKKIAILNFGILLHNAYCAAEKLDATLVDMRFVKPLDKSMILKLSSQNKFFITLEEGVISGGAGSAVNEFIMVNKIFLPVLNIGLPDTFIPQGTQEEIRHVYKLDSEGIYKQIFYWLRQ

SEQ ID NO: 10300 - protein, 360 aa, Limulus polyphemus
MSAATTCTRFSDNYEVKEELGKGAFSIVRRCVQNITLLEFAAKIINTKKLSARDFQKLEREARISRKLNHPNIVRLHDSIQEESFHYLIFDLVTGGELFEDIVAREYYSEADASHCIQQILESVHHCHQNNVVHRDLKPENLLLASKTKGAAVKLADFGLAIEVQGDQQAWYGFAGTPGYLSPEVLKKDPYGKPVDIWACGVILYILLVGYPPFWDEDQHRLYAQIKAGAYDYPSPEWDTVTPEAKNLINSMLTVNPAKRITASEALKHPWICQRERVASTLHRQETVECLKKFNARRKLKGAILTTMLATRNFSTRKSEIIKITEQLIEAISSGDFQSYTKYCDPHLTSFEPEALGNLV

SEQ ID NO: 10301 - protein, 360 aa, Limulus polyphemus
MSAGISCTRFSDNYEVKEELGKGAFSIVRRCIQKSTGLEFAAKIINTKKLSARDFQKLEREARICRKLNHPNIVRLHDSIQEEAFHYLIFDLVTGGELFEDIVAREYYSEADASHCIQQILESVHHCHQNSVVHRDLKPENLLLASKAKGAAVKLADFGLAIEVQGDQQAWYGFAGTPGYLSPEVLKKDPYGKPVDIWACGVILYILLVGYPPFWDEGQHRLYAQIKAGAYDYPSPEWDTVTPEAKNLINSMLTVNPAKRITASEALKHPWICQRERVASTLHRQETVECLKKFNARRKLKGAILTTMLATRNFSTRKSEIIKITEQLIEAISSGDFQSYTKYCDPHLTSFEPEALGNLV

SEQ ID NO: 10302 - protein, 519 aa, Trametes versicolor
MGLQRFSFFVTLALVARSLAAIGPVASFVVANAPVSPDGFLRDAIVVNGVVPSPLIRAKKGDRFQLNVVDTLTNHSMLKSTSIHWHGFFQAGTNWADGPAFVNQCPIASGHSFLYDFHVPDQAGTFWYHSHLSTQYCDGLRGPFVVYDPKDPHASRYDVDNESTVITLTDWYHTAARLGPRFPLGADATVINGLGRSASTPTAALAVINVQHGKRYRFRLVSISCDPNYTFSIDGHNLTVIEVDGINSQPLLVDSIQIFAAQRYSFVLNANQTVGNYWVRANPNFGTVGFAGGINSAILRYQGAPVAEPTTTQTPSVIPLIETNLHPLARMPVPGTRTPGGVDKALKLAFNFNGTNFFINNASFTPPTVPVLLQILSGAQTAQELLPAGSVYPLPAHSTIEITLPATALAPGAPHPFHLHGHAFAVVRSAGSTTYNYNDPIFRDVVSTGTPAAGDNVTIRFQTDNLGPWFLHCHIDFHLEAGFAIVFAEDVADVKAANPVPKAWSDLCPIYDGLSEADQ

SEQ ID NO: 10303 - protein, 256 aa, Brassica oleracea
MGRGRVQLKRIENKINRQVTFSKRRAGLFKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRSRKNQLMYDSVNELQRKEKAIQEQNSMLSKQIKEREKVLMAQQEQWDQQNHGQNMPSPPPPQQHQIQHPYMLSHQPSPFLNMGGLYQEEDPMAMRRNDLDLSLEPVYNCNLGCFAA

SEQ ID NO: 10304 - protein, 256 aa, Brassica oleracea
MGRGRVQLKRIENKINRQVTFSKRRAGLMKKAHEISVLCDAEVALVVFSHKGKLFEYSTDSCMEKILERYERYSYAERQLIAPESDSNTNWSMEYNRLKAKIELLERNQRHYLGEDLQAMSPKELQNLEQQLDTALKHIRSRKNQLMYDSINELQRKEKAIQEQNSMLSKQIKERENVLRAQQEQWDEQNHGHNMPPPPPPQQHQIQHPYMLSHQPSPFLNMGGLYQEEDQMAMRRNDLDLSLEPVYNCNLGCFAA

SEQ ID NO: 10305 - protein, 232 aa, Brassica oleracea
MARGKIQIKRIENQTNRQVTYSKRRNGLFKKAHELTVLCDARVSIIMFSSSNKLHEFISPNTTTKEIIDLYQTVSDVDVWSAHYERMQETKRKLLETNRKLRTQIKQRLGECLDELDIQELRSLEEEMENTFKLVRERKFKSLGNQIETTKKKNKSQQDIQKNLIHELELRAEDPHYGLVDNGGDYDSVLGYQIEGSRAYALRYHQNHHHHYPNHALHAPSASDIITFHLLE

SEQ ID NO: 10306 - protein, 678 aa, Chlamydophila pneumoniae CWL029
MGVVQNQVISSIRDVLKLVWELRFAEHKMLLLSRQSGSGGTFQLSCAGHELAGVLAGKSLIPGKDWSFPYYRDQGFPIGLGCDLSEIFASFLARTTPNHSSARMMPYHYSHKKLRICCQSSVVGTQFLQAAGRAWAVKHSSADEVVYVSGGDGATSQGEFHEMLNFVALHQLPLITVIQNNHWAISVPFEDQCGADLASLGRCHQGLAVYEVDGGNYTSLTETFSHAVDQARQHSVPALILIDVVRLSSHSNSDNQEKYRSALDLKLSMDKDPLILLEKEAINVFGLSPFEIEEIKAEAQEEVRKSCEIAEALPFPSKGSTSHEVFSPYTETLIDYENSESAQNLRNSEPKVMRDAISEALVEEMTRDSGVIVFGEDVAGDKGGVFGVTRNLTEKFGPQRCFNSPLAEATIIGTAIGMALDGIHKPVVEIQFADYIWPGINQLFSEASSIYYRSAGEWEVPLVIRAPSGGYIQGGPYHSQSIEGFLAHCPGIKVAYPSNAADAKALLKAAIRDPNPVVFLEHKALYQRRIFSACPVFSHDYVLPFGKAAIVHPGKDLTIVSWGMPLVLSLEVAQELASRGISIEVIDLRTMVPCDFATVLKSLEKTGRLLVIHEASEFCGFGSELVATMSEQGYAYLDAPIRRLGGLHAPVPYSKVLENEVLPHKESILQAAKSLAEF

SEQ ID NO: 10307 - protein, 246 aa, Chlamydophila pneumoniae CWL029
MEAGANVLVIDTAHAHSKGVFQTVLEIKSQFPQISLVVGNLVTAEAAVSLAEIGVDAVKVGIGPGSICTTRIVSGVGYPQITAITNVAKALKNSAVTVIADGRIRYSGDVVKALAAGADCVMLGSLLAGTDEAPGDIVSIDEKLFKRYRGMGSLGAMKQGSADRYFQTQGQKKLVPGGVEGLVAYKGSVHDVLYQILGGIRSGMGYVGAETLKDLKTKASFVRITESGRAESHIHNIYKVQPTLNY

SEQ ID NO: 10308 - protein, 248 aa, Chlamydophila pneumoniae CWL029
MDITLVGKKVIVTGGSRGIGLGIVKLFLENGADVEIWGLNEERGQAVIESLTGLGGEVSFARVDVSHNGGVKDCVQKFLDKHNKIDILVNNAGITRDNLLMRMSEDDWQSVISTNLTSLYYTCSSVIRHMIKARSGSIINVASIVAKIGSAGQTNYAAAKAGIIAFTKSLAKEVAARNIRVNCLAPGFIETDMTSVLNDNLKAEWLKSIPLGRAGTPEDVARVALFLASQLSSYMTAQTLVVDGGLTY

SEQ ID NO: 10309 - protein, 379 aa, Chlamydophila pneumoniae CWL029
MKHLAVLGSTGSIGRQTLEIVRRYPSEFKIISMASYGNNLRLFFQQLEEFAPLAAAVYNEEVYNEACQRFPHMQFFLGQEGLTQLCIMDTVTTVVAASSGIEALPAILESMKKGKALALANKEILVCAGELVSKTAKENGIKVLPIDSEHNALYQCLEGRTIEGIKKLILTASGGPLLNKSLEELSCVTKQDVLNHPIWNMGSKVTVDSSTLVNKGLEIIEAYWLFGLENVEILAVIHPQSLIHGMVEFLDGSVISIMNPPDMLFPIQYALTAPERFASPRDGMDFSKKQTLEFFPVDEERFPSIRLAQQVLEKQGSSGSFFNAANEVLVRRFLCEEISWCDILRKLTTLMECHKVYACHSLEDILEVDGEARALAQEI

SEQ ID NO: 10310 - protein, 515 aa, Chlamydophila pneumoniae CWL029
MTKTEEKPFGKLRSFLWPIHTHELKKVLPMFLMFFCITFNYTVLRDTKDTLIVGAPGSGAEAIPFIKFWLVVPCAIIFMLIYAKLSNILSKQALFYAVGTPFLIFFALFPTVIYPLRDVLHPTEFADRLQAILPPGLLGLVAILRNWTFAAFYVLAELWGSVMLSLMFWGFANEITKIHEAKRFYALFGIGANISLLASGRAIVWASKLRASVSEGVDPWGISLRLLMAMTIVSGLVLMASYWWINKNVLTDPRFYNPEEMQKGKKGAKPKMNMKDSFLYLARSPYILLLALLVIAYGICINLIEVTWKSQLKLQYPNMNDYSEFMGNFSFWTGVVSVLIMLFVGGNVIRKFGWLTGALVTPVMVLLTGIVFFALVIFRNQASGLVAMFGTTPLMLAVVVGAIQNILSKSTKYALFDSTKEMAYIPLDQEQKVKGKAAIDVVAARFGKSGGALIQQGLLVICGSIGAMTPYLAVILLFIIAIWLVSATKLNKLFLAQSALKEQEVAQEDSAPASS

SEQ ID NO: 10311 - protein, 257 aa, Chlamydophila pneumoniae CWL029
MKTQQTQNIIEVWNFYWETQEIEYRDSLIEFYLPLVKSVVHRLISGMPSHVKTEDLYASGVEGLVRAVERYNPERSRRFEGYAVFLIKAAIIDDLRKQDWVPRSVHQKANKLSGAMDSLRQSLGKEPTDLELCEYLNISQQELSGWFVSARPALIVSLNEEWPSQSDEGAGMALEERIPDERAETGYDVVDKQEFSLCLANAIQELEEKERKVMALYYYEELVLKEIGKVLGVSESRVSQIHSKALLKLRAALSAFR

SEQ ID NO: 10312 - protein, 540 aa, Chlamydophila pneumoniae CWL029
MQSSEVKPFSRLRAYLCPIYKSEFSKFVPLFLLAFFVGFNYCLLKNMKDTLVIVGSDAGAEVIPFLKVWGIVPGAVIVTMVYGWLGSRYPRDTVFYCFMAAFLGFFFLFAVIIYPVGDSLHLNSLADKLQELLPQGLRGFIVMVRYWSYSIYYVMSELWSSVVLSMLFWGLANQITTITEAGRFYALINTGLNLSSICAGEISYWMGKQTFVAYSFACDSWHSVMLNLTMLITCSGLIMIWLYRRIHHLTIDTSIPPSRRVLAEEGAATANLKEKKKPKAKARNLFLHLIQSRYLLGLAIIVLSYNLVIHLFEVVWKDQVSQIYSSHVEFNGYMSRITTLIGVVSVLAAVLLTGQCIRKWGWTVGALVTPLVMLVSGLLFFGTIFAAKRDISIFGGVLGMTPLALAAWTGGMQNVLSRGTKFTFFDQTKEMAFIPLSPEDKNHGKAAIDGVVSRIGKSGGSLIYQGLLVIFSSVAASLNVIALVLLIIMVVWIAVVAYIGKEYYSRAADAVATLKQPKEPSSSIVREAQESVEQEEMAVL

SEQ ID NO: 10313 - protein, 572 aa, Chlamydophila pneumoniae CWL029
MFMNTQNSQATEVSSEEESQKKLEELVALAKEQGFITYEEINEILPMSFDTPEQIDQVLIFLTGMDIQVLNQIDVERQKEKKKEAKELEGLARRTEGTPDDPVRMYLKEMGTVPLLTREEEVEISKRIEKAQVQIERIILRFRYSAKEAISIAHYLISGKERFDKIISEKEVEDKTHFLKLLPKLITLLKEEDTYLENLLLSLKQPDLSKQEAAKLNDSLEKCRIRTQAYLRCFHCRHNVTEDFGEVVFKAYDSFLHLEQQINDLKVRAERNKFAAAKLAAAKRKLYKREVAAGRTLEEFKKDVRMLQRWMDKSQEAKKEMVESNLRLVISIAKKYTNRGLSFLDLIQEGNMGLMKAVEKFEYRRGYKFSTYATWWIRQAVTRAIADQARTIRIPVHMIETINKVLRGAKKLMMETGKEPTPEELAEELGLTPDRVREIYKIAQHPISLQAEVGEGSESSFGDFLEDTAVESPAEATGYSMLKDKMKEVLKTLTDRERFVLIHRFGLLDGKPKTLEEVGSAFNVTRERIRQIEAKALRKMRHPIRSKQLRAFLDLLEEEKTGTSKVKSLKSK

SEQ ID NO: 10314 - protein, 428 aa, Chlamydophila pneumoniae CWL029
MFEAVIADIQAREILDSRGYPTLHVKVTTSTGSVGEARVPSGASTGKKEALEFRDTDSPRYQGKGVLQAVKNVKEILFPLVKGCSVYEQSLIDSLMMDSDGSPNKETLGANAILGVSLATAHAAAATLRRPLYRYLGGCFACSLPCPMMNLINGGMHADNGLEFQEFMIRPIGASSIKEAVNMGADVFHTLKKLLHERGLSTGVGDEGGFAPNLASNEEALELLLLAIEKAGFTPGKDISLALDCAASSFYNVKTGTYDGRHYEEQIAILSNLCDRYPIDSIEDGLAEEDYDGWALLTEVLGEKVQIVGDDLFVTNPELILEGISNGLANSVLIKPNQIGTLTETVYAIKLAQMAGYTTIISHRSGETTDTTIADLAVAFNAGQIKTGSLSRSERVAKYNRLMEIEEELGSEAIFTDSNVFSYEDSEE

SEQ ID NO: 10315 - protein, 303 aa, Chlamydophila pneumoniae CWL029
MSLFLVFLTAFIWSSSFALSKLVMNASAPIFATGARMVIAGAILALAAWFRGGFVGISKKIFLYIVLLALTGFYLTNIFEFIGLQSLSSSKTCFIYGLSPLMSALFSYIQLKEKVTLKKVLGLSLGLVSYICYLTFGGGGDDSQPWTWQIGLPELLILGAASLASFGWTLLRQIEKQSTLSVTAINAYAMLIAGMLSIMHSAVVEPWRPLPVQDISQFLYATLALVVISNLICYNLYAKLLRKYSSTFLSFCNLVMPLYSGFYGWILLGEKGVSLGLVLAVAFMVAGCRLIYHEEFRQGYIVS

SEQ ID NO: 10316 - protein, 155 aa, Chlamydophila pneumoniae CWL029
MEKDIFFMQQAFKEARKAYDQDEVPVGCVIVKDDKIIARAHNSVEKLKDATAHAEILCIGSAAQDLDNWRLLDTVLYCTLEPCLMCAGAIQLARIPRIVWAAPDVRLGAGGSWVNIFTEEHPFHTVSCTGGVCSEEAEHLMKKFFVEKRREKSEK

SEQ ID NO: 10317 - protein, 644 aa, Chlamydophila pneumoniae CWL029
MTSSSCPLLDLILSPADLKKLSISQLPGLAEEIRYRIISVLSQTGGHLSSNLGIVELTIALHYVFSSPKDKFIFDVGHQTYPHKLLTGRNNEGFDHIRNDNGLSGFTNPTESDHDLFFSGHAGTALSLALGMAQTTPLESRTHVIPILGDAAFSCGLTLEALNNISTDLSKFVVILNDNNMSISKNVGAMSRIFSRWLHHPATNKLTKQVEKWLAKIPRYGDSLAKHSRRLSQCVKNLFCPTPLFEQFGLAYVGPIDGHNVKKLIPILQSVRNLPFPILVHVCTTKGKGLDQAQNNPAKYHGVRANFNKRESAKHLPAIKPKPSFPDIFGQTLCELGEVSSRLHVVTPAMSIGSRLEGFKQKFPERFFDVGIAEGHAVTFSAGIAKAGNPVICSIYSTFLHRALDNVFHDVCMQDLPVIFAIDRAGLAYGDGRSHHGIYDMSFLRAMPQMIICQPRSQVVFQQLLYSSLHWSSPSAIRYPNIPAPHGDPLTGDPNFLRSPGNAETLSQGEDVLIIALGTLCFTALSIKHQLLAYGISATVVDPIFIKPFDNDLFSLLLMSHSKVITIEEHSIRGGLASEFNNFVATFNFKVDILNFAIPDTFLSHGSKEALTKSIGLDESSMTNRILTHFNFRSKKQTVGDVRV

SEQ ID NO: 10318 - protein, 87 aa, Chlamydophila pneumoniae CWL029
MEEALTFDDVLLIPQYSEILPSEVSLKTAISKTLSLNIPILSAAMDSVTETAMALALAQEGGLGILHKNMSEVEQSSSVRKIKEAYP

SEQ ID NO: 10319 - protein, 258 aa, Brucella melitensis biovar Abortus
MVEAKSYPASWRFAGKRVIVTGAAQGIGRRVAEHFLAEGATVIGLDRQAGEADAPFRLIRLDITDAAEVRAVSDGLKAEGKPLDILVNVAGVLKLGNSDRLSAEDWKTCMDVNASGPFHLLSQWVPVFRDQRHGAIVNVASNAAHVPRLNMAAYCASKAALASFSHCVALELAPYGVRCNVVSPGSTRTAMLGAMLNDPSGEAQLVRGLPEQFKLGIPLGKIAMPDDIANVILFLASDQAGHVTMQDIVVDGGATLGA

SEQ ID NO: 10320 - protein, 236 aa, Oryza sativa (japonica cultivar-group)
MANCPSQNATPAARRAPIAMSKRSRSMWDMQEFVGSVDTARVLMLLAQQSQHGLLGGGGFAAGAQPVVVRGGAHDRVFECKTCNRQFPTFQALGGHRASHKRPRQQQQHALGGGAGADDAGLCLGRQPTPPRPQPAKPRVHECPVCGLEFPIGQALGGHMRRHRAEAEAAATTTTTTTKNGDVGKAAAVKACDGGGVCLDLNLTPSENRAKCRNVVGLGAGGQGVHKALAMLDCFL

SEQ ID NO: 10321 - protein, 159 aa, Oryza sativa (japonica cultivar-group)
MESLRVHASALLSLSSPAASASQPTSSSSTTEGVFECKTCSKRFPSFQALGGHRTSHTRLQAKLLSDPAAAAAAAAERDRARVHECAVCGVEFSMGQALGGHMRRHRGETGTTTVVLADADDSGGATVPQPPEPMPDLNYPPLEDAGDGSEPELLNLLV

SEQ ID NO: 10322 - protein, 939 aa, Oryza sativa (japonica cultivar-group); identical to SEQ ID NO: 3359

SEQ ID NO: 10323 - protein, 213 aa, Oryza sativa (japonica cultivar-group)
MSLSLGFSAGAGVGADRLAAAPALQAAGALPPRVDVSLSLARAANGQPSSYLPLNENDSLDMVLFDVLREASAVAALSSSSSSSPELGARTTAPVVAGHPAGRKGGGGGGGGRGAAARGGAAGGRHYRGVRRRPWGKYAAEIRDPTRHGARLWLGTFGTAEEAAAAYDRAAFRMRGAKALLNFPPAVAGDGARRGAAAAAKQVGMSDESETKN

SEQ ID NO: 10324 - protein, 281 aa, Oryza sativa (japonica cultivar-group); identical to SEQ ID NO: 3367

SEQ ID NO: 10325 - protein, 277 aa, Oryza sativa (japonica cultivar-group); identical to SEQ ID NO: 3602

SEQ ID NO: 10326 - protein, 1121 aa, Oryza sativa (japonica cultivar-group); identical to SEQ ID NO: 1172

SEQ ID NO: 10327 - protein, 299 aa, Oryza sativa (japonica cultivar-group); identical to SEQ ID NO: 3481

SEQ ID NO: 10328 - protein, 567 aa, Oryza sativa (japonica cultivar-group); identical to SEQ ID NO: 3986

SEQ ID NO: 10329 - protein, 354 aa, Caenorhabditis elegans
MGCTMSQEERAALERSRMIEKNLKEDGMQAAKDIKLLLLGAGESGKSTIVKQMKIIHESGFTAEDYKQYKPVVYSNTVQSLVAILRAMSNLGVSFGSADREVDAKLVMDVVARMEDTEPFSEELLSSMKRLWGDAGVQDCFSRSNEYQLNDSAKYFLDDLERLGEAIYQPTEQHILRTRVKTTGIVEVHFTFKNLNFKLFDVGGQRSERKKWIHCFEDVTAIIFCVAMSEYDQLLHEDETTNRMHESLKLFDSICNNKWFTDTSIILFLNKKDLFEEKIKKSPLTICFPEYSGRQDYHEASAYIQAQFEAKNKSANKEIYCHMTCATDTTNIQFVFDAVTDVIIANNLRGCGLY

SEQ ID NO: 10330 - protein, 354 aa, Caenorhabditis elegans
MGLCQSAEDKELTLKSKAIDKEMMQNHMSQQKVVKLLLLGAGECGKSTVLKQMRILHDHGFTAEEAEQQKSVVFNNTLQAMTAILKGMEALRMTFDKPIRENDAKFVMESHKMLQEAKVFPEELANAIQALWNDKAVQQVIAKGNEFQMPESAPHFLSSLDRIKLPDYNPTEQDILLSRIKTTGIVEVKFQMKSVDFRVLDVGGQRSERKKWIHCFEDVNAIIFIAAISEYDQVLFEDETTNRMIESMRLFESICNSRWFINTSMILFLNKKDLFAEKIKRTSIKSAFPDYKGAQTYDESCRYIEEKFDGLNANPEKTIYMHQTCATDTDQVQMILDSVIDMIIQANLQGCGLY

SEQ ID NO: 10331 - protein, 256 aa, Lycopersicon esculentum
MASPREENVYMAKFAEQAERSYEEMVEFMEKVVFSLNGEELTVEERNLLSVPYGGLIGARRASWRIISSIEQKEESRGNEDHVASIKKYRSQIENELTSICNGILKLLDSKLIGSAATGDSKVFYLKMKGDYYRYLAEFKTGTERKEAAENTLSAYKSAQDIANGELAPTHPIRLGLALNFSVFYYEILNSPDRACNLAKQAFDEAIAELDTLGEESYKDSTLIMQLLRDNLTLWTSDMQDDGTDEIKEPSKADNE

SEQ ID NO: 10332 - protein, 115 aa, Tilia platyphyllos
MALPKAKEIVSGNPVVVFSKSYCPFCVSVKQLLEQIGASFKAIELDNESDGSEIQAALAEWTGQRTVPNVFIGGKHIGGCDSTTAMHKNGKLIPLLTEAGAVATATATVTATASA

SEQ ID NO: 10333 - protein, 120 aa, Yarrowia lipolytica
WSYGAMFASMIFKKEPFFHGTSNTDQLVKIARVLGTEKLWDYLEKYNIELGAEYDDIGTYPARPWSKFVNVDNEAYISQEAIHLLDNLLRYDHQERLTAKEAMAHDYFKPVRVREEGEQE

SEQ ID NO: 10334 - protein, 510 aa, Treponema pallidum
MQKEKCDFSVSLIPLGIVISCALLFISFPDISHRVIGTLLNILVNKLGFFYILTGLFFLGTTLTIAFSRYGAVYLGTTRTARYSNFTWGSMIFTSTMAADILYWSLIEWAHYFTQAPFIAEHSPPTERQEWAAAYPLFHWGIIPWSFYVLLAVAFGYMLHVKKRHTHKISEACRPLLGAYVDGIIGEAIDICSVVGLLLGVATTFSLATPLLSLMVSLLFGISNTQLLALALLCVIALVYTTAVLLGTQGISKLSRAAVYCFSTVLVFFLCAGPTVYLIETGITAIGKMLQNFFLMATWMDPSRISLQETDGTLGFPQRWTIFYWAYWITWSVATPFFIGAISEGRTIRNTIVGGLCWGIAGTYGSFIVLGNYGLYLQTHHLLPAAYFVRAGNTPAEVIIAIIQTLPCAYIVMALLAATMIAFYASTFDALTLIIASYSQKSVAPGEEPRQIMKSFWAVACILLPASLIFSQSTLMHLKSLAIIAAFPLALIMLCVVASFFKELRAEVTS

SEQ ID NO: 10335 - protein, 105 aa, Treponema pallidum
MERGNPIAVERRRFCVMSAKIYVGNLNYATTEAGLASLFSQFGEVLSVAVIKDKLTQRSKGFGFVEMESAESAELVINELNEKEFEGRRLRVNYAEEKPRFPFKN

SEQ ID NO: 10336 - protein, 611 aa, Treponema pallidum
MMELSRTPAVMRLLEYAREKKAITHDEVENILAHYGVETEELLHDVLDMLEQENIKVFSSEEEELEDEVFAGLKGPAADDGDGSFPLSTERVRDKLCDSSRGARQNLLSNARNIALDDPVKLYLRDIGQEKLLTAEQEVMLSKRMEEGEGIIKDIITQSGLLLPEFYHIGRSLSKKALAVLDPAESGRTRKEISEEMADRRRLKQAYGEVLRSLYPEMRHYMAMKKRLDERGEPVTVLSSDEEVCKQRDKLLSCLQKVDLQLEEIDRFSRKFLDTARKIREYKRRKDRHEKQLMIADLCDMRKIGRGLAVPRQRAKLEETLGMSADCIQEIYTQIQKVTRRLRRIEYDFENTIDGILSMARAIHRGHVMLKKAKDKLINANLRLVVSIAKKYTNRGLLFFDLVQEGNIGLIKAVEKFEYRKGYKFSTYATWWIRQAITRSISDQARTIRVPVHMIEQINKVTRESRQLLQKFGREPSDEEIAQQLCWTVEKVKQVKSVAREPISLETPIGEEEDSSLGDFVPDADVENPSRVTERVLLKEEVRSILSALPAREHEVLRMRFGLDGDYSQTLEEVGLYFDVTRERIRQIEAKALKRLRHPRHSRRLKDFLDS

SEQ ID NO: 10337 - protein, 383 aa, Treponema pallidum
MFWDRCSMSVRRVVVLGITGSIGAAALKLLRRFPDRFLLVGASGHRQTEYARALAREFSLSDITMTGSCSEQEGRARIKRLLSSCEAEVVVNGIAGAAGLFASLEVLKTRCTLALANKESVVLAASLLHAAARESGATIVPVDSEHAAIFQLIAAHGAHAVAQVVLTASGGPFRTFSKECLAHVTVEDALQHPTWRMGKKISVDSATLANKALEVIEAVQFFRIPVDRVTVVVHPQSIVHALVQCHSGETYAQLSVPDMASPLLYALLYPDAPPAYQTPLDFTSGLSLHFEPPRVDDFPLLRMGFDVARAQRAYPIAFNAANEEAVRAFLQRNIGFLDIAHVTAQALQEDWRAIPQTFEEVMACDTRARMCARTCIAQRWRER

SEQ ID NO: 10338 - protein, 901 aa, Treponema pallidum
MNIAKSIHFLSNKEALDKRLDRGLLGIRGRQADELSSLGLPVLPSVVIDATVSRSLYGEKLRSALSPYLRKFTLLNRKEYADAKNPMLLKVVLSPNLAISNYPVLHNFGLTRDTFAGFAERVGEHFATHEVFFLLKGVFGVLLGIAESEENTKGASEFVETLKEIEVFLQGGKSSPSGREAMNRYRALLPDGFFDDAYVQLEEAVRLVSKLLSFEEDGEDGVAILIQPMVYGNYGGGSYSGRFFSRNIITGEKKLQGQYFEERFDECDAEGSDVNAIKPAYLKQLQDIAWKLEDHSREIREVRFTIEAGSLWLIEQKPVEAKSTISLVRLLLDLYEREVVDAEYVVKSVKPGQLNEILHPVIDMTSVTGLKSSQGGIIGVPGAAVGRVYFTADSLIEAWRVAKMGGQDTRCILCMPATYAGDVKAIEVATGVLSNEGGYSAHASVVARQYGKISLVRPDMKIYSDKAVVDGMTINEGDFVTLNVPYYGESTLYMGAAQLIEPDPETSGLVSFIELAKGFVRSFHVRANADSPHDAELALAFGAQGIGLCRTEHMFFKEDRINVFRRMIFSENAEERTGSLKQLQKMQGEDFYGIFKVMQGHEVTIRLLDAPLHEFLPHGESEVSKFLEYLEKVCGKGLSREELQERISMLSEVNPMLGHRGCRIAISYPEIYAMQVRAVFEAVYRLQKEKISVYPEIMIPIVMNCRELKQIVYGKKIEGHAYQGIGSIEEEVRLALKAKEVDYKVGAMIELPAAALSADEIARYAQFFSFGTNDLTQTTLGLSRDDFNTFMPDYTMYDLVDGNPFAILDARVRELIEVAMQRGRLARPDIQLGLCGEHGSRSENIRFCMEVGLDYVSCSSYSVPIALLAIAQAEIENAEKEGRKPAWRGRSSAKSGGRRAR

SEQ ID NO: 10339 - protein, 432 aa, Treponema pallidum [sequence omitted]

SEQ ID NO: 10340 - protein, 630 aa, Treponema pallidum
MDLSLLRSLTGPHDLKSLSPEQVRALAQEVRQEILRVVSANGGHLASNLGVVELTIALHRVFSCPHDVVVWDVGHQCYAHKLLTGRAGRFHTLRQKDGISGFPRRDESPYDAFGTGHSSTALSAASGILSALRYRGKSGKVVAVVGDGALTAGLAFEALLNVGRSCSDLIVILNDNKMSISPNTGSFSRYLSTLTVKGPYQKLKTRLRRALQTVPLVGRPACRALSRLKRSARTLLYQSNIFADFGFEYVGPLNGHHIEDLERVLNDAKKLTRPTLLHVQTVKGKGYPFAEQNPTDFHGVGPFNLAEGIVEKKDALTFTEAFSHTLLNAARTDDRVVAITAAMTGGTGLGLFSHIYPERFFDVGIAEQHAVTFAAGLACAGVKPVVAVYSTFLQRAVDQVIHDVAVQNLPVIFALDRAGAVPHDGETHQGLFDLSILRAVPNINILCPASAHELSLLFGWALAQDTPVAIRYPKALCPPEEDGFSTPVHTGRGVLITRENECNVLLVCTGGVFPEVTAAANTLARKGIFADIYNVRFVKPVDEDYFLDLVGRYRSVLFVEDGVKIGGIAEALQALLNTRHPAPCSDVLAFQDMFYPHGSRAQVLAAAGLSAPHIAARAEWLLAHSVGQIR

SEQ ID NO: 10341 - protein, 311 aa, Treponema pallidum
MLSIWYVPFEQKEYSVRQMQFRHDENTLTAYLNDLKRIPLMNEKEEYACACAAYAGDAQAKNALVRANVRFVISVARHYRTCGLPLADLISEGNIGLLTAAERFNPARGCRFISYAACWIRQSILKALNEKARIIRLPVSRIRAAKSTYEYIPPVTSVNVGISKTQGGNRYGKRRATMCRAVPTVEEVHIWHTPLSLDAPLGASGSRGESGDVDGLRIGDCVPDDLYAQPEEHMLACALQADIAKILRLLPARDAQVIRYRFGLGGYERRSLQEIGEIFQITKERVRQIEKKALLRIRSCARQHRLDSYIA

SEQ ID NO: 10342 - protein, 417 aa, Vibrio cholerae
MDYFNYQEDGQLWAEQVPLADLANQYGTPLYVYSRATLERHWHAFDKSVGDYPHLICYAVKANSNLGVLNTLARLGSGFDIVSVGELERVLAAGGDPSKVVFSGVGKTEAEMKRALQLKIKCFNVESEPELQRLNKVAGELGVKAPISLRINPDVDAKTHPYISTGLRDNKFGITFDRAAQVYRLAHSLPNLDVHGIDCHIGSQLTALAPFIDATDRLLALIDSLKAEGIHIRHLDVGGGLGVVYRDELPPQPSEYAKALLDRLERHRDLELIFEPGRAIAANAGVLVTKVEFLKHTEHKNFAIIDAAMNDLIRPALYQAWQDIIPLRPRQGEAQTYDLVGPVCETSDFLGKDRDLVLQEGDLLAVRSSGAYGFTMSSNYNTRPRVAEVMVDGNKTYLVRQREELSSLWALESVLPE

SEQ ID NO: 10343 - protein, 286 aa, Vibrio cholerae
MTNQAYPMALVSQDSLDSYIRSVNGYPMLSADEERELAERLHYKGDIDAAKGLILSHLRFVVHVARGYSGYGLPMADLVQEGNIGLMKAVKRFNPEMGVRLVSFAVHWIKAEIHEYVLRNWRIVKIATTKAQRKLFFNLRKSKKRLGWFNNGEVETVARELGVEPAEVREMESRLAAQDAAFEMSAEDDENGMAYTAPVLYLEDKHSDLADNLEAENWEAHTTQRLSMALASLDERSQHIVRARWLDDDNKTTLQDLAEMYGVSAERIRQLEKNAMRKLKEAVGEF

SEQ ID NO: 10344 - protein, 399 aa, Vibrio cholerae
MQSLAGKKILLGISGGIAAYKCAELTRRLVERGATVQVVMTHAAKEFITPLTMQAVSGRPVSDSLLDPAAEASMGHIELAKWADLVLLAPATADLIARMAAGMGNDLLTTLILATSAPVAIAPAMNQQMYRNIATQENLQTLIRRGYLTWGPAAGEQACGDVGPGRMLEPMELVAHCENFFAPKILVGKRVLITAGPTREALDPVRYITNHSSGKMGFALAKAAAQLGADVTLVSGPVHLPTPVGVNRIDVQSGLEMHSAVMKEATSHQIFIACAAVADYRPQTVAEQKIKKSRDNDTLTIEMVKNPDIVASVAALTENRPFTVGFAAETQDVETYARSKLVRKNLDMICANDVSIAGQGFNSNDNALTLFWKEGQHSLPLTSKDALASAVMHLIHEQM

SEQ ID NO: 10345 - protein, 410 aa, Vibrio cholerae
MPWKTYSRNLMYAVITLMLNVLSEFYLMHLRVIRHKNENKMKVLHVYRTCYPETKGGVEQVIRFIASGTKPLGIETKILTLSDNQTSSYYCEGTEIISVKKSIEISSNGFSWKLIRQFKKLSKWADIIHYHYPWPTGDFLSLFGSSNPSIVTYHSDIIRQKCLKKLYQPLESHFLNQANILVATSPQYAHTSENLLRHKNKVKIIPLAVDENTYPIPSNDNINKWREKVGEGFFLFVGVLRYYKGLDFLLEAAKINQLPVIIAGDGPERVKLESYIAKHNLENVKLVGFISEEDKVILHLLSKAFVFPSHLRSEAFGISLIEAQMYCKAIISSDIGTGSSYVNINGETGLVVPPADSQSFSDAMLKIEHDTKLCEKLGINARKRFEQEFTAHRYAQSYTKLYSELFGNVC

SEQ ID NO: 10346 - protein, 444 aa, Vibrio cholerae
MSVYYTLCFLSAAAMLIAFINSKISRMQTTIAITAGSMMLSLLILIAGQNDWFHLNQIATETVTSINFENFLLKGILGFLLFAGGLGIKLPNLKDQKWEITVLALGATLFSTFFIGFTLYGFCQLIGIQFDLVYCLLFGALISPTDPIAVLAIVKKLKAPKRISTQIEGESLFNDGFGLVIFVTIFTIAFGHETPTVGSVTLLFIQEAIGGIVYGFLLGLLFHYLISATDDHSMELLLTIGIPTAGYAFADVIHVSGPLAMVVSGIMIGNWTRFIGFSKESEEHLDHFWELVDEFLNGVLFLLIGMSMLLFEFHQEDWILMAFAVPLVLCGRYLSVFVSYIGFKRYRSYNPWSIRILTWGGLRGGLALAMALSIPSGIMVIPEKLIDVKELILVMTYAVVVFSILVQGSTITPMIEKAKKAEKALQAERNTDNQSPMPQQEQQH

SEQ ID NO: 10347 - protein, 1226 aa, Vibrio cholerae
MGKEVRQQLEQQLKQRILLIDGGMGTMIQSYKLQEEDYRGARFVDWHCDLKGNNDLLVLTQPQIIKEIHSAYLEAGADILETNTFNSTTIAMADYDMQSLSAEINFAAAKLAREVADEWTAKDPSRPRYVAGVLGPTNRTCSISPDVNDPGFRNVTFDGLVEAYSESTRALIKGGSDLILIETIFDTLNAKACAFAVDSVFEELGISLPVMISGTITDASGRTLSGQTTEAFYNALRHVRPISFGLNCALGPDELRQYVEELSRISECYVSAHPNAGLPNAFGEYDLSAEEMAEHIAEWAQAGFLNLVGGCCGTTPEHIAAIAKAVEGVKPRALPDLKVECRLSGLEPLNIGPETLFVNVGERTNVTGSARFKRLIKEEQYDEALDVAREQVENGAQIIDINMDEGMLDAEACMVRFLNLCASEPEISKVPVMVDSSKWEVIEAGLKCIQGKGIVNSISLKEGKEKFIAQAKLVRRYGAAVIVMAFDEVGQADTRERKLEICRRAYHILVDEVGFPPEDIIFDPNIFAVATGIDEHNNYALDFINAVADIKRELPHAMISGGVSNVSFSFRGNNYVREAIHAVFLYHCFKHGMDMGIVNAGQLEIYDNVPLKLREAVEDVILNRRSDGTERLLEIAEAYRENSVGKEEDASALEWRAWPVAKRLEHALVKGITEFIVQDTEEARQQASKPLEVIEGPLMDGMNVVGDLFGEGKMFLPQVVKSARVMKQAVAYLEPFINAQKSGSTSNGKILLATVKGDVHDIGKNIVGVVLQCNNFEIIDLGVMVPCEQILKVAREQNVDIIGLSGLITPSLDEMVHVAKEMERQGFELPLLIGGATTSKAHTAVKIEQNYHAPVVYVNNASRAVGVCTSLLSDEQRPGFIERLDLDYERTRDQHARKTPKSRPVTLEQARANKAALDWANYTPPAPAKPGVHVFENIALATLRPYIDWTPFFMTWSLMGKYPAILEHEEVGEEAKRLFHDANALLDKVEREGLLKASGMCALFPAASVGDDIEVYSDESRTQVAHVLYNLRQQTEKPKGANYCLSDYVAPKESGKRDWIGAFAVTGGIGERALADAYKAQGDDYNAIMIQAVADRLAEAFAEYLHEKVRKEIWGYASDENLSNDDLIRERYQGIRPAPGYPACPEHTEKATLWQMLNVEETIGMSLTTSYAMWPGASVSGWYFSHPDSRYFAVAQIQPDQLHSYAERKGWRLEEAEKWLAPNLDA

SEQ ID NO: 10348 - protein, 625 aa, Vibrio cholerae
MDQNPQSQLKQLVLRGKEQGYLTYAEVNDHLPAEIVDSEQVEDIIQMINDMGIKVVETAPDADDLALSDDTTITDEDAAEAAAAALSSVESEIGRTTDPVRMYMREMGTVELLTREGEIDIAKRIEDGINQVQSAIAEYPGTIPYILEQFDRVQAEELRLTDLISGFVDPNDMETEAPTATHIGSELSEADLADEDDAVVEDEDEDEDEDGDGESSDSEEEVGIDPELAREKFNELRGKFQNLQLAVNEFGRDSHQASEASDLVLDIFREFRLTPKQFDHLVETLRTSMDRVRTQERLVMKAVVEVAKMPKKSFIALFTGNESNEEWLDKVLASDKPYVAKVREQEEEIRRSIQKLQMIEQETSLSVERIKDISRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPLPEELAERMQMPEDKIRKVLKIAKEPISMETPIGDDEDSHLGDFIEDTTLELPLDSATATSLKAATRDVLAGLTPREAKVLRMRFGIDMNTDHTLEEVGKQFDVTRERIRQIEAKALRKLRHPSRSEVLRSFLDE

SEQ ID NO: 10349 - protein, 335 aa, Vibrio cholerae
MSVSNTVTKVEEFDFEDEALEVLETDAELTSDEELVAVEGASEDVREEFDASAKSLDATQMYLSEIGFSPLLTAEEEVLYARRALRGDEAARKRMIESNLRLVVKISRRYSNRGLALLDLIEEGNLGLIRAVEKFDPERGFRFSTYATWWIRQTIERALMNQTRTIRLPIHVVKELNIYLRTARELSQRLDHEPTPEEIALELDRPVDDVTKMLRLNERISSVDTPIGGDGDKALLDILPDSHNADPEFSTQDDDIRESLLNWLDELNPKQKEVLARRFGLLGYEPSTLEEVGREINLTRERVRQIQVEGLRRLREILVKQGLNMEALFNVEYDN

SEQ ID NO: 10350 - protein, 121 aa, Vibrio cholerae
MDDCFREEEMKLINAIIKPFKLDDVREALADVGIEGMTVSEVKGFGRQKGHTELYRGAEYQVDFLPKVKIEIATQSDNVDRVVEAIIKAAHTGKIGDGKIFVYDLSQAVRIRTGEMDSEAL

SEQ ID NO: 10351 - protein, 1177 aa, Vibrio cholerae
MRLCPRFSLDLLVKVKKLVNFVTLGFSCLSPTHAWRSPQSFTESNTLIMFRFYRKQKFKRLQNTLMAAFLALSIIPLTITALFFLHSHSKDLEQQSTSYLVSVRDNKQQQVIDYMMAKESEVMGFVRSELAYASGGRFYGLVNAFQRLDVSIEAAREHAQQRYITGSGDQIKTSVLPQSSSYVGSERYRLLHKRYHWAYLELLKRSDFDDILLVDIDGNVVYSIYKYDNFGTNLLTGKYQDTNLGHTFKRLEQTVNEQRKTNEDFTPVVISDFVQEDGKQYAWLGAPIIQQGYLHSYAMFRLPSNAITKLIAEGSSNPSMQTILVGQDHRSRTLTSAEIAVEKSKAVVDLALSGKRAVGTYTNTDGEQIIAAYAPINLKNIHWALVVELPEKEAFARVRQLEKLFVFAMLTAIVLVVIASHYLSNFITSPLLKLTWAAERVSAGDLDEAMINTERKDEIGRLAVSFERMQRSIREKISLIKSQNKELESNLLIIRKQNDELQLANKLKDEFLATTSHELRTPLHGMIGIAEALISGANGPISAAHKYQLDIIISSGQRLATLVDDLLDYHKMRYGALDIQRCAVDLSSATRLVLELSHHLLGKKTLRIINQVSEQPVWVSADPQRLEQVLYNLIGNAIKYTSEGKIVISATYIDDKVRVQVVDTGQGIPAEQLEHIFEPLIQAGHDASRYRQGAGLGLSISRQLIELMHGTLYVSSQPMVGTTFSFTLPLASEEEIAQARLTELPHFQAPEVLDSELPEQSNLPENEHGPLLLVADDEPVNLRVLDSFLRLEGYRVHTAQDGHQVLEAIKREKPELVLLDIMMPGMSGYQVCEKLRQTYDHAELPIIMLTALNQSDDRVRGFEAGANDYLSKPFNKQELAARIVAHLTASKAELRRIENAQLQKELKHRAMVEASLLETQGRLLEQLESAPEAILCVKEGNKVRFANEAAARLFRRTPEQLKRSNAEELIAPKFLNIEQEHYCGNIDVYVDDVRQHLSADVLRLPQGSGLQAMYIFNVGGSVNAARIHNLETAVEALSSYAFEGDKDKLQKLKELGGEFTRLADKASGEYQSKQDLMRAVLVEAMTSALNYWERVSGQSKFTFAEQSGLWRVYLDRSTLQTRTLDKYLRIETLPKTPRWRTVLNSLDYILEHCKEAGPERTHIEMQRDKLQKLLTSE

SEQ ID NO: 10352 - protein, 748 aa, Vibrio cholerae
MLSQLRDIVEQVSKVEDVYQALDIFVKQTCEAMSTECCTVYLANEEMHRLELMATQGLKFKGDKIHIDFDEGLVGLVKRSAEPINLAEASKHPSFKYFKQLGEEVYHSFLGTPIIYRKQVLGVLVVQQKSPRLFSEMEVSFLVTLAAQLAVLVAHAQTQGHWRLSKKQQAITGVAASSGVAIGEFWWDDTQPDLSEVLPASALDPDFEQERIALAVENALADFRRMRKKLDGDINKEALAIFDLFTHLLNDPMLRKDLKAQIQKGDRADWALRQVVESYSNRFARMSDVYLRERAQDIRELGQRLLFFLLNTETNQPKIDKPVILVVRELTASVLAALPKDKLLAVVSLEGAANSHAAILSRALGIPAVMGVSINLRDLNGKKGIVDGYSGKLFISPSKTILNEYRALANEERELSRMVNEAIREPACTLDGARIELLLNAGLSADTSIAVNQGVDGVGLYRTEISFLLQHRFPSEEEQTQQYRHVLNTYPHQRVVMRTLDIGGDKPLPYLPIEEDNPFLGWRGIRFTLDHPDIFIIQLRAMLRASAESGNLSILLPMISGAKELDDALKFIYQAYQEVSQQDPRVVMPQIGIMLEVPSMLYLLPLIADKIDFVSVGTNDLTQYLLAVDRNNARVADVYESMHPAVVMALKQIQQTCATHQIPVCVCGELAGDPIGALLLIGLGYTTLSMNTSNVAKVKYLVRHSELAELTQLAEQALTQPYGREIYNMMLAYIEKHGFAGFVRAGKK

SEQ ID NO: 10353 - protein, 489 aa, Vibrio cholerae
MHMLRIAKEALTFDDVLLVPAHSTVLPNTADLRTRLTKNIALNIPMVSASMDTVTEARLAIALAQEGGIGFIHKNMSIEQQAAQVHQVKIFEAGVVTHPVTVRPEQTIADVMELTHYHGFAGFPVVTENNELVGIITGRDVRFVTDLTKSVAAVMTPKERLATVKEGATGAEVQEKMHKARVEKILVVNDEFQLKGMITAKDFHKAESKPNACKDEQGRLRVGAAVGAAPGNEERVKALVEAGVDVLLIDSSHGHSEGVLQRIRETRAAYPHLEIIGGNVATAEGARALIEAGVSAVKVGIGPGSICTTRIVTGVGVPQITAIADAAGVANEYGIPVIADGGIRFSGDISKAIAAGASCVMVGSMFAGTEEAPGEVILYQGRSYKAYRGMGSLGAMSKGSSDRYFQTDNAADKLVPEGIEGRIAYKGHLKEIIHQQMGGLRSCMGLTGSATVEDLRTKAQFVRISGAGMKESHVHDVQITKEAPNYRLG

SEQ ID NO: 10354 - protein, 541 aa, Vibrio cholerae
MKFQYDFVFLNQFSCKKLISFYRIIFPSKKVAVFYMIYPIPNSETSTVHFKDVYDNYIGGQWMKPHSGEYFSNTSPVNGLVFCRVARSSSQDVELALDAAHNALESWSTTSAVERSNILLRIADRIESNLETLAIVESWDNGKPIRETLAADLPLTIDHFRYFAACIRSQEGAASELDSRTLTYHLPEPIGVVGQIIPWNFPLLMAAWKLAPALAAGCTVVLKPAEQTPVSILFLMEIIGDLIPAGVINVVNGFGSEAGNALATSQRIDKLAFTGSTEIGNHILKCAADNLIPSTIELGGKSPNIYFPDIFSHEDQYLDKCIEGALLAFFNQGEVCTCPSRILVHESIYEKFIAKIIERVALIKQGNPLDTETQIGAQVSKEQYDKILGYIQIGKDEGAELIFGGHPNNQENYLSGGYYIKPTLFFGHNQMHIFQEEIFGPVIAITKFKDEIEALHLANDTVYGLGAGVWTRDINIAHRMAKNIKAGRVWVNCYHAYPAHAAFGGYKKSGIGRETHKLTLSHYQNIKNVLISHEIHPLGLF

SEQ ID NO: 10355 - protein, 193 aa, Vibrio cholerae
MSAISARITVFKNPWSVILSASLFSAQDEQFMRRAIVLAAQAEAQGEVPVGAVLVRDGEIIAEGWNGSITNHDATAHAEIEVIRKAGKALSNYRLLDTTLYVTLEPCPMCAGALLHSRVKRIVYGAPDLKAGAAGTVMDLFSSQAAYHYATVEKGLLEEECRAQLQAFFQRRRKEIKAKRDAERKNAERKNER

SEQ ID NO: 10356 - protein, 626 aa, Vibrio cholerae
MTLDISKYPTLALANTPDELRSLPKEVLPKLCDELRTYLLNSVSQSSGHLASGLGTVELTVALHYVYHTPFDHLIWDVGHQAYPHKILTGRRDQMPTIRQKDGLHPFPWREESEYDTLSVGHSSTSISAALGMAICAGKEGKDRKVVSVIGDGAITAGMAFEAMNHAGDVHPDMLVVLNDNEMSISENVGALNNHLAQVLSGSLYTSIREGGKKVLSGIPPIKELVRRTEEHLKGMVVPGTLFEELGFNYIGPVDGHDVLELIKTLKNMRELKGPQFLHVMTKKGKGYAPAEKDPIGYHGVPKFDPSHHSLPKSSNTKPTFSKIFGDFLCDMAAQDPKLMAITPAMREGSGMVRFSKEYPSQYFDVAIAEQHAVTLATGMAIAGYHPIVAIYSTFLQRGYDQLIHDVAIMNLPVMFAIDRAGIVGADGQTHQGAFDLSYMRCIPNMLIMAPADENECRQMLYTGHQHQGPSAVRYPRGNGMGVELESSFTALEIGKGRLMRESTACEGEKVAILSFGTLLPNALQAAEKLNATVADMRFVKPLDEALIKQLAQTHDVLVTLEENAIAGGAGAGVIEFLMKEKQLKPVLNLGLPDQFIVQGTQEEMHAELGLDGAGIERAIRDYLAK

SEQ ID NO: 10357 - protein, 184 aa, Vibrio cholerae
MSSPWELIKADLYRHTGQVSIGLVVKHLLLNAGFAYMFWFRLCRSKNVLIRTVARLMHRILSVRYQIQLPKETQVGPGLYLGHATGVIVNSTAKIGANCNLSPFTVIGSNQGQAATVGDCVYIGPHVSIVEDITIGDGSIIGAGSVVIRDVPPNSVVVGNPGRVLTRPSHKTYIRHPAPLESKS

SEQ ID NO: 10358 - protein, 143 aa, Vibrio cholerae
MWLYRVGHFFHKRRIPLLPQVCNGLIRLVHNCAVYSQSEIGKGTVFGYGGIAVVIHKRCVIGKECVIGSNVTIGGRSRSHNVPVIGNYVYIATGAKVLGDIRVGDGAVIGANAVVLEDVPPYSVVVGMPAKVIKTNINPKDFY

SEQ ID NO: 10359 - protein, 573 aa, Vibrio cholerae
MISGILASPGIAIGKALLLQEDEIVLNTNTISDDQVEAEVERFYTARDKSSAQLEVIKQKALETFGEEKEAIFEGHIMLLEDEELEEEILALIKKEKMSADNAIHTVIEEQATALESLDDEYLKERATDIRDIGTRFVKNALGMHIVSLSEIDQEVVLVAYDLTPSETAQINLNYVLGFACDIGGRTSHTSIMARSLELPAIVGTNDITKKVKNGDTLILDAMNNKIIVNPTQAQIEEAKAVKAAFLAEKEELAKLKDLPAETLDGHRVEVCGNIGTVKDCDGIIRNGGEGVGLYRTEFLFMDRDALPTEEEQYQAYKEVAEAMNGQAVIIRTMDIGGDKDLPYMDLPKEMNPFLGWRAVRISLDRREILRDQLRGILRASAHGKLRVMFPMIISVEEIRELKNAIEEYKAELRTEGHAFDENIEIGVMVETPAAAAIAHHLAKEVSFFSIGTNDLTQYTLAVDRGNEMISHLYNPLSPAVLTVIKQVIDASHAEGKWTGMCGELAGDERATLLLLGMGLDEFSMSGISIPKVKKVIRNANYAEIKAMAEEALALPTAAEIEACVDKFIAAKA

SEQ ID NO: 10360 - protein, 382 aa, Vibrio cholerae
MIPLSFSGFSCSLSGGSMGKKGEVMQSIQSKQDLCRWLSQFSHPDLISDWAMSPSIVTITPNQQVNVQLPFAAHSLLAELSDWIAKQQASGAVAPVTFDIQVKPQALETRVSAAVKGVKNIIAVTSGKGGVGKSTTAVNLALAIAKSGGKVGLLDADIYGPSVPLMLGKTKAKPVVRDNKWMQPIEAHGIATHSIGYLVDEADAAIWRGPMASKALAQLLNETEWPDLDYLVIDMPPGTGDIQLTLAQQIPVTGAVIVTTPQDLALADARKGAAMFAKVDVPVIGLVENMSYHICSHCGEKEHIFGVGGAQTLAAEFGLSLLAQIPLHIDMREDIDAGVPTVVARPNSEHTERYLALAQRVCASLFWQGKAKPESIQIQWVN

SEQ ID NO: 10361 - protein, 540 aa, Vibrio cholerae
MTQRGYMTKEIDKYSIDNTDYTVGQDNVQKWGFDVHNPVFGISAGLIAAFLLLTVLVDAHQAKIGLDTVKQSIIASFDWLFIWSGNLFLLFCVGLVISPFGKIRLGGQAAKADHSFLSWLAMLFAAGMGIGLMFWSVAEPVAYYTGWYETPLGVEANTPQAAQLAMGATMFHWGLHPWAIYGVVALSLAFFCYNKGLPLSMRSVFYPLLGDRAWGWAGHVVDILAVLATLFGLATSLGLGAQQAASGIHHVFGFESGIGLQIAVICVVTGLATLSVVRGIDGGVKVISNINMIVAFLLLALVAVIGYSVTLTSIPTTLMAYLQNLIPLSNPHGREDEVWFQGWTVFYWAWWISWSPFVGMFIARVSKGRTIREFIVAVLLIPTLVTLVWMSVFGGLAVDQVINEIGVLGQNGLTDVSLAMFQMFDSLVFGKVLSVIAVVLVLVFFITSSDSGSLVIDSITSGGKLDSPVLQRVFWAVLEGAVAVALLWIGGTEAVQALQAGVISTALPFTVILLLMCVSLWKGLKTEPEFMASSKRLHQS

SEQ ID NO: 10362 - protein, 1331 aa, Vibrio cholerae
MRSIKAMFVLLFCLMAILAVAMFKVTRQVADLRLESHQYSEQLFHFYRLSQELKQSSDHLTKFARAYASTGNERWLRMFNQVLNVRNGKLPAPSNNDYEFWDVVVLNDSSELTPNANQRYPTLIERIRQSGIGSVEFLELQNALALSDQLVALEREAFMAVKGWKREFAGEYRYTGEPDLNFARSLLYSEKYFLEKAKIMAAIGSAHSNIVDRIESEVRAADEKAQFYERVNLVLVSLSLLVIIASFILLWVIYIAPLSILLKTVVRQVRSEDYKFTLTQKAYGELQRFIDSLNVVFHHISEQLSFNTLVKDFNIIIRNHPTTEALCNQVTQFLLHHFPVELIGLYLYQNGVLTRIAGVGQSESAQRDYSDPTTTHCSVLRSGKPYAMKSLNGNFQVVSTSGVIALNEVYYLPLQVNNQPIALLELGTVGMLTMQQYHWLSQMLDDLSVAIQLSQNAEQQRLAERKVLEQSQLNQEILDATPNPMYCLSADGKFLTVNAKFLDLMGLYNNEVIDKEPQEIFPAEVAERFAAAHQVLTQQQSSQNYEVSLVDYTGVQREMLVYEASFSDRADKVNGIVGILLDMTERKEMEDELRKAKEAADAMSQAKGDFLANMSHEIRTPMNAILGMAHLALNTPLDTTQRKYVTRINESAKNLLGIINDILDFSKMEAGKLNVERIDFNLDDVLDNVTAVVSLKAQEKGIEFLMDIDPHIPLGLIGDPLRLGQVMVNLCGNAVKFTSQGEIVLSARVSQLNEQQVTLRFAVKDTGIGIAQDKLDDLFDAFSQADNSITRQYGGTGLGLSISKQLVELMGGQITVHSEEGKGSTFEFSVVCGLQDAKMRDISQPVHGLADKRVLVVDDNDSARHILDSLLTAMRFNVVTVSNGFEALSEIQQKPFDMLFVDWNMPGMNGIELLTRVKTLGLRGHMKSFLVTAYGREINLDGENSKLVDALIVKPVNPSNLLDAIVTSYGIEHVRHKTNEAHHNSRPNFAGQSLLLVEDNEVNQEVALGLLQDTGLNVVVANHGQEALERLEHADFDLVLMDMQMPVMDGITATEHIRANPRWHSLPIVAMTANAMAIDIERCLQAGMNDHLSKPIEVDKFYQVLRHFLQVSDEQSFSSHSPNKPSASKPAMNALLDLPQLTGVDLEQAIFRIGGNQQRYFEILRHFIDSQVDELNSVTGLIEAQDWSSATRVAHTLKGSAANLGLEALAQLAAEMEQSLEQQVLPSFELLQQAQSLLTQVDDELSAWEHQHKEPLLAENLDWGLWYQQLQQAINDYDVTALSLSKSIRQVSQWDSAQQAALISAIEDFDFEQAKALLASYPQLSGERLNQ

SEQ ID NO: 10363 - protein, 572 aa, Vibrio cholerae
MKMDSEYTEKVNELTLELQRSIERGKQLAEENRVILAAISAFSVATNKNHIFEELKTLLNRYIQFDDFIVISKDKNGHQFRTAIASNASFNDVVWPNGVKFQRVLNGECILLFEPCKLDEFACLMGSIDKPVYSALITGIQAQISDSVLILLGQNKGQFSLEAKETLSRFRPLLERAISDIEHKEELQKLVEIRTRELRLAQKLAEQANQSKSNFLAMMSHELRTPLNAVLGLIDILRGESTSYQVELLEQMENSAELLLIIINDILDLSRIESGHFSLHCHWLDLEKKLDQSLVYHRQIAQDKGVHFYVQSNKNPTLEYYTDSARLTQILFNIVGNAIKFTKQGQVDVVLDYTKDGVVFRVKDTGIGIEKNRVEQLFTPFIQADNSITRNYGGTGLGLAITKHLVELMGGTIQVESEFGIGTTFTLYIPLQSRLKNIKPSTSSSQQIVNVKNHHILVVEDTKTNQMVIQLLLNKLGYDVTIAENGLQAVELLEKNHVFDLVLMDISMPIMDGIAATKILRDKHIEIPIIALTAHTAGSDKQNCIDAGMNDIVLKPIRSKDIMEVVKRFLNP

SEQ ID NO: 10364 - protein, 461 aa, Vibrio cholerae
MENSVHRYKKEASNLIKLATPVLIASVAQTGMGFVDTIMAGGVSAIDMAAVSIAASIWLPSILFGVGLLMALVPVVAQLNGAGRQHKIPFEVHQGLILALLVSVPIIAVLFQTQFIIRFMDVEEAMATKTVGYMHAVIFAVPAYLLFQALRSFTDGMSLTKPAMVIGFIGLLLNIPLNWIFVYGKFGAPELGGVGCGVATAIVYWIMLLLLLFYIVTSKRLAHVKVFETFHKPQPKELIRLFRLGFPVAAALFFEVTLFAVVALLVAPLGSTVVAAHQVALNFSSLVFMFPMSIGAAVSIRVGHKLGEQDTKGAAIAANVGLMTGLATACITALLTVLFREQIALLYTENQVVVALAMQLLLFAAIYQCMDAVQVVAAGSLRGYKDMTAIFHRTFISYWVLGLPTGYILGMTNWLTEQPLGAKGFWLGFIIGLSAAALMLGQRLYWLQKQSDDVQLHLAAK

SEQ ID NO: 10365 - protein, 252 aa, Vibrio cholerae
MRGLTHKVALVTGAANGIGLAIAERLYQEGATLALADWNEEQLAIVIEQFDSARVYAQKVDVSDPEQVQALVRKTVERFGRLDILVNNAGIHIPGTVLECSVQDWRRIASVNIDGVVYCAMHALPELIKTRGCMVNTASVSGLGGDWGAAFYCATKGAVVNFTRALALDHGAQGVRINAVCPSLVKTNMTNGWPQAIRDQFNERIALGRAAEPKEIAAVVAFLASDDASFVHGVNLPVDGGATASDGQPKIV

SEQ ID NO: 10366 - protein, 458 aa, Vibrio cholerae
MSVVSQVLSHMRGDFFRRLIAIALPITLQNIMFSSRGLVDVLMLGQLGEAEIAAVGVAARATFVTTIMLVGVTTGGALLTAQYWGAGDRKGVRESTALTWLVSNFFAFFTVLLFLFFPQQIMSLTTDSEQVNALGSQYLIITSFTMFAVACVSSMAVGLRAMHKPGVSTFFSGIGIVSNVVLNWILIFGKFGFPAMGIQGAAIATVLSGAIEIACLYSYLYGKKHLMAFGWQDIKAVIDWPKISRFLRLSLPTTFNFLIWAAGLFTYHAIMGQTGVQGLAALSVMTPVESISLSLLIGMSTAAAVLVGNQLGAKNYEAVYYQAIGVTACSVLVGIVVAIGLYLVQIPVLGAFTALTPETRELSEKFMLILCLGIVLRSFPMTAIVGVLRAGGDVKFCLGQDIVAQWCIGIPLAAFAALVLKVEPEWIYLLFLTEEVVKWFGSLHRMKSKKWMKNLIEN

SEQ ID NO: 10367 - protein, 1146 aa, Vibrio cholerae
MPYWGGTGQEPIGIEHDFASGIAKELGINIEYKGFDTIEALLNAVSTGKADMAIGFGQTLAREGKFLFSKPLYENVRVIWLRDKAMEEKPFASLKWVCIQGTSYCEILKDRGYPNIIMARNYSSSVEMIRQGIADATVTNYVSLNHYLSQKRLALGKVIFDPDLGVQTNRILINNNEPLLLSAINKVIDADKQGLTENKLNSADVYFLNDQANLNILRNENVNPVVRYTIQDDLFPMSYWDEKEKKYKGYVHDLLERISTKSILKFEFVPAYGRDVEDMLRHGKVDLIPSFNMTYVDDRYFIHTGRYTDIQFGYIETTRPYTTPITGILDRTGKFNAYIAVQKNLSDVKVYRSMYDLEQALEKGDITHGLLNKVLINQMLLDGHQDAFKLSPLTEGQDLRADMTMLVRKDARGLQNMLQKVLATFSQQEIDEIKGAYDRVTVYFGYDKQKVLIYALIILCALLSIGLILTLSLSRLRGKLRSSEQVAKLSTEQLRWLTELLDAIPSMIFISDAKGEVVLTNAAYRKIYHTCCEKGCVQPQPECSFLALPDQHEAEFSIIIQAPKSNCSIGEHYFHVTRRAISHPINQRKYYLTLFNDITELKETEQALRQSNEQALQAVEARNHFLAVVSHELRTPIAAMLGLMEILASRLKSSESQLLLTNAISSAERLKLHVNDILDFSKIEAQQLQLDIGLYNLADELGPLLRGFEASAQLKEIEFDVIWSPNSLLLANFDALRFNQIVTNLLSNAIKFTDQGRVVFKIDVAPEMLTIVVEDTGCGMTQTQIESLFVPFAQADSTITRRFGGTGLGMSIVANLIELMNGKIEVKSEFEQGTQIQVNLPLVTQTCDEFRGQVVAMSYRSPYMLWAKALGMRVEENEEWVEQSGHNIYPDLLLNRLREVSNLTQAQTEPAHSRLLQGHVLVADDDAINRLLIKKQLSELGLSATLVSDGLQAFEKLSQHPEQYDLLITDCHMPHLDGFALTRKVKQEISLFKGAVVGCTAEDSRLAAEQALQAGMDKVIYKPYTLANLRKVLSRYLTTQWVALPEQSWLDAYQEEEREEMAMVVAESLAQDIALLNQPDCDVKALAHRIKGAAGSLQLQRLADLAKTVEKQNDPQQLVADKQQLINAMHEVVEQAQQWLHQYQSE

SEQ ID NO: 10368 - protein, 488 aa, Vibrio cholerae
MRSLAMLPTDFPFFHQSAFINGQWILGEPQARQTVTNPFDGSLIGSVPLLSAAQVQEAIAGAQAAQILWCQQPAENKAKILRRWYELIEQHHESLAKLLTIEQGKPLAEARGEIHYAASFVEWYAEEAKRAYGELIPSHKPDARIMVSRQPVGVVAAITPWNFPAAMITRKCAPAFAAGCAVVLKPAPDTPFTALALADLAQQAGIPDGLLQVVTGDAIEIGRVLTESKTVRKLSFTGSTGVGKLLMAQSANNVKKLSLELGGNAPFIVFEDADINAAIDGVMVAKFRNAGQTCVCANRIYVHDAVYDQFAAKLVDRVSRLNVGYGLDAGVNIGPLINDAAVAKVTSHIVDAQSKGAKVMFGALPEAGSRLFQPHVLTEVTDEMRVADEETFGPLAALFRFSSEQEVIERANATDSGLAAYCYTQSLRRAWHMSEALEAGIVGINEGLISTTLAPFGGIKESGLGREGAKHGLEEYLEVKYTLMGGLA

SEQ ID NO: 10369 - protein, 506 aa, Vibrio cholerae
MIYAQPGSDNAVITFKSHYDNFIGGQWVKPVSGEYFGNISPVNGQVYCQVARSTQADIDLALDAAHQVREAWAKTSVTERSNLLLKIADRIEANIEQLAVAECWENGKPVRETLAADLPLVVDHFRYFAGCIRAQEGSAAELDSHTASYHFPEPIGVVGQIIPWNFPMLMAAWKLAPALAAGCCVVLKPAEQTPTSILVLIEKIADLIPAGVLNVVNGFGSEAGQALATSQRIAKLAFTGSTQVGQHILKCAAQSLIPSTVELGGKSPNIYFPDIFDHEDTYLEKCIEGTLLGFFNQGEVCTCPSRVLVHESIYDRFVAKVAERAKGIKQGNPLDTATQVGAQASQEQFDKILSYLDIGRQEGAKVLFGGGVAKQEGELGQGYYIQPTLLQGHNKMRVFQEEIFGPVIAITSFKDEAEALALANDTEYGLGAGIWTRDQNLAYRMGRNIQAGRIWINCYHAYPAHAAFGGYKKSGIGRETHKMMLNHYQNTKNLLISYDVNPLGFF

SEQ ID NO: 10370 - protein, 736 aa, Vibrio cholerae
MVMAIRSSLKKKSILALTIYLAFFLAIVGTLSYWGLEVPFRKELKNNLALRAELLATQIREPLNNSIGVLQSLTSIGKSAADKEEQERMLRSLFSVVGGVIISGGLWPEPNLSATDPSLRYDSLFFNKATDGQVDQLSSWNNPKAGGYDRESWYLAAEREAEGLYFWSPVYVDPYTRVEMITVSTPYYRNGQFAGVATVDLSLESLIQFVAATAEQYNLGVNLKDAFGVEVVSHNFRTYDNALVSYYSFGEFNWQIEVVNANQHVDEIIFDLIINIEKGLMPILLLCVMVGYFLISHYWIRPIVLIAKKVSESREGEIIDIRYKSQDEIRHLIDTFNQKTIYLEAEKVKAQASTKAKSAFLATLSHEIRTPMNGVLGTAQILLKDELTSKQRQHLTSLYESGEHMMSLLNEILDYSKIEQGKFELDHSAFPLKSIIGSIKSIYSSLCVEKGLKFQLNSEITDGRWYYGDKARLRQIIFNLLSNAVKFTEAGFVAIGLSEESCDEENYLIIKVQDTGIGIAQESLGRIFRPFEQAESHTTRRFGGTGLGLAIVKQIAELMNGTVLVQSEVGQGSCFKVRVKLAITEPVTEDVKPTKAKTYPGLRVLIVEDNRTNIMILEAFMRNKGFECHSVMDGVQAITALQESSFDLVLMDNHMPLKDGIQATREIRQLPLPQAKILLFGCTADVFKDTRDKMLSAGADDIIAKPIAEHELDMALEQHSERLYQFHREPSLPSVE

SEQ ID NO: 10371 - protein, 248 aa, Vibrio cholerae
MSQFMNLEGKVALVTGASRGIGKAIAELLAERGAKVIGTATSESGAQAISDYLGDNGKGMALNVTNPESIEAVLKAITDEFGGVDILVNNAGITRDNLLMRMKEEEWSDIMETNLTSIFRLSKAVLRGMMKKRQGRIINVGSVVGTMGNAGQANYAAAKAGVIGFTKSMAREVASRGVTVNTVAPGFIETDMTKALNDEQRTATLAQVPAGRLGDPREIASAVAFLASPEAAYITGETLHVNGGMYMI

SEQ ID NO: 10372 - protein, 114 aa, Vibrio cholerae
MNMKKIEAIIKPFKLDDVREALAEVGITGMTVSEVKGFGRQKGHTELYRGAEYMVDFLPKVKLEIVVTDDVADRCVDTIIETAQTGKIGDGKIFITNVERVVRIRTGEEDEDAI

SEQ ID NO: 10373 - protein, 402 aa, Vibrio cholerae
MRKLTILGATGSIGASTLKVIAQNPQQFSIVALVAGVNVAKMYQLCQQWRPKYAVMATASAASELQGLLKNQAMATEVLYGEEAMCQVAALDDVDTVMAAIVGAAGLLPTMAAVKAGKRVLLANKEALVMSGQLFIDAVAQSGAELMPVDSEHNAIFQCLPTEIQTQLGRCDLSQHGIDHILLTGSGGPFRYSDLATLDSVTPEQAIAHPNWSMGPKISVDSATMMNKGLEYIEAKWLFNTSREQLKVLIHPQSVIHSMVQYQDGSVIAQLGEPDMATPISYAMAYPERVTAGVPALDFTRLQQLTFMEVDFARYPCLQLAMDACFLGQHATTSLNAANEVAVDAFLKRKIRFTDIALINDQVLSKVCATNTQLHCRDLESLLELDTMARHFAHQVLKERQA

SEQ ID NO: 10374 - protein, 785 aa, Vibrio cholerae
MKPMKNLAQYYVDLLVKLGILRFSILLALALVALAVVVQVGITLILNGFVDDIDIIRSVFFGLLITPWAVYFLSVVVDQLEESRQRLSKLVSKLKDMRSRDQELNQKLQQNIVKLNQEIEERIKAEEAREEAMADLENEVYQREKTQVELAERTALLRSFIDASPDLIYYRNAKGEFSGCNRAMEELTGKRESELVGLTPWDVYRKEIAQSIVETDQQVFNNNTAITYEQWLEYPDGRKSFFELRKVPFYNKDGRHLGLVGFGRDITERKRHEESLEKASRDKTTFISTISHELRTPLNGIVGLSRMLLDTPLSGEQRKHLQTINVSAVTLGNIFNDIIDMDKFDRRKLELFPAALNFEEFVAEIEVLAALMAEQKGLRFDLERLTDLPSLVEVDSTRLRQVLWNLLSNAMKFTKEGGVVMTVSAECDAQHAEITIEVEDTGIGIPEAEQEKIFAMYYQVKSGKDNLHAVGTGIGLAVSRQLIKLMGGDISVNSEEGFGSTFTVTIRVPLLAEAPIEIEPQEPQTELNIFMVEDIELNITVARSLLESMGHKVTVAMTGEEAIQGFNPTEYDLVFLDIQLPDMTGFDIAHYYRTHYSSLPPLVALTANVLKDKEEYRQKGMDAAISKPLSVAAVREVIAKMTQHHAGESVAKVKSNKEKELPDDLYQQLLDLEMLQSYVEIVGSQPVIDSVHLFEQSMPAYLAVLDSNMVAKDQEGIVSEAHKIKGAAGSVGLKRIQKIAQKAQSPEAPAWWENISDWVEEIKNEYQSDIALLKRWLTQQANAKQ

SEQ ID NO: 10375 - protein, 433 aa, Vibrio cholerae
MSKIVKVLGREIIDSRGNPTVEAEVHLEGGFVGMAAAPSGASTGSREALELRDGDKSRFLGKGVLKALAAVNGPIADALVGKDAKDQATIDQIMIDLDGTENKSNFGANAILAVSLANAKAAAAAKGMPLYEHIAELNGTPGVFSMPLPMMNIINGGEHADNNVDIQEFMIQPVGAKTLKEAVRMGAEVFHNLAKVLKSKGYNTAVGDEGGFAPNLKSNAEALEVIAEAVAAAGYKLGTDITLAMDCAASEFYDAEKKEYNLKGEGRIFTSNGFSDFLEELTEKFPIVSIEDGLDESDWEGFAYQTEKLGKKIQIVGDDLFVTNTKILKRGIDNGIANSILIKFNQIGSLTETLAAIKMAKDAGYTAVISHRSGETEDATIADLAVGTAAGQIKTGSMSRSDRVAKYNQLIRIEEALGSRAPFNGLKEVKGQA

SEQ ID NO: 10376 - protein, 927 aa, Vibrio cholerae
MTQRYGLRARVMTLTLAPTLIIGLLLSALFSFNRYHDLETQVINSGASIIEPLAIASEDALRMQSRESVRRIISYAHRKNSKLVRSIAVFDANHELFVTSNFHPNFEKLMYPKDKPIPFLSSSVIDENTLILRTPIISERTVLDNGDANPATPVMGYIAIELDLSSLRLQQYQEIFSAGLVLVIGILLSGVFASRLMYDVTRPITHMKNMVDRIRRGHLDVRIEGKMHGELDTLKKGINAMAVSLSEYHVEMQHSIDQATSDLRETLEQLEIQNVELDIAKKRAQEAARVKSEFLANMSHELRTPLNGVIGFTRQMLKTQLTNSQADYLQTIEKSANNLLTIINDILDFSKLEAGKLALENIPFEFQEVLEEVVNLQATSAHEKGLEITLKIDPKIPRGVVGDPLRIQQVLTNLVGNSIKFTERGNIDVSVEMRALRDDVIDLQFMVRDTGIGISERQQAQLFQAFSQADASISRRYGGTGLGLVITQKLVSHMGGEISLTSRLHQGSTFWFTLRLHTTELPLNDGYNADSLNHRHLLLIEPNMQAAAIVQQTLVQSGLEVTYRSAIPEEQHVYDYVLLNLAPSKETNPTLVELWVQRALAMTHNVIVGVPSTELALADQLMQRYPVKCISKPLSRKKLLQTLAAQQPQLANTSLPKPQADKLPLCVMAVDDNPANLKLITALLQERVEYVVSCTSGQEAIEQAQSRQFDIILMDIQMPHMDGVTACKAIKQLKGYRDTPVIAVTAHAMAGERDRLLKAGMDDYLTKPIEEHILQQVLVHWSPHTRSKQVAKVTPPDGAAVISNALPSSPPAEEAIIDWPVALRQSANKEDLAKEMLGMLVDYLREVETVVNTALEDEEYPASDLLHHIHKLHGSCSYSGVPRLRKICASLEQALRNGASIDELEPELFELQDEMAKVLEASRDYLN

SEQ ID NO: 10377 - protein, 336 aa, Vibrio cholerae
MQKMRTLGEFIVEKQHDFPHASGELSSLLASIRLAAKIVNREINKAGLADIIGASGNDNIQGEEQQKLDLYANEKFKAALEARDQVCGVASEEEDEAVAFSKELNKNAKYVVLMDPLDGSSNIDVNVSVGTIFSIYRRVSPVGTPPTQEDFLQPGNKQVAAGYVIYGSSTMLVYTTGNGVNGFTYDPSLGTFYLSHENMRIPENGKIYSINEGNYIRFPTGVKKYIKFCQENVPEEGRPYTSRYIGSLVADFHRNLLKGGIYLYPSTQSHPNGKLRLLYECNPMAFLIEQAGGLASDGARRIMDIKPTELHQRVPFFVGSKNMVHKVETFLETYPD

SEQ ID NO: 10378 - protein, 273 aa, Vibrio cholerae
MKQCAHTKVWQTIVAEAREQAEQEPMLASFYHATIIKHDSLKAALSYILANRLNTASMPAMAVREVIEEAFAADPSISEAAACDICATVNRDPAVSMYSMPLLYLKGYHALQGYRVANWLWRQGRKALATYFQNQISVACQVDIHPAARIGRGIMLDHATGIVIGETAVVEDDVSILQDVTLGGTGKECGDRHPKIREGVMIGAGAKILGNIEVGEGAKIGSGSVVLQAVPPHTTVAGVPARIVGRPQSDKPSLDMDQQFNGRSQTFIGGDGI

SEQ ID NO: 10379 - protein, 335 aa, Vibrio cholerae
MKRDLAMAFSRVTEGAALAGYKWLGRGDKNAADGAAVEVMRILLNQTEISGEIVIGEGEIDEAPMLYIGEQVGLGGDAVDIAVDPIEGTRMTAMGQSNALAVLAAGEKGSFLKAPDMYMEKLVVGPGAKGCIDLNLPLKDNLNHVAKALGKPLTDLVVITLAKPRHDQVIAQMQQMGVRVFAVPDGDVAASILTCMPDSEVDMMYCIGGAPEGVVSAAVIRALDGDMQGRLLPRHQVKGDSEDNRIWGAKELERCQQMGVEAGKVLKMEDMARSDNVIFAATGITKGDLLDGISRKGNIATTETLLIRGRCRTIRRIRSIHYLERKDQQVRDIIL

SEQ ID NO: 10380 - protein, 404 aa, Thermotoga maritima
MNTGEMKINWVSRYMPLLNKIAEEYSREKPLSGFTVGMSIHLEAKTAYLAITLSKLGAKVVITGSNPLSTQDDVAEALRSKGITVYARRTHDESIYRENLMKVLDERPDFIIDDGGDLTVISHTEREEVLENLKGVSEETTTGVRRLKALEETGKLRVPVIAVNDSKMKYLFDNRYGTGQSTWDAIMRNTNLLVAGKNVVVAGYGWCGRGIALRAAGLGARVIVTEVDPVKAVEAIMDGFTVMPMKEAVKIADFVITASGNTDVLSKEDILSLKDGAVLANAGHFNVEIPVRVLEEIAVEKFEARPNVTGYTLENGKTVFLLAEGRLVNLAAGDGHPVEIMDLSFALQIFAVLYLLENHRKMSPKVYMLPDEIDERVARMKLDSLGVKIDELTEKQRRYLRSWQ

SEQ ID NO: 10381 - protein, 726 aa, Thermotoga maritima
MYVAALFFLIPLVALGFAAANFAAVVRKPEGTERMKEISSYIRSGADSFLAHETKAIFKVAIVIAILLMIFTTWQTGVAFLLGAVMSASAGIVGMKMATRANVRVAEAARTTKKIGPALKVAYQGGSVMGLSVGGFALLGLVLVYLIFGKWMGQVDNLNIYTNWLGINFVPFAMTVSGYALGCSIIAMFDRVGGGVYTKAADMAADLVGKTELNLPEDDPRNPATIADNVGDNVGDVAGLGADLLESFVGAIVSSIILASYMFPIYVQKIGENLVHQVPKETIQALISYPIFFALVGLGCSMLGILYVIVKKPSDNPQRELNISLWTSALLTVVLTAFLTYFYLKDLQGLDVVGFRFGAISPWFSAIIGIFSGILIGFWAEYYTSYRYKPTQFLSKSSIEGTGMVISNGLSLGMKSVFPPTLTLVLGILFADYFAGLYGVAIAALGMLSFVATSVSVDSYGPIADNAGGISEMCELDPEVRKITDHLDAVGNTTAAIGKGFAIGSAIFAALSLFASYMFSQISPSDIGKPPSLVLLLNMLDARVIAGALLGAAITYYFSGYLISAVTKAAMKMVDEIRRQAREIPGLLEGKAKPDYNRCIEITSDNALKQMGYPAFIAILTPLVTGFLLGAEFVGGVLIGTVLSGAMLAILTANSGGAWDNAKKYLEAGNLEGYGKGSEPHKALVIGDTVGDPLKDTVGPSLDILIKIMSVVSVIAVSIFKHVHLF

SEQ ID NO: 10382 - protein, 768 aa, Thermotoga maritima
MRNRREVSKLLSERVLLLDGAYGTEFMKYGYDDLPEELNIKAPDVVLKVHRSYIESGSDVILTNTFGATRMKLRKHGLEDKLDPIVRNAVRIARRAAGEKLVFGDIGPTGELPYPLGSTLFEEFYENFRETVEIMVEEGVDGIIFETFSDILELKAAVLAAREVSRDVFLIAHMTFDEKGRSLTGTDPANFAITFDELDIDALGINCSLGPEEILPIFQELSQYTDKFLVVEPNAGKPIVENGKTVYPLKPHDFAVHIDSYYELGVNIFGGCCGTTPEHVKLFRKVLGNRKPLQRKKKRIFAVSSPSKLVTFDHFVVIGERINPAGRKKLWAEMQKGNEEIVIKEAKTQVEKGAEVLDVNFGIESQIDVRYVEKIVQTLPYVSNVPLSLDIQNVDLTERALRAYPGRSLFNSAKVDEEELEMKINLLKKYGGTLIVLLMGKDVPKSFEERKEYFEKALKILERHDFSDRVIFDPGVLPLGAEGKPVEVLKTIEFISSKGFNTTVGLSNLSFGLPDRSYYNTAFLVLGISKGLSSAIMNPLDETLMKTLNATLVILEKKELPRAEVKEEKLVEIILSGNRSELEKLVEDFLKEKDPLSVIEEHLRPAMERIGELYDKGKIFLPQLILAAQTVKPVFDKLTSMLPSDSQGETFVIATVKGDVHDIGKNIVASVIRSSGYRVVDLGKDVDTSEIVEAVEKERPVALGLSAMMTTTVGRIKEVVEKLKEKNLKIPVIVGGASLNEKLAKELGADYYAKNASEAVKILKSLGR

SEQ ID NO: 10383 - protein, 881 aa, Thermotoga maritima
MAKKYVYFFANGKAEGRADMKDILGGKGANLAEMTNLGIPVPPGFTISAEVCKYYYDHGRTYPEELKEQVEEAMRRLEEVTGKKFGDPNNPLLVSVRSGAAISMPGMMDTVLNLGLNDETVKGLAKLTNNERFAYDAYRRFLQMFGDVVLKIPHEKFEKALEELKKEKGVKLDTELDAEDLKKLVERYKQIYKEEGKEFPQDPWKQLWLAIDAVFGSWMNERAIKYRQIHGIKEGDLLGTAVNIVAMVFGNMGEDSGTGVAFTRDPNTGEKKPYGEFLPNAQGEDVVAGIRTPLKLEELKNRMPEVYNQLLEIMDKLEKHYRDMQDIEFTVERGKLYILQTRNGKRTSQAAIRIAVDMVHEGLITKEEAILRVRPEDVEQVLHPVFDPKEKAQAKVIAKGLPASPGAATGKVVFNAKKAEELGKAGEQVILVRPETSPEDVGGMAAAQGILTSRGGMTSHAAVVARGMGKPAVVGAESIEVHPEEGYFKVGDVVVKEGEWISIDGTTGEVLLGKVTTIKPQGLEGPVAELLQWADEIRRLGVRTNADIPRDAEVARKFGAEGIGLCRTEHMFFEKDRIPKVRRMILAKTKEEREKALDELLPLQKEDFKGLFRVMKGLPVTIRLIDPPLHEFLPQEDEQIKEVAEQMGVSFEELKNVVENLKELNPMLGHRGCRLTITYPEIAVMQTKAIIGAAIELKKEEGIDVIPEIMIPLVGHVNELRYLKKIIKETADALIKEAGVELTYKIGTMIEVPRAAVTAHQIAEEAEFFSFGTNDLTQMTFGFSRDDVGKFLPEYLEKGILEHDPFKTLDYDGVGELVRMGKEKGRSTRPDLKVGVCGEHGGDPRSILFFDKIGLDYVSCSPYRVPVARLAAAQAALKNKK

SEQ ID NO: 10384 - protein, 257 aa, Thermotoga maritima
MNILEKLFSLKRKVALVTGGGQGIGKAIAQALAAAGAAVLIMDINEETARRTVEEIKEKGGEADFYVGDVTKEEDCFGAVKKALDRWGKLDIGVNNAGIGDWCEAENYPVEKWKKVIDVNLVGVFLSAKAEFHAMKERKYGKIINIASMSGHIVNKPQKQTAYNASKAGVIHLTRSLAAEWAPYGIRVNSISPGYIRTPLIESPNVKDLVPLWLDMIPLGRLGEVDDLIGAAIFLASPASDYMTGHDLVIDGGYTVW

SEQ ID NO: 10385 - protein, 251 aa, Thermotoga maritima
MNFQGKVVLITGAGSGIGKKAAVMFAERGAKVAINDISEEKGKETVELIKSMGGEAAFIFGDVAKDAEQIVKKTVETFGRLDILVNNAGIVPYGNIEETSEEDFDKTMAVNVKGPFLLSKYAVEQMKKQGGGVIVNVSSEAGLIGIPRRCVYSVSKAALLGLTRSLAVDYVDYGIRVNAVCPGTTQSEGLMARVKASPNPEELLKKMTSRIPMKRLGKEEEIAFAILFAACDEAGFMTGSIINIDGGSTAV

SEQ ID NO: 10386 - protein, 113 aa, Thermotoga maritima
MKLIIAVIQPHKLPDVKKALFDAQVYKMTVMNVLGCGQQKGYTETYRGEVEEVNLLKKVMLLIAVNEEFVEPTIEAIQKGARTGNIGDGKIFVLDLLDCIRIRTGERGREAIG

SEQ ID NO: 10387 - protein, 255 aa, Thermotoga maritima
MKEVFDLRGRVALVTGGSRGLGFGIAQGLAEAGCSVVVASRNLEEASEAAQKLTEKYGVETMAFRCDVSNYEEVKKLLEAVKEKFGKLDTVVNAAGINRRHPAEEFPLDEFRQVIEVNLFGTYYVCREAFSLLRESDNPSIINIGSLTVEEVTMPNISAYAASKGGVASLTKALAKEWGRYGIRVNVIAPGWYRTKMTEAVFSDPEKLDYMLKRIPLGRTGVPEDLKGVAVFLASEEAKYVTGQIIFVDGGWTAN

SEQ ID NO: 10388 - protein, 220 aa, Thermotoga maritima
MRLLFRKAGEFFRDFVSIFKHISDDLEMYLKLDPAAESKLQVFFFYASFQGLMWYRFAHFFYKWKLKVLAYLIYYFVRVVFSMDIHPAARIAPGVVIDHGIGVVIGSTASVGRGTLIYHGVTLGTRKPCSGKRHPDVGENVMIGTGAKILGPIRVGNNAVVGANAVVLEDVPDGAVVVGVPARIVKWRRDFCDDGKTDREHSYSETRFDRLENLLETGKE

SEQ ID NO: 10389 - protein, 276 aa, Thermotoga maritima
MWRENKALAFLVLTAVLQGSTFPLQKLVLGGVSPFVYNTVRFGSAALLSLFVFGPGRFVKGFLLGLVLCGAYIFQLWGLKFTSAVKSGFIVSSFVFLVPLFAFLLEREKLRKIHFISFTSGFLGLYLLTGGVSQITLGNLFQFFCAVLFALHVVLITRFSRSEEEKNMLFWQFVTVGAVNFLFGLGERWHLNLEAISVGIYSGVFATTLGILWQMRYQKEVGNNTTALVYMTQPFVSLVLSFLLLGERMSFLQLLGGILVLVALFTGTTLRPRESN

SEQ ID NO: 10390 - protein, 489 aa, Thermotoga maritima
MEEIKEQNNRLFLLLSIMIMEFSNAKTESDILQGLLNLVRKVVDIKEVVLVDENKRKIWGRDIDIKRFEEFIDWSIRQSNPVFVEDELGYVGIVPVVKQDRMFGSLIVLLNHQPSMEETEIFKVLSFLSAVVLENIKLYRELEETYNYVNVILNGLPEGIFVYSNGEIKFQNEKFKEENFPDEVLRKAISLSEEAISLRTQRVGEVISGEEFFSITSIPLILGSEVQALTIVENVTESKELERLKRIDRMKTEFIANISHELRTPLTAIKAYAETIYNSLGELDLSTLKEFLEVIIDQSNHLENLLNELLDFSRLERKSLQINREKVDLCDLVESAVNAIKEFASSHNVNVLFESNVPCPVEAYIDPTRIRQVLLNLLNNGVKYSKKDAPDKYVKVILDEKDGGVLIIVEDNGIGIPDHAKDRIFEQFYRVDSSLTYEVPGTGLGLAITKEIVELHGGRIWVESEVGKGSRFFVWIPKDRAGEDNRQDN

SEQ ID NO: 10391 - protein, 427 aa, Thermotoga maritima
MEIVDVRAREVLDSRGNPTVEAEVVLEDGTMGRAIVPSGASTGKFEALEIRDKDKKRYLGKGVLKAVENVNETIAPALIGMNAFDQPLVDKTLIELDGTENKSKLGANAILAVSMAVARAAANYLGLPLYKYLGGVNAKVLPVPLMNVINGGQHADNNLDLQEFMIVPAGFDSFREALRAGAEIFHTLKKILHEAGHVTAVGDEGGFAPNLSSNEEAIKVLIEAIEKAGYKPGEEVFIALDCAASSFYDEEKGVYYVDGEEKSSEVLMGYYEELVAKYPIISIEDPFAEEDWDAFVEFTKRVGNKVQIVGDDLYVTNVKRLSKGIELKATNSILIKLNQIGTVTETLDAVEMAQKNNMTAIISHRSGESEDTFIADLAVATNAGFIKTGSLSRSERIAKYNQLLRIEEELGKVAEFRGLKSFYSIKR

SEQ ID NO: 10392 - protein, 376 aa, Thermotoga maritima
MEERTLVILGATGSIGTQTLDVLKKVKGIRLIGISFHSNLELAFKIVKEFNVKNVAITGDVEFEDSSINVWKGSHSIEEMLEALKPDITMVAVSGFSGLRAVLASLEHSKRVCLANKESLVCGGFLVKKKLKEKGTELIPVDSEHSAIFQVMEPEVEKVVLTASGGALRDWKISKIDRARPEDVLKHPVWNMGARITVDSATMVNKAFEVLEAMELFELPFEKIEVKIHREGLVHGAVVLPDGNVKMVVSPPDMRIPISYALFYPRRVALEPFFLRTISLSFEDPDPEKYPAFFLLKEIKDSYALRTAFNAADEVAVEAFLKGRIRFGGIHRVIEKTLEEFQGYPQPRTLDDVERIHFEAIKKAERVTEWLSSTSY

SEQ ID NO: 10393 - protein, 286 aa, Thermotoga maritima
MQVPKVTLNNGVEMPILGYGVFQIPPEKTEECVYEAIKVGYRLIDTAASYMNEEGVGRAIKRAIDEGIVRREELFVTTKLWVSDVGYESTKKAFEKSLKKLQLEYIDLYLIHQPFGDVHCAWKAMEEMYKDGLVRAIGVSNFYPDRLMDLMVHHEIVPAVNQIEIHPFYQRQEEIEFMRNYNIQPEAWGPFAEGRKNIFQNGVLRSIAEKYGKTVAQVILRWLTQKGIVAIPKTVRRERMKENISIFDFELTQEDMEKIATLDEGQSAFFSHRDPEVVKWICSLKR

SEQ ID NO: 10394 - protein, 215 aa, Thermotoga maritima
MLVKDFMTRNPITIAPETSFSEALKLMKQNKIKRLIVMKNEKIVGIVTEKDLLYASPSKATTLNIWELHYLLSKLKIEEIMTKDVVTVNENTPIEDAARIMEEKDISGLPVVDDAGRLVGIITQTDIFKVFVEIFGTKREGTIRYTMEMPDKPGELLEVAKRIYEAGGNIISIATLFEEGKDSYLATLRVENIDHEKFVKSLDEIDVKLLYYHSN

SEQ ID NO: 10395 - protein, 237 aa, Thermotoga maritima
MELGIRDKGVLVLAASRGIGRAVADVLSQEGAEVTICARNEELLKRSGHRYVVCDLRKDLDLLFEKVKEVDILVLNAGGPKAGFFDELTNEDFKEAIDSLFLNMIKIVRNYLPAMKEKGWGRIVAITSFSVISPIENLYTSNSARMALTGFLKTLSFEVAPYGITVNCVAPGWTETERVKELLSEEKKKQVESQIPMRRMAKPEEIASVVAFLCSEKASYLTGQTIVVDGGLSKFPL

SEQ ID NO: 10396 - protein, 331 aa, Thermotoga maritima
MIKNQWYVVLSSRELKKGQLIGVTRFGEKLAFWRDSNGKVHCISDICCHRGASISHGKVLSNGERVMCPFHGFEYDSQGRVRTIPANGRNTPVPENFRVKSYPTYELADFIWIWYGDREPEKPPKYFDDITDELVYTEFKEVWNVHYSRAIENQLDPIHLPFVHYNTIGRGNRTVVDGPIVEWKDDEMFYFYVFNRIDDGTPARKPEEMDPKRKSKVYLEFKFPNIWQNHISEKIRVTAAFTPIDDDHTMIYLRFYVGLTGIKFLDKLIAVLGKPFNKIVLHQDKRVVETQIPKRSELRMGENLIPGDAPILEYRKKREALKSMQQNNRVK

SEQ ID NO: 10397 - protein, 321 aa, Thermotoga maritima
MWFAVLSSNEVRRKPVGVRRLGRDLVFWRDSLGKVYALEDFCVHRRARLSAGKVINDRIQCPFHGFEYDGNGRVRLIPALGKNYKVPDRFRVNSYPVYEKNNIIWLWSGEGEPEKEPKFFDDIDEDFAYAEFRELWNVPFPRAVENQLDVMHLPFVHRTTIGRGNRTLVHGPVVKWIDEDSFIFYVFNEVDRGQRVKRPEELSGEESRVYLEFIFPNLWQNHISEGTRVVAFFVPVDRQKTMIYLRFYVKMTGLKPVDSIIARLSMPLNRIILHQDRRVVETQERDIRKDVLVQGDLPIMEFRKRLYKEKKLIDFLFGGGQ

SEQ ID NO: 10398 - protein, 482 aa, Thermotoga maritima
MKEALTFDDVLLVPQYSEVLPKDVKIDTRLTRQIRINIPLVSAAMDTVTEAALAKALAREGGIGIIHKNLTPDEQARQVSIVKKTENGIIYDPITVTPDMTVKEAIDLMAEYKIGGLPVVDEEGRLVGLLTNRDVRFEKNLSKKIKDLMTPREKLIVAPPDISLEKAKEILHQHRIEKLPLVSKDNKLVGLITIKDIMSVIEHPNAARDEKGRLLVGAAVGTSPETMERVEKLVKAGVDVIVIDTAHGHSRRVIETLEMIKADYPDLPVVAGNVATPEGTEALIKAGADAVKVGVGPGSICTTRVVAGVGVPQLTAVMECSEVARKYDVPIIADGGIRYSGDIVKALAAGAESVMVGSIFAGTEEAPGETILYQGRKYKAYRGMGSLGAMRSGSADRYGQEGENKFVPEGIEGMVPYKGTVKDVVHQLVGGLRSGMGYIGARTIKELQEKAVFVKITPAGVKESHPHDIIITKESPNYWVQA

SEQ ID NO: 10399 - protein, 399 aa, Thermotoga maritima
MNEEQQVLQEQHQEQTQEQTQEQKETLPPQIERRIKKLISLGKKKGYITYEDIDKAFPPDFEGFDTNLIERIHEELEKHGINIVENEPEEEEISASSDEQELEELLEKESPEIHDSSNVRDSIKMYLKEIGKIPLLTPAQERELARRAQMGDKKAKEKLITSNLRLVVSIAKRYMGRGLSFQDLIQEGNIGLLKAVEKFDWRKGYKFSTYATWWIRQAITRAIADQARTIRIPVHMVETINKLNRLRREYYQKHGEEPSIEELAKMMGKPPEKIKEILEAAKETISLESPIGEDEDSSIEDFVADDSIASPKKEAMRMLMREELEKVLKTLSPREAMVLRMRYGLLDGKPKTLEEVGQYFNVTRERIRQIEVKALRKLRHPSRSKYLKSLLSLMDENEG

SEQ ID NO: 10400 - protein, 386 aa, Thermotoga maritima
MDILRKVAEIHGTPTYVYFEETLRKRSRLVKEVFEGVNLLPTFAVKANNNPVLLKILREEGFGMDVVTKGELLAAKLAGVPSHTVVWNGNGKSRDQMEHFLREDVRIVNVDSFEEMEIWRELNPEGVEYFIRVNPEVDAKTHPHISTGLKKHKFGIPLEDLDSFMERFRSMNIRGLHVHIGSQITRVEPFVEAFSKVVRASERYGFEEINIGGGWGINYSGEELDLSSYREKVVPDLKRFKRVIVEIGRYIVAPSGYLLLRVVLVKRRHNKAFVVVDGGMNVLIRPALYSAYHRIFVLGKQGKEMRADVVGPLCESGDVIAYDRELPEVEPGDIIAVENAGAYGYTMSNNYNSTTRPAEVLVRENGRISLIRRRETEMDIFKDVVM

SEQ ID NO: 10401 - protein, 236 aa, Thermotoga maritima
MSELDAREIIEMIAKAKKKTPIVAYIKGDLAGIDFSSFKFFGDERFGILFGEYEDFKKLLEEHREKIEDYHLEVKARNSALPLADLTKYKARIEPGAIIRDMVEIGEGAVIMMGAVINVGAVIGEGTMIDMNAVVGGRAIIGKKCHIGAGAVIAGVIEPPSAKPVVIEDEVLVGANAVILEGVTVGKGAVVAAGAVVTKDVPPYTVVAGVPARVIKQIDEKTKEKTKIVDELRNLE

SEQ ID NO: 10402 - protein, 412 aa, Thermotoga maritima
MSVFLFVIVAVLFVLLFLVFKKRLSEYKILIEKLSDMLGEKGVPPLYLFERLKKYVDNLKETISRVEVSRDNFLTILNSLSEPIFILDREGKITFLNEIARELVQGRINPEGRPYYEIFEDYYINEMVEETIKSEEPQEGTLVTYVGNEKKYFHVKVIPVELKSGDKIFVILFHDVTKERKLDEMRREFIATVSHELRTPLTSIHGYAETLLEDDLENKELVKRFLKIIEEESARMTRLINDLLDLEKIEESEANFEMKDVDLCEVIEYVYRIIQPIAEENEVDLIVECEDVVVRGNKERLIQMLLNLVDNAVKYTSLKEKGEKKVWVRAYDTPDWVVVEVEDTGPGIPKEAQSRIFEKFYRVDKARSRKMGGTGLGLTIVKTIVDKHGGKIEVESEINQGTLMRVLLPKRR

SEQ ID NO: 10403 - protein, 394 aa, Thermotoga maritima
MRIVLGVSSGIAIYKAVDLASKLRKEGHELHVVMTPDATRMISPVVFSAVGNCSVYHDWMDVRNGWIPHTEISRTADVLVVAPATANTISKIANGIADNLLTLVALAFDKDAKILVPTMNYRMYSNKLFQENLEKLKNNGWFVVEPEEGHLACGEVGKGRYPENEKIVEAVHLLTFPKKLAGKKVLITAGPTRERIDAVRFITNASSGKMGYALATVAKRMGARVSLVSGPTSLKPPYYVDEFVKVESAEEMYEEVMKRFEDTDIVIMNAAVGDYRPKKVFEGKLKKTENDLVLHLERTKDILKELGQRKSNQILVGFAAEVENFEENAVKKLREKNLDLLVLNDARKAFSSDRVEVYIYGRDGFIKRIDEDDKIRVACGILDVVSNLAGGSPS

SEQ ID NO: 10404 - protein, 288 aa, Thermotoga maritima
MVKALFSLLFVAFIWGSTFPIQKIVLVGVSPTFYIAVRFFIAALVSYFLFGKGNVKYGSILGTLLGIAYTTQTWGLTITTSTKSGFITSMYIVFVPVFAYLLEREIPTIFQIVSFFAASLGLYMISGGIKDFNFGDFLTLICAVSFALHVVLITMFSKRVKEVDLLFPQFLVVGILNLILNFFWKNWNFTLPALGSAVFTALAATILAIYLQAKYQKALGNNVSAIVFLGEPVFAAVVSYFMLGETMAGKQLLGAALLLISMLFSSLERVKIVRDANQKGRDECEDSL

SEQ ID NO: 10405 - protein, 246 aa, Thermotoga maritima
MRLEGKVCLITGAASGIGKATTLLFAQEGATVIAGDISKENLDSLVKEAEGLPGKVDPYVLNVTDRDQIKEVVEKVVQKYGRIDVLVNNAGITRDALLVRMKEEDWDAVINVNLKGVFNVTQMVVPYMIKQRNGSIVNVSSVVGIYGNPGQTNYAASKAGVIGMTKTWAKELAGRNIRVNAVAPGFIETPMTEKLPEKARETALSRIPLGRFGKPEEVAQVILFLASDESSYVTGQVIGIDGGLVI

SEQ ID NO: 10406 - protein, 274 aa, Thermotoga maritima
MLYKELGRTGEEIPALGLGTWGIGGFETPDYSRDEEMVELLKTAIKMGYTHIDTAEYYGGGHTEELIGKAIKDFRREDLFIVSKVWPTHLRRDDLLRSLENTLKRLDTDYVDLYLIHWPNPEIPLEETLSAMAEGVRQGLIRYIGVSNFDRRLLEEAISKSQEPIVCDQVKYNIEDRDPERDGLLEFCQKNGVTLVAYSPLRRTLLSEKTKRTLEEIAKNHGATIYQIMLAWLLAKPNVVAIPKAGRVEHLRENLKATEIKLSEEEMKLLDSLG

SEQ ID NO: 10407 - protein, 635 aa, Thermotoga maritima
MERFPYEKLPESELKELKELGRLCRGDILKMTYIANSGHPGGSMSSIDLYLTVFKYAKLRPVDDPARDRIVISHGHTSPGVYAAMARLGFVDLDEVLAGFRHPASVFEGHVTRGVGIIDWTTGNLGQGLSAGLGFALASRFTGKDYHVFVLMSDAEQAKGQVAEARRVAKKYGVTNLTVIIDYNDAQISGRARDVMPVNIKENYLADGWRVIEIDGHDYEQIYLALKEAVEDELNPVAIIAKTVMGKGVSFMENEVKYHGKPLNREELEKALAELGIENDVDVYIEKRKQLPVEKHKKVYKTYPIKIDTGEPITYTSPTDNRSAFGKAILDLVKKNVNNPETTPIVAVDCDLKGSVKLDLLDKEFPERLLEVGVQEHNAAAMAGALSAEGVITFFADFGVFGISETYNQHRLNAINGTNLKVVVTHCGLNVGEDGKTHHGLDYVSGPMNWYGFKVIVPGDPNQTDRVVRYAAKEYGNFVIAMGRSKLPIILDENGKPFFGEGYTFEYGKIDVVRKGDDAVIITYGSTLCEAVNAADELKKEGVNVAVLNVSCPVDLDIETLKMVDGKPVLVVEDHNVFTGLGSFLGTTLLENGIIPKKYVRVGVPEFAVSGSYTMLYKLYGLDKDGIISRLREML

SEQ ID NO: 10408 - protein, 608 aa, Thermotoga maritima
MLLDEIKRMSYDELKRLAEDIRKRITEVVLKNGGHLASNLGTIELTLALYRVFDPREDAIIWDTGHQAYTHKILTGRDDLFHTIRTFGGLSGFVTRRESPLDWFGTGHAGTSIAAGLGFEKAFELLGEKRHVVVVIGDGALTSGMALEALNQLKNLNSKMKIILNDNGMSISPNVGGLAYHLSKLRTSPIYLKGKKVLKKVLEKTEIGFEVEEEMKYLRDSLKGMIQGTNFFESLGLKYFGPFDGHNIELLEKVFKRIRDYDYSSVVHVVTKKGKGFTAAEENPTKYHSASPSGKPKMLSYSELLGHTLSRVAREDKKIVAITAAMADGTGLSIFQKEHPDRFFDLGITEQTCVTFGAALGLHGMKPVVAIYSTFLQRAYDQIIHDVALQNAPVLFAIDRSGVVGEDGPTHHGLFDINYLLPVPNMKIISPSSPEEFVNSLYTVLKHLDGPVAIRYPKESFYGEVESLLENMKEIDLGWKILKRGREAAIIATGTILNEVLKIPLDVTVVNALTVKPLDTAVLKEIARDHDLIITVEEAMKIGGFGSFVAQRLQEMGWQGKIVNLGVEDLFVPHGGRKELLSMLGLDSEGLTKTVLTYIKARSREGKV

SEQ ID NO: 10409 - protein, 388 aa, Thermotoga maritima
MMEYWIRRALEVVKTPFLLFDLSVVEKKYLEMKAALKKADIYYAVKANSHPRIISLLARLGSNFDVASKGEIEKLLALGVDGKRMSFGNTIKREEDIAFAYKNGIRLFAVDSEMEVEKVAINAPGSFVFVRVETDGADADWPLSRKFGTNPEHALQLLSYASKMKLIPAGLSFHVGSQNLNPESWKKAIEIAGRVFKKAMRSGLNLFLLNVGGGFPVQHTKPIPSMEEIGKAIEEAIDENLWFVHNLKVIAEPGRYMVGEAGWLVTKVLLKSERSGEKWVYIDAGVFHGLAETIQNFEYEIRVLGKEREELEEYHLAGPTCDSVDVIYDRIFLPKSITLNDLVCFINAGAYTVEYNTRFNGIEPPKMVFIEELTEISIEEKIKTRVLD

SEQ ID NO: 10410 - protein, 311 aa, Thermotoga maritima
MKVALRKTIGERLLELAKQDEKIVVVTSDARGSAAIADFFKVFPERSIEVGIAEQTAAGVAAGLALCGKKAWVFGPACFYSARNLEQIKNDIAYSDANVKIVAVSGGVSYGPLGSTHHALHDVAVMRAIPNLKVLLPSDAVLAAAILEQLLKDEKPVYMRTGRNPVPVIYSRDEKFEVGRAITLKEGNDITIIATGEVVWRALEAAKILEKEGISARVIDMFTVKPLDEEAVFRAARETGRIVTVEEHSIFGGLGGAVAEFLSQNLPTPMKILGIPDEYPVTGTQDEVLKHYGLAPEGIAKTVLEWFKEGN

SEQ ID NO: 10411 - protein, 671 aa, Helicobacter pylori 26695
MKKKANEEKAQKRAKTEAKAEATQENKTKENNKAKESKIKESKIKEAKAKEPIPVKKLSFNEALEELFANSLSDCVSYESIIQISAKVPTLAQIKKIKELCQKYQKKLVSSSEYAKKLNAIDKIKKTEEKQKVLDEELEDGYDFLKEKDFLEWSRSDSPVRMYLREMGDIKLLSKDEEIELSKQIRLGEDIILDAICSVPYLIDFIYAYKDALINRERRVKELFRSFDDDDENSVSDSKKDEDNEEDEENEERKKVVSEKDKKRVEKVQESFKALDKAKKEWLKALEAPIDEREDELVRSLTLAYKRQTLKDRLYDLEPTSKLINELVKTMETTLKSGDGFEKELKRLEYKLPLFNDTLIANHKKILANITNMTKEDIIAQVPEATMVSVYMDLKKLFLTKEASEEGFDLAPNKLKEILEQIKRGKLISDRAKNKMAKSNLRLVVSIAKRFTSRGLPFLDLIQEGNIGLMKAVDKFEHEKGFKFSTYATWWIKQAISRAIADQARTIRIPIHMIDTINRINKVMRKHIQENGKEPDLEVVAEEVGLSLDKVKNVIKVTKEPISLETPVGNDDDGKFGDFVEDKNIVSSIDHIMREDLKAQIESVLDQLNEREKAVIRMRFGLLDDESDRTLEEIGKELNVTRERVRQIESSAIKKLRSPQYGRILRNYLRI

SEQ ID NO: 10412 - protein, 812 aa, Helicobacter pylori 26695
MRYIKFFKELNNKNVNLVGGKNASIGEMFQELVPIGIKVPDGFAITSEAYWYLLEQGGAKQKIIELLENVDATEIDVLKIRSKQIRELIFGTPFPSDLRDEIFQAYEILSQQYHMKEADVAVRSSATAEDLPDASFAGQQDTYLNIKGKTELIHYIKSCLASLFTDRAISYRASRGFDHLKVALSVGVQKMVRADKGSAGVMFSIDTETGFKDAVFITSAWGLGENVVGGTINPDEFYVFKPTLEQNKRPIIKRQLGNKTQKMVYAPRGSEHPTRNIKTTKKEWQSFSLSDEDVLILAKYAIEIEKHYSKEAKQYRPMDIEWAKDGESGEIFIVQARPETVQSQKSKEESQVFEKFKFKNPNEKKEIILQGRAIGSKIGSGKVRIINDLEHMNSFKEGEILVTDNTDPDWEPCMKKASAVITNRGGRTCHAAIVAREIGVPAIVGVSGATDSLYTGMEITVSCAEGEEGYVYAGIYEHEIERVELSNMQETQTKIYINIGNPEKAFGFSQLPNHGVGLARMEMIILNQIKAHPLALVDLHHKKSVKEKNEIENLMAGYANPKDFFVKKIAEGIGMISAAFYPKPVIVRTSDFKSNEYMRMLGGSSYEPNEENPMLGYRGASRYYSESYNEAFSWECEALALVREEMGLTNMKVMIPFLRTIEEGKKVLEILRKNNLESGKNGLEIYIMCELPVNVILADDFLSLFDGFSIGSNDLTQLTLGVDRDSELVSHVFDERNEAMLKMFKKAIEACKRHNKYCGICGQAPSDYPEVTEFLVKEGITSISLNPDSVIPTWNAVAKLEKELKEHGLTEH

SEQ ID NO: 10413 - protein, 426 aa, Helicobacter pylori 26695
MLTIKDIHALEVMDSRGNPTIQASVVLSDNTKASAIVPSGASTGKREALELRDNDKTRFLGKGVLRACENVNSVIKHHLIGLEAINQAFVDERLRALDGTPNYANLGANAVLGVSMALARASAKALNLPLYRYLGGANALTLPVPMLNIINGGTHANNSIDFQEYMIMPLGFESFKEALRASAEVYHTLKKLLDGKNQLTSVGDEGGFAPNFSNNVEPLEVISQAIEKAGYKLGEEIALALDVASSELVDENFNYHLKGENKILDSHELVAYYKELVAKYPIVSIEDGLSEDDWEGWAFLSKELGRQIQLVGDDLFVTNASLLQKGIEKNIANAVLIKPNQIGTISETLETIRLAKHHAYQCVMSHRSGESEDSFIADFAVALNTGEIKTGSTARSERIAKYNRLLEIEHELKGGIYIGKELFKHG

SEQ ID NO: 10414 - protein, 412 aa, Helicobacter pylori 26695
MVQFQNTLIKFHALSFKNANLIYNAKLNKTCYKENSNTIILRIKMLTQEDVLNALKTIIYPNFEKDIVSFGFVKNITLHDDQLGLLIEIPSSSEETSAILRENISKAMQEKGVKALNLDIKTPPKPQAPKPTTKNLAKNIKHVVMISSGKGGVGKSTTSVNLSIALANLNQKVGLLDADVYGPNIPRMMGLQSADVIMDPSGKKLIPLKAFGVSVMSMGLLYDEGQSLIWRGPMLMRAIEQMLSDIIWGDLDVLVVDMPPGTGDAQLTLAQAVPLSAGITVTTPQIVSLDDAKRSLDMFKKLHIPIAGIVENMGSFVCEHCKKESEIFGSNSMSELLEAYHTQILAKLPLEPKVRLGGDRGEPIVISHPNSVSAKIFEKMAQDLSAFLERVKKEKLADNKDIQPTQTHACSH

SEQ ID NO: 10415 - protein, 368 aa, Helicobacter pylori 26695
MVVLGSTGSIGKNALKIAKKFGIEIEALSCGKNIALINEQIQVFKPKKVAILDPSDLNDLEPLGAEVFVGLEGIDAMIEECTSNLVLNAIVGVAGLKASFKSLQRNKKLALANKESLVSAGHLLDISQITPIDSEHFGLWALLQNKTLKPKSLIISASGGAFRDTPLEFIPIQNAQNALKHPNWSMGSKITIDSASMVNKLFEILETYWLFGASLKIDALIERSSIVHALVEFEDNSIIAHLASADMQLPISYAIDPKLASLSASIKPLDLYALSAIKFEPISMERYTLWCYKDLLLENPKLGVVLNASNEVAMEKFLNKEIAFGGLIQTISQALESYDKMPFKLSSLEEVLELDKEVRERFKNVAGV

SEQ ID NO: 10416 - protein, 405 aa, Helicobacter pylori 26695
MFNYEELFQTHKTPFYLYDFDKIKQAFLNYKEAFKGRKSLICYALKANSNLSILSLLAHLESGADCVSIGEIYRALKAGIKPYRIVFSGVGKSGFEIEQALKLNILFLNVESFMELTTIETIAQSLGIKARISIRINPNIDAKTHPYISTGLKENKFGVGEKEALEMFLWAKKSAFLEPVSVHFHIGSQLSDLEPIIEASQKVAKIAKSLIALGIDLRFFDVGGGIGVSYENEETIKLYDYAQGILNSLQGLDLTIICEPGRSIVAESGELITQVLYEKKAQNKRFVVVDAGMNDFLRPSLYHAKHAIRVITPSKGREISPCDVVGPVCESSDTFLKDAHLPELEPGDKLVIEKVGAYGSSMASQYNSRPKLLELALEDHKIRVIRKREALEDLWRLEEEGLKGV

SEQ ID NO: 10417 - protein, 618 aa, Helicobacter pylori 26695
MILQNKTFDLNPNDIAGLELVCQTLRNRILEVVSANGGHLSSSLGAVELIVGMHALFDCQKNPFIFDTSHQAYAHKLLTGRFESFSTLRQFKGLSGFTKPSESAYDYFIAGHSSTSVSIGVGVAKAFCLKQALGMPIALLGDGSISAGIFYEALNELGDRKYPMIMILNDNEMSISTPIGALSKALSQLMKGPFYQSFRSKVKKILSTLPESVNYLASRFEESFKLITPGVFFEELGINYIGPINGHDLSAIIETLKLAKELKEPVLIHAQTLKGKGYKIAEGRYEKWHGVGPFDLDTGLSKKSKSAILSPTEAYSNTLLELAKKDEKIVGVTAAMPSGTGLDKLIDAYPLRFFDVAIAEQHALTSSSAMAKEGFKPFVSIYSTFLQRAYDSIVHDACISSLPIKLAIDRAGIVGEDGETHQGLLDVSYLRSIPNMVIFAPRDNETLKNAVRFANEHDSSPCAFRYPRGSFALKEGVFEPSGFVLGQSELLKKEGEILLIGYGNGVGRAHLVQLALKEKNIECALLDLRFLKPLDPNLSAIVAPYQKLYVFSDNYKLGGVASAILEFLSEQNILKPVKSFEIIDEFIMHGNTALVEKSLGLDTESLTDAILKDLGQER

SEQ ID NO: 10418 - protein, 247 aa, Helicobacter pylori 26695
MQFTGKNVLITGASKGIGAEIAKTLASMGLKVWINYRSNAEVADALKNELEEKGYKAAVIKFDAASESDFIEAIQTIVQSDGGLSYLVNNAGVVRDKLAIKMKTEDFHHVIDNNLTSAFIGCREALKVMSKSRFGSVVNVASIIGERGNMGQTNYSASKGGMIAMSKSFAYEGALRNIRFNSVTPGFIETDMNANLKDELKADYVKNIPLNRLGSAKEVAEAVAFLLSDHSSYITGETLKVNGGLYM

SEQ ID NO: 10419 - protein, 481 aa, Helicobacter pylori 26695
MRILQRALTFEDVLMVPRKSSVLPKDVSLKSRLTKNIRLNIPFISAAMDTVTEHKTAIAMARLGGIGIVHKNMDIQTQVKEITKVKKSESGVINDPIFIHAHRTLADAKVITDNYKISGVPVVDDKGLLIGILTNRDVRFETDLSKKVGDVMTKMPLVTAHVGISLDEASDLMHKHKIEKLPIVDKDNVLKGLITIKDIQKRIEYPEANKDDFGRLRVGAAIGVGQLDRAEMLVKAGVDALVLDSAHGHSANILHTLEEIKKSLVVDVIVGNVVTKEATSDLISAGADAIKVGIGPGSICTTRIVAGVGMPQVSAIDNCVEVASKFDIPVIADGGIRYSGDVAKALALGASSVMIGSLLAGTEESPGDFMIYQGRQYKSYRGMGSIGAMTKGSSDRYFQEGVASEKLVPEGIEGRVPYRGKVSDMIFQLVGGVRSSMGYQGAKNILELYQNAEFVEITSAGLKESHVHGVDITKEAPNYYG

SEQ ID NO: 10420 - protein, 425 aa, Helicobacter pylori 26695
MNFLEDLFYPLRLLENKRVLLLVSGSIAAYKSLELVRLLFKSGASIQVVMSKGAKKFIKPLSFEALSHHKVLHDRNEKWYYNHQNALHHNHIACAANADLLIFAPLSTNSLSKIAHALADNIVSATFLACASPKILAPSMNTNMLNSPITQSNLKRLKDSNHIILDTKNALLACDTKGDGAMAEPLEILFKAAQTLLKDAYFENREVIVMGGASIEKIDSVRTISNLSSGIQASALALALYFKGAKVTLIASNFPTPLPKEITSVLVSDTASYENALNSAANNLQKHALKPLLFNLAAISDYVPKTSFNYKLKKSEIGETLNIECVQNKDLLVSINPNQFVKIGFKAEDNQQNAIKNAQNLLKPFKDNGKDCSVVALNLIKDSRPFGSLENELWLFSHHKTQKIPSMNKLEASFKILDFIKDNAL

SEQ ID NO: 10421 - protein, 327 aa, Helicobacter pylori 26695
MSLKVFDYEDVQLIPNKCIVNSRSECDTTVILGKHAFKMPIVPANMQTIINESIAEFLAENGYFYIMHRFDGAARIPFVKKMKKRQWISSISVGVKKEECLFVEELAKQGLAPDYITIDIAHGHSNSVIEMIQRIKTHLPETFVIAGNVGTPEAVRELENAGADATKVGIGPGKVCITKIKTGFGTGGWQLAALRWCAKAARKPIIADGGIRTHGDIVKSIRFGATMVMIGSLFAGHEESSGETKIENGIAYKEYFGSASEFQKGEKKNIEGKKIWIQHKGSLKDTLVEMHQDLQSSISYAGGRDLEAIRKVDYVIVKNSIFNGDAI

SEQ ID NO: 10422 - protein, 171 aa, Helicobacter pylori 26695
MLDLSYSLERVLQEDPAARNKWEVLLLYPGIHALLCYRLAHALHKRRFYFIARALSQLARFITGIEIHPGAKIGRGLFIDHGMGVVIGETTEIGDDVTIYHGVTLGGTGKFKGKRHPTLGNRVVVGAGAKVLGAICVGDDVKIGANAVVLSDLPTGSTAVGSKAKTITKDR

SEQ ID NO: 10423 - protein, 142 aa, Saccharum officinarum
MAEEKHHHHLFHHKKDEEEQVEQPAGGGGYGEAAEYTETTVTEVVSTGEDEYDKYKKEEKEHKHKQHLGEAGAIAAGAFALYEKHEAKKDPEHAHRHKIEEEVAAAAAVGSGGFAFHEHHEKKKDHKEAEEAGGEKKHHFFG

SEQ ID NO: 10424 - protein, 206 aa, Cryptomeria japonica
MGRGKIEIKRIESTTNRQVTFSKRRSGLFKKAKEISILCASDVAVIVFNSTGRLFDFASSSMKRILERYRNASGRGVWNNEYEQMLSQFRNLKKENEELQKELSCVTGENVETLAPKQLDYLEENLVLAAKKVRERKTEVLKYERRKTESKVIGLQQKQSILMELLAHAENHEEYGFTVSNSEGQTTPPPAFRVQPSQPNLQGSGH

SEQ ID NO: 10425 - protein, 194 aa, Cryptomeria japonica
MGKGKIEIKRIEIKKNRQVTFSKRRSGLFKKAKEISILCAADVAVIVFNSTGRLFDFASSRNASGGKAWNNEYEQMLSQFRNLKNENEELQKELSCVRGEDVEKLARNQLDCLEGNLVLAAKKVQERKTEVLKYEGRKTESKKCSIPKDSLPHSPPLMETQFNEALEALHSLKDYGDDDAQDQNAGDGHRMRKP

SEQ ID NO: 10426 - protein, 355 aa, Chara corallina
LELRDGGKDFMGKGVLKAVSNVNDIIAPALIGKDVTEQTAIDKFMVEDLDGTQNEWGWCKQRLGANAILAVLLAVCKAGAGAKKIPLYQHIANLAGNSKLVLPVPSFNIINGGSHAGNKLAMQEFMILPTGASSFQEAMKIGSEVYHHLKSIIKKKYGQDATNVGDEGGFAPNIQDNKEGLELIKAAIEKAGYTGKVTIGMDVAASEFYSDKTKMYDLDFKTEHNDGSKRITGDQLIQLYESFCSEYPLVSIEDPFDQDDWEHYAKLTALIGEKVQIVGDDLLVTNPKRVAKAIAEKSANALLLKVNQIGSVTESIEAVRMSKKAGWGVMTSHRSGETEDTFIADLAVGLATGQI

SEQ ID NO: 10427 - protein, 355 aa, Nitella opaca
LELRDGGKDFMGKGVLKAVSNVNDVIAPALIGKDPTEQTALDNFMVEELDGTQNEWGWCKQRLGANAILAVSLAVCKAGAGAKKIPLYQHIANLSGNTKLVLPVPSFNIINGGSHAGNKLAMQEFMILPTGASSFKEAMKMGSEVYHHLKSIIKKKYGQDATNVGDEGGFAPNIQDNKEGLELIKAAIEKAGYTGKVTIGMDVAASEFYDEKTKMYDLDFKTENNDGSKRISGDEIIQLYKSFCDEYPLVSIEDPFDQDDWEHYAKFTALIGEKVQIVGDDLLVTNPKRVAKAVAEKSANALLLKVNQIGSVTESIEAVRMSKKAGWGVMTSHRSGETEDTFIADLAVGLATGQI

SEQ ID NO: 10428 - protein, 355 aa, Nitellopsis obtusa
LELRDGGKEFMGKGVLKAVSNVNDIIAPAVIGMDPADQTKIDELMVQQLDGTQYEWGWCKQKLGANAILAVSLAVCKAGAGVLNVPLYQHIANLAHNPNLILPVPSFNIINGGSHAGNKLAMQEFMILPTGASSFKEAMKMGTEVYHNLKSIIKKKYGQDATNVGDEGGFAPNIQDNKEGLELIKEAIAKAGYTGKVTVGMDVAASEFYTEASKTYDLNFKTDNNDGSGKISGQQIIELYQSFCEDYPMVSIEDPFDQDDWEHYAKFTALIGEKVQIVGDDLLVTNPKRVAKAIAEKSCNALLLKVNQIGSVTESIEAVRMAKKAGWGVMTSHRSGETEDSFIADLAVGLATGQI

SEQ ID NO: 10429 - protein, 359 aa, Pycnococcus provasolii
VELRDKDTAPDDYMGKDVLQAVSHVNREITTLHVGKVPTDQKAIDVAMIALDGTENKGRLGANAILTASIAVCKAGAAESGVPLWRHIGKLANNVTFVLPVPAFIIINGGSHAGNRLAFQEYMILPTGASSLTEAMKMGSEVYHKLKDIIKAKYGQDSVNVGDEGGFAPSLENNEEGLKLIVEAIEVAGYTGKVKIGMDVAASEFLVPAASEIAIYKYDLDFKAPEGAAKDEKLAAMPGDELRALYASFVQNYPVISIEDPFDQDDAENTTALTADDLCQIVGDDLLVTNPKRVQRAIDGKWCNALLLKVNQIGSVSEAIEAVGMSKNAGWGVMTSHRSGETEDSFIADLAVGLATGQI

SEQ ID NO: 10430 - protein, 348 aa, Pycnococcus provasolii
VELRDGDKSMWMGKGCSKAVANLNDIIAPALVGKDPTQQKAIDDLMNKELDGTENKGKLGANAILAVSMAVCKAGAAEKDIPLYKYIAELAGNTKLILPVPAFNIINGGSHAGNKLAMQEFMTLPTGATSFTEAMKMGTEVYHNLKSVIKEKYGQDACNVGDEGDFAPNIESNKEGLDLVNQAIEKADSTGKVKIGMDVASSEFYTEDKMYDLDFKTKDNDGSQKKTGEEMLEMYKSFCSEYPVISIEDPYDQDDFENTAALTAEGVCQVVGDDLLVTNPTRVASAIEGKTCNALLLKVNQIGSISEAIEAVRMSKEAGWGVMTSHRSGETEDSFIADLAVGLATGQI

SEQ ID NO: 10431 - protein, 352 aa, Bigelowiella natans
LELRDGGDVYMGKGVSKAVSNVNEVIGPALIGMDPTDQQKIDDKMVKELDGSKNEWGWSKSDLGANAILGVSIAVCRAGAQASNTPLYEHIQKLAGNSELVMPVPSFNIINGGSHAGNALAMQEFMILPTGADNFTQAMQMGCEVYHNLKTVIKKRYGQDAVNVGDEGGFAPPLKGSDEGLSLIKEAIEISGYTGKVKFGMDVAASEFLTKDGNYDLNFKNQPNDGSDVVSGDGLLDIYGGFVSDYPMVSIEDPYDQDDWEHWAKATAKYGKECQIVGDDLLVTNPKRIEVAIEKKACNALLLKINQIGSITESIEAVSMAKQAGWGIMTSHRSGETEDPFIADLAVGLATG

SEQ ID NO: 10432 - protein, 375 aa, Mastocarpus papillatus
VATAGGKFSAMVPSGASTGIYEALELRDGDKSSYLGKGVDKAVANVKDKISEAIMGMDASDQGAVDAKMIELDGTEGGFKKNLGANAILGVSMAVARAGANAKGVPLYKHLNNLAGNPKMLLPVPSLNVINGGTHAGNKLAMQEFMILPVGASTFREAMKMGAETYQYLKKVIKKKYGLDATSVGDEGGFAPNIQDNTEGLKLLEEAIEMAGYTGKIKVGMDVAASEFWKEDKEVYDLDFKNDDNDGSQCLTGEKLGEMYKDFISNFPMISIEDPFDQDDWESYAKLTAAVGEGVQIVGDDLLVTNPNRIQTGIDKKACNALLLKVNQIGSITEAIQASKMSRDAGWGVMVSHRSGETEDNFIADLCVGLGTAQI

SEQ ID NO: 10433 - protein, 373 aa, Mastocarpus papillatus
VETDDGKFRAMVPSGGSTGIHEAHEMRDGDENKFSGKGVLKAIKNVNNEIAVTVIGMDPTDQEGIDQALADLDGQPDKSRLGANAILGVSMAVTRAGAAKKGIPLYKHINNLAGNPTPILPVPSFNVLNGGSHAGNPLAMQEFMILPTGAESFKEAMQVGVEVYHKLKSVIKQKYGQSSTSVGDEGGFAPNIKDSEEALELIQTAVKEAGHSDIVQIGMDVAASEFYNKETKKYNLNFKNPAGSTNPAGMKSADELLRMYKLFAANYGVISIEDPFDQDDFTSFEKMTGELNELIQIVGDDLLVTNPERIERAIERNACNALLLKLNQIGTVTEAIEANNLARNAGFGVMVSHRSGETEDSFIAALCAGLGTG

SEQ ID NO: 10434 - protein, 375 aa, Prionitis lanceolata
VTTADGKFSAMVPSGASTGIYEALELRDGDKSAYLGKGVDKAVANVKDKIAPAISGMDAADQAAVDKKMIELDGTEGGFKKNLGANAILGVSMAVARAGAAAKRVPLYKHLNDLAGSPKMLLPVPSLNVINGGSHAGNKLAMQEFMILPVGATSFREAMKMGAETYQYLKKVIKKKYGLDATSVGDEGGFAPNIQDNTEGLRLLEEAIEMAGYTGKIKVGMDVAASEFWKDDTKMYDLDFKNPDNDGSQCLSGEKLGELYKEFVAKFPMISIEDPFDQDDWESYAKLTEAVGESVQIVGDDLLVTNPDRIRTGIEKKACNALLLKVNQIGSVTEATQASQISRDAGWGVMVSHRSGETEDTFIADLCVGLGTAQI

SEQ ID NO: 10435 - protein, 377 aa, Prionitis lanceolata
VETDDGNFRAMVPSGASTGIYEAHELRDGDPKVFNGKGVLKAIDNVNNELAVAVTDMDPTDQGGIDQALVDCDGSSDSSKSRLGANAILGVSMAVARAGAAKKGIPLYKHINNLAGNPTLMLPVPCFNVINGGSHAGNGLAFQEFMILPTGAETFKEAMRIGVEVYHKLKRTLEESYGKASTAVGDEGGFAPDIHDNEQALKLVQSAVKESGYEGVIQIGLDVAASEFYDKESGRYNLSLKTKVNGAAAGQLRSASELLHTYKLYAANYGVTSIEDPFDQDDFPSFESMTAELGEVIQIVGDDLLATNPNRIETAVERSACNALLLKLNQIGTVTEAIEANNTARDAGFGVMVSHRSGETEDPFIAALCVGLGTGQI

SEQ ID NO: 10436 - protein, 142 aa, Prionitis lanceolata
LTTDLGLFRAAVPSGASTGAYEALELRDGDKSRYNGKGVLKAISNVNELIAPAVAGADVIDQAAFDAIMLELDGTENKAKLGANAILGVSMAACMAGAAAKGIPLYRHISEIAGKGSDPVIMPVPVMNVINGGSHAGNKLAM

SEQ ID NO: 10437 - protein, 356 aa, Paramecium multimicronucleatum
LELRDGDKSRYLGKGVSKAVANVNEVIRPALVGKNVTEQTKLDKSIVEQLDGSKNKYGWCKSKLGANAILAVSLSLARAGAAEQNVPLYQYLAQLAGKRTDKFVTPVPSLNVINGGKHAGNKLAMQEFMILPTGAHSFKEAIQIGCEVYHSLKSVIKSKYGLDATNVGDEGGFAPSIQDPNEALQLLEDAIKKAGHTGKVDIGMDVAASEFFENNKYDLDFKNPKNDGSQKLTAQQLTDLYLKFVTSHPIVSIEDPFDQDDWDGYAQFTAKIGSKVQIVGDDLLVTNPTRVQEAINRKACNALLLKVNQIGSLTESIEASNLSQKNGFGVMVSHRSGETEDNFIADLVVGLGTGQI

SEQ ID NO: 10438 - protein, 379 aa, Paramecium tetraurelia
VITSKGVFRSAVPSGASTGIYEALELRDGDKSRYLGKGVAKAVANVNEVIRPALVGKNVTEQTKLDKSIVEQLDGSKNKYGWSKSKLGANAILAVSLSLARAGAAEQNVPLYQYLAQLAGKRTDKFVTPVPSLNVINGGKHAGNKLAMQEFMILPTGAKSFKDAIQIGCEVYHSLKSVIKSKYGLDATNVGDEGGFAPSIQDPNEALQLLEDAIKKAGHTGKVDIGMDVAASEFFEKNTYDLDFKNAKNDGSKKLTAQQLTELYLKFVSSHPIVSIEDPFDQDDWEGYTQFTAKIGQKVQIVGDDLLVTNPIRVQEAINRKACNALLLKVNQIGSLTESIEASNLSQKNGFGVMVSHRSGETEDNFIADLVVGLGTGQI

SEQ ID NO: 10439 - protein, 384 aa, Colpidium aqueous
LTTSNGQVFRAAVPSGASTGIYEACELRDEDKTKYLGKGVLKAVNNVNTVIKPALVGLSVVNQTEIDNLMVQQLDGTKNEWGWCKSKLGANAILAVSMAVARAGAAFKGLPLYKYLGVLNGGSADQATYNLPLPFFNVINGGKHAGNKLAFQEFMFTPSGAANFEEALRIAAEVYHTLKKVIEKKYGQTATNVGDEGGFAPDTSSPDEGLELLSEAIKKSGHEGKVQISMDVAASEFYDPKEKIYDLDFKNSASDGKHRFTSDQLVEYFANLSTKYPIFSIEDPFDQDDWAAYAKLTALVGDKVKIVGDDLLVTNPLRSAKAIEEKACNYLLLKVNQIGTVTESIQTFNIVSKAGFGTMVSHRSGETEDTFIADLAVGIGAASI

SEQ ID NO: 10440 - protein, 383 aa, Tetrahymena thermophila
LTVDNGQVFRAAVPSGASTGIYEACELRDGDNHRYLGKGVLKAVNNVNTIIKPHLIGKNVTEQEQLDKLMVEQLDGTKNEWGWCKSKLGANAILAVSMAVARAAAAHKNLPLYKYLSHLNGQDNLTQFNLPLPFFNVINGGKHAGNKLAFQEFMFTPCGASNFAEGLRMGAEVYHNLKKVIEKKYGQTATNVGDEGGFAPDTSNPDEALELLVEAIKKAGHEGKIKISMDVAASEFYDAKTKLYDLDFKNSNSDGKHKLTSEQLVEYFANLVSKYPIFSIEDPFDQDDWAAYAQLTARIGNQVKIVGDDLLVTNPLRAEKAIQEKACNYLLLKVNQIGTVTEAIQTYQIVSKANFGTMVSHRSGETEDTFIADLVVGIGAATI

SEQ ID NO: 10441 - protein, 383 aa, Tetrahymena bergeri
LTVDNGQVFRAAVPSGASTGIYEACELRDGDNHRYLGKGVLKAVNNVNTVIRTALLGKDVTHQEEIDKLMVEQLDGTKNQWGWCKSKLGANAILAVSMAVARAAAAHKHLPLYKYLSILNGKNNQTDFNLPLPFFNVINGGKHAGNKLAFQEFMFTPSGATNFAEALRMGAEVYHNLKKVIEKKYGQTATNVGDEGGFAPDTSNPDEGLDLLVEAIKKAGHEGKVQISMDVAASEFYNSETKIYDLDFKNSASDGKHKFTSDQLVEYFANLASKYPIFSIEDPFDQDDWSAYAKLTARIGDKVKIVGDDLLVTNPLRAQKAIEEKACNYLLLKVNQIGTVTEAIQTYQIVSKAKFGTMVSHRSGETEDTFIADLVVGIGAATI

SEQ ID NO: 10442 - protein, 347 aa, Rhodomonas salina
CELRDGDDKRYLGKGVLKAVENVKSVIAPALAGMNPVEQDAVDNKMIQELDGTPNKTKLGANAILAVSLACCKAGAAQKGVPLYKHIADLAGTKKICLPVPWMNVINGGSHAGNRLAMQEFMIGPVGAKTFKEAMQMGCEVYHTLKKVIKKKYGQDACNVGDEGGFAPNIQANDEGLKLLTEAIEMAGFTGKIKIGMDVAASEFCKDKKYDLDFKNDASKPEDYLSPDALTDMYKGFCKDFPVVTIEDPFDQDDWEAYTKMTGEMECQIVGDDLLVTNPTRITTALEKKACNALLLKVNQIGSVSESIKAAKMSMDSNWGVMCSHRSGETEDCFIADLVVGLGTGQI

SEQ ID NO: 10443 - protein, 347 aa, Guillardia theta
CELRDGDKSRYLGKGVSKAVKNVEEKIAPAIKGMDPTDQEGIDKKMIEVDGTPNKTNLGANAILAVSLAVAKAGAAQKGVPLYQHFADMAGVKKYVLPVPWMNVINGGSHAGNRLAMQEFMIGATGATSFKEAVRMSCEVYHALKAVIKKKYGMDACNVGDEGGFAPNIQDNKEGLSLLTEAIANAGYTGKIKIGMDVAASEFYQDGKYNLDFKNANADPSMVVSGDELIEVYKSFTQDFPVVTIEDPFDQDDWEHYNKFNSQMPHTQIVGDDLLVTNPNRITMAIEKKACSGLLLKVNQIGTVSESIKACKMSQEQGWGVMRSHRSGETEDTTIADLVVGLATGQI

SEQ ID NO: 10444 - protein, 122 aa, Bigelowiella natans
LELRDGGDVYMGKGVSKAVSNVNEVIGPALIGMDPTDQQKIDDKMVKELDGSKNEWGWSKSDLGANAILGVSIAVCRAGAQASNTPLYEHIQKLAGNSELVMPVPSFNIINGGSHAGNALAM

SEQ ID NO: 10445 - protein, 347 aa, Pedinomonas minor
LELRDGDKTHYMGKSVEKAVDNINKLISPALVGMNPVNQREIDNAMMKLDGTDNKGKLGANAILAVSMAVCKAGAAEKGVPLYKHIADVAGVKKLVLPVPAFNIINGGMHAGNNMPMQEFMVLPTGAKSFKEAMKMGCEVYHTLRTLIKKKYGQDACNVGDEGGFAPNVASAEEALKMVDQAINDAGYKGKVTIGMDVAASEFYTQDKCYDLGFKMKNNDGSLKMTGKQMQELYAKFCKEFPIISIEDPFEQDDFANWTEITAANSCQIVGDDHLVTNPKRVKQAIEAKSSNALLLKVNQIGTISESIDAVRMSKEAGWGVMTSHRSGETEDSFIADLAVGLATGQI

SEQ ID NO: 10446 - protein, 140 aa, Scenedesmus rubescens
VTTYKGTFRAAVPSGASTGIHEAVELRDGDKSQWMGKGVAKAVGNVNNDIAPALLGKDPTQQKEIDDAMIALDGTENKGKLGANAILAVSMAVAKAGAAEKGVPLYKYIAQLAGNSKLVLPVPSFNVINGGEHAGNGLAM

SEQ ID NO: 10447 - protein, 118 aa, Nephroselmis olivacea
VELRGGDKAKWMGKGVLKAVENLNSKIAPALIGKDPRNQRELDDLMNSLDGTENKGNFGANAILAVSMAACKAGAAEKGVPLYQHIADLAGNKKLILPVPAFNVINGGSHAGNKLAMQ

SEQ ID NO: 10448 - protein, 396 aa, Methanocaldococcus jannaschii
MRNMQEKGVSEKEILEELKKYRSLDLKYEDGNIFGSMCSNVLPITRKIVDIFLETNLGDPGLFKGTKLLEEKAVALLGSLLNNKDAYGHIVSGGTEANLMALRCIKNIWREKRRKGLSKNEHPKIIVPITAHFSFEKGREMMDLEYIYAPIKEDYTIDEKFVKDAVEDYDVDGIIGIAGTTELGTIDNIEELSKIAKENNIYIHVDAAFGGLVIPFLDDKYKKKGVNYKFDFSLGVDSITIDPHKMGHCPIPSGGILFKDIGYKRYLDVDAPYLTETRQATILGTRVGFGGACTYAVLRYLGREGQRKIVNECMENTLYLYKKLKENNFKPVIEPILNIVAIEDEDYKEVCKKLRDRGIYVSVCNCVKALRIVVMPHIKREHIDNFIEILNSIKRD

SEQ ID NO: 10449 - protein, 112 aa, Methanocaldococcus jannaschii
MKKVEAIIRPEKLEIVKKALSDAGYVGMTVSEVKGRGVQGGIVERYRGREYIVDLIPKVKIELVVKEEDVDNVIDIICENARTGNPGDGKIFVIPVERVVRVRTKEEGKEAL

SEQ ID NO: 10450 - protein, 427 aa, Methanocaldococcus jannaschii
MLYNMDERFEIKDIVAREVIDSRGNPTVEVEVITKGNGYGSAIVPSGASTGTHEALELRDKEKRFGGKGVLMAVENVNSIIRPEILGYDARMQREIDTIMIELDGTPNKSRLGANAILAVSLAVAKAAAATAKIPLYKYLGGFNSYVMPVPMMNVINGGKHAGNDLDLQEFMIMPVGATSISEAVRMGSEVYHVLKNVILEKYGKNAVNVGDEGGFAPPLKTSREALDLLTESVKKAGYEDEVVFALDAAASEFYKDGYYYVEGKKLTREELLDYYKALVDEYPIVSIEDPFHEEDFEGFAMITKELDIQIVGDDLFVTNVERLRKGIEMKAANALLLKVNQIGTLSEAVDAAQLAFRNGYGVVVSHRSGETEDTTIADLSVALNSGQIKTGAPARGERTAKYNQLIRIEQELGLSKYAGRNFRCPF

SEQ ID NO: 10451 - protein, 290 aa, Methanocaldococcus jannaschii
MAECDGKCDTCPSKNTCPDTKKLLAQQDAKIRENMSKIKHKIVILSGKGGVGKSTVTVNLAAALNLMGKKVGVLDADIHGPNIPKMLGVENTQPMAGPAGIFPIVTKDGIKTMSIGYLLPDDKTPVIWRGPKVSGAIRQFLSDVVWGELDYLLIDTPPGTGDEQLTIMQSIPDIDGAIIVTTPEEVSVLDVKKSIMMAKMLNIPIIGIIENMSGFVCPYCNKVVDIFGRGGGEKAAKELGVEFLGRIPLDIKAREASDKGIPMVLLDCKASEEFKKIVKRIVEKVEGKKE

SEQ ID NO: 10452 - protein, 195 aa, Methanocaldococcus jannaschii
MATGPTYRVKFRRRREAKTDYRKRLKLLLSRKPRLVARRTLNHCIAQIVLYDEKGDKTVVSAHSRELIKLGYKGHTGNLPSAYLTGYLLGKKALAKGYTEAVLDIGLHRATKGNAIFAILKGALDAGMEIPHGEEILPSEERIRGEHIKAYAEMLKEQDEERYKKQFSKYLEKGLEPEKLPEHFEEIKAKIDSMF

SEQ ID NO: 10453 - protein, 338 aa, Methanocaldococcus jannaschii
METKVKAHVAPWKIEEVKTLKGLIKSKPVVAIVDMMDVPAPQLQEIRDKIRDKVKLRMSRNTLIIRALKEAAEELNNPKLAELANYVERGAAILVTDMNPFKLYKLLEENKSPAPVRGGQIAPCDIKVEKGSTGMPPGPFLGELKSVGIPAAIEKGKIAIKEDKVVVKKGEVVSPKLAAVLDRLGIKPIKVGLNILAVYEDGIIYTPDVLKVDEEKLLADIQAAYQNAFNLAFNTAYPAKEVLPFLIQKAFINARALSVETAFVTKETAGDILAKAQAQALALASKLPDEALDEDIKAKLSSVEVSAAPAAEEEKEEEKKEEEKKEEDTGAAGLALLF

SEQ ID NO: 10454 - protein, 1188 aa, Methanocaldococcus jannaschii
MLIIQNTKGDSMKFIAWLDELSNKDVDIAGGKGASLGEMWNAGLPVPPAFVVTADAYRHFIKETGLMDKIREILSGLDVNDTDALTNASKKIRKLIEEAEMPEDLRLAIIEAYNKLCEMCGEDEVTVAVRSSATAEDLPEASFAGQQDTYLNIKGAENVVKYVQKCFSSLFTPRAIFYREQQGFDHFKVALAAVVQKLVNAEKAGVMFTVNPISENYDELVIEAAWGLGEGVVSGSVSPDTYIVNKKTLEIVDKHIARKETMFVKDEKGETKVVEVPDDMKEKQVLSDDEIKELAKIGLNIEKHYGKPMDVEWAYEKGKFYMLQARPITTLKKGKKEKKAKEEDIEAKILLKGIGASPGIATGVVKIIHDVSEIDKVKEGDILVTEMTTPDMVPAMKKAAAIVTDEGGLTCIEGDAKILTDRGFLKMKEVYKLVKNGEKLKVLGLNAETLKTEWKEIIDAQKREARRYEIGVYRKNKNTKDTIKITPDHKFPVFVNGELSKVQLCDIIDNNLSVLSIDYIPMIEEKYESLAEVMYLGGAVLSDGHIVRRNGKPIRVRFTQKDTEEKKDFIEKVKGDVKLIGGNFIEISNRNNVIEYQTSRKIPSEILGFIEVNINTIPLYATKDEIADLIAGFVDGDGCLSGKRRVEIYQNSSHIKKIEGLIVGLYRLGIIPRLRYKRSSTATIYFNNNLETILQRTRRIKLDKLKEFKKPVEDKKLIDISQILPELKEFDYKGYLYKTYKEKLFIGINKLEEYLSKIDKDGIERIKQKIKLLKESDIYSIRIKKVGEDYGEVYNITVKAENEFNHNYVVWTKHYTPIVVFNCHAAIVSRELGTPCVVGTKKATKVLKDGMIVTVDGEKGIVYEGEIKKVEEKEKKQEVVVQQAPIITATEVKVNVSMPEVAERAAATGADGVGLLRAEHMILGLGKHPRKILEEEGEEALIEALMEGIRKVADAFYPRPVTYRTLDAPTDEFRGLEGGENEPIEHNPMLGWRGIRRDLDEVDILKCELKAIKRLREEGYKNIEIMIPLVTHPDEVRRVKEIMREVGLEPCKDIPFGIMVETPAAALIIEDFIKEGINFVSLGTNDLTQYTIAIDRNNELVSKYYKEDHPAVLKLVEHVIKTCKKHGIKTSICGQAGSRPHIVEKLVEWGIDSVSANIDAVETIRRVVARTEQKVILNYIRKSYVERE

SEQ ID NO: 10455 - protein, 316 aa, Methanocaldococcus jannaschii
MVKLSGVYKGMRKGYGETLIELGKKYENLVVLDADLSGSTQTAMFAKEFPERFFNAGVAEQNMIGMAAGLATTGKIVFASSFSMFASGRAWEIIRNLVAYPKLNVKIVATHAGITVGEDGASHQMCEDIAIMRAIPNMVVIAPTDYYHTKNVIRTIAEYKGPVYVRMPRRDTEIIYENEEEATFEIGKGKILVDGEDLTIIATGEEVPEALRAGEILKENGISAEIVEMATIKPIDEEIIKKSKDFVVTVEDHSIIGGLGGAVAEVIASNGLNKKLLRIGINDVFGRSGKADELLKYYGLDGESIAKRIMEEMKKE

SEQ ID NO: 10456 - protein, 438 aa, Methanocaldococcus jannaschii
MKIMFLGNDTVEIKDGRFFIDGYDAIELAEKFGTPLYVMSEEQIKINYNRYIEAFKRWEEETGKEFIVAYAYKANANLAITRLLAKLGCGADVVSGGELYIAKLSNVPSKKIVFNGNCKTKEEIIMGIEANIRAFNVDSISELILINETAKELGETANVAFRINPNVNPKTHPKISTGLKKNKFGLDVESGIAMKAIKMALEMEYVNVVGVHCHIGSQLTDISPFIEETRKVMDFVVELKEEGIEIEDVNLGGGLGIPYYKDKQIPTQKDLADAIINTMLKYKDKVEMPNLILEPGRSLVATAGYLLGKVHHIKETPVTKWVMIDAGMNDMMRPAMYEAYHHIINCKVKNEKEVVSIAGGLCESSDVFGRDRELDKVEVGDVLAIFDVGAYGISMANNYNARGRPRMVLTSKKGVFLIRERETYADLIAKDIVPPHLL

SEQ ID NO: 10457 - protein, 112 aa, Methanocaldococcus jannaschii
MKKVEAIIRPEKLEIVKKALSDAGYVGMTVSEVKGRGVQGGIVERYRGREYIVDLIPKVKIELVVKEEDVDNVIDIICENARTGNPGDGKIFVIPVERVVRVRTKEEGRDVL

SEQ ID NO: 10458 - protein, 415 aa, Methanocaldococcus jannaschii
MYEVRDINLWKEGERKIQWAKQHMPVLNLIRERFKEEKPFKGITIGMALHLEAKTAVLAETLMEGGAEIAITGCNPLSTQDDVAAACAKKGMHVYAWRGETVEEYYENLNKVLDHKPDIVIDDGCDLIFLLHTKRTELLDNIMGGCEETTTGIIRLKAMEKEGALKFPVMDVNDAYTKHLFDNRYGTGQSALDGILRATNLLIAGKTVVVAGYGWCGRGVAMRAKGLGAEVVVTEVNPIRALEARMDGFRVMKMEKAAEIGDIFITTTGCKDVIRKEHILKMRNGAILANAGHFDNEINKKHLEELAKSIKEVRNCVTEYDLGNKKIYLLGEGRLVNLACADGHPCEVMDMSFANQALAAEYILKNHEKLEPRVYNIPYEQDLMIASLKLKAMGIEIDELTKEQKKYLEDWREGT

SEQ ID NO: 10459 - protein, 463 aa, Methanocaldococcus jannaschii
MFIDGKWINREDMDVINPYSLEVIKKIPALSREEAKEAIDTAEKYKEVMKNLPITKRYNILMNIAKQIKEKKEELAKILAIDAGKPIKQARVEVERSIGTFKLAAFYVKEHRDEVIPSDDRLIFTRREPVGIVGAITPFNFPLNLSAHKIAPAIATGNVIVHHPSSKAPLVCIELAKIIENALKKYNVPLGVYNLLTGAGEVVGDEIVVNEKVNMISFTGSSKVGELITKKAGFKKIALELGGVNPNIVLKDADLNKAVNALIKGSFIYAGQVCISVGMILVDESIADKFIEMFVNKAKVLNVGNPLDEKTDVGPLISVEHAEWVEKVVEKAIDEGGKLLLGGKRDKALFYPTILEVDRDNILCKTETFAPVIPIIRTNEEEMIDIANSTEYGLHSAIFTNDINKSLKFAENLEFGGVVINDSSLFRQDNMPFGGVKKSGLGREGVKYAMEEMSNIKTIIISK

SEQ ID NO: 10460 - protein, 496 aa, Methanocaldococcus jannaschii
MFLKKLIEAKKAYTFDDVLLVPNASWVEPKDTDVSTDLAGLKLNIPIVSAAMDTVTEKEMAIALARLGGLGVIHRNMSIEEQVHQVQAVKKADEVVIKDVITVSPDDTVGEAINVMETYSISGLPVVDNEDKLVGIITHRDVKAIEDKTKKVKDVMTKDVVCAKEDVEEEEALELMYANRVERLPIVDDENRLIGIITLRDILKRRKYPQAARDKKGRLLVAAACGPHDFERAKALIEAEVDAIAIDCAHAHNMRVVENVKKFKEMLEGTDIKLIVGNIATKEAAEDLIKAGADVLKVGIGPGSICTTRVVAGVGVPQLTAVAEVADVAKEHNVPIIADGGIRYSGDIAKAIAAGADAVMLGSLLAGTDEAPGQLMVINGRKYKQYRGMGSLGAMTGGVGAGADRYFQAPAKSHMKHVKLVPEGVEGAVPYKGPVSEVVFQLIGGLRASMGYCGAKNLKEMQEKARFVIITPSGQVESHPHDIIITNEAPNYPLGK

SEQ ID NO: 10461 - protein, 326 aa, Lactococcus lactis subsp. lactis
MAVKTYIAAITEALDLALEKDKDALIFGEDVGQNGGVFRATDGLQAKYGEERVFNTPLAESGIGGMAIGLATQGFHPIMEIQFGTFIFEVFDSIAGQMSRTRYRFNNTRSNNIVVRTPYGIGTKTPEMHADSIEGLFSQIPGIRVVMPSNPADAKGLLLASIENNDPVIFLENLHLYRSLKGEVPEGYYTTPLDTAAVAKEGSDVSIIAYGGTVPLALKAAEQLEKDGIKAEVLDLRTVAPLDIESIGKTVEKTGRVVVVQEAQRTAGIAANVMAEISERFVLNLKAPIGRVSGPDSIFPFAQAENDWAVKAEDIVNKVKEVVDYD

SEQ ID NO: 10462 - protein, 575 aa, Lactococcus lactis subsp. lactis
MTTMLKGIAASSGVAVAKAYLLVQPDLSFETKTIADTANEEARLDAALATSQSELQLIKDKAVTTLGEEAASVFDAHMMVLADPDMTAQIKAVINDKKVNAESALKEVTDMFIGIFEGMTDNAYMQERAADIKDVTKRVLAHLLGVKLPSPALIDEEVIIVAEDLTPSDTAQLDKKFVKAFVTNIGGRTSHSAIMARTLEIPAVLGTNNITELVSEGQLLAVSGLTGEVILDPSTEQQSEFHKAGEAYAAQKAEWAALKDAETVTADGRHYELAANIGTPKDVEGVNDNGAEAIGLYRTEFLYMDAQDFPTEDDQYEAYKAVLEGMNGKPVVVRTMDIGGDKTLPYFDLPKEMNPFLGWRALRISLSTAGDGMFRTQLRALLRASVHGQLRIMFPMVALVTEFRAAKKIYDEEKAKLIAEGVPVADGIEVGIMIEIPAAAMLADQFAKEVDFFSIGTNDLIQYTMAADRMNEQVSYLYQPYNPSILRLINNVIKAAHAEGKWAGMCGEMAGDQTAVPLLMGMGLDEFSMSATSVLQTRSLMKRLDSKKMEELSSKALSECATMEEVIALVEEYTK

SEQ ID NO: 10463 - protein, 493 aa, Lactococcus lactis subsp. lactis
MSNWETKFLKKGFTFDDVLLIPAESHVLPNEVSMKTKLAKNLTLNIPIISAAMDTVTDSKMAISMARQGGLGVVHKNMSVEEQAEEIHKVKRSESGVITDPFFLTPNHKIEEAENLMATYRISGVPIVDTLENRKLVGIITNRDLRFITDYNQQIKNMMTSENLITAPVGTTLDTAARILQEHKIEKLPLVDEAGKLAGLITIKDIERVIEFPNAAKDEQGRLLVAGAVGVSSDTFERAEALFAAGADAIVIDTAHGHSAGVLRKIREIRNHFPDRTLIAGNIATGEGARALFEAGVDVVKVGIGPGSICTTRVVAGVGVPQITAIYDAANVAREFGKTIIADGGIKYSGDIVKALAAGGDAVMLGSMLAGTDESPGEFEIFQGRKFKTYRGMGSLAAMKKGSKDRYFQGAVNEANKLVPEGIEGRVAYKGTATDIVFQMLGGLKAGMGYTGAADITALHDSAQFIEMSGAGLKESHPHDVQITKEAPNYSVQ

SEQ ID NO: 10464 - protein, 281 aa, Lactococcus lactis subsp. lactis
MTLTDTYTLNNGIKIPKVGFGTWQSASGEEAYNAVKAALEAGYRHIDTAAVYKNEESVGQAIADSGIPREELFVTTKLWGVGTTEDAAKALDESLKKLGLDYVDLYLIHWPNPKAFRPDFETRNLAVWKAMEAGVKAGKIRAIGVSNFHPRHLKPLLKFAEIKPAVNQIMVNPSDQQEEIVSFNVDNNILTEAYSPLGTGKIFEVPELADLASKYNKSIAQVVLRWSLHKGYLPLPKSVTPARIKENAEIFDFDLSIEDIAFIDSLHGKAGLAKNPDEVDF

SEQ ID NO: 10465 - protein, 422 aa, Lactococcus lactis subsp. lactis [sequence omitted]

SEQ ID NO: 10466 - protein, 256 aa, Lactococcus lactis subsp. lactis
MEAQKLSAQEIIQFIGNAEKKTRVKVTLSGMPSFKAAGFLAENGRPNFKALANKGIQVLGDFHTHYSLKIIIGDWQAVRPLLSGLTENKDYTLELEGRNSAVPLLDTREINARIEPGAIIRDQVTIGDSAVIMMGAIINIGAEIGEGTMIDMGAILGGRATVGKNSHIGAGAVLAGVIEPASAEPVRVGDNVLVGANAVVIEGVQVGSGSVVAAGAIVTQDVPENVVVAGVPARIIKEIDEKTQQKTALEDALRNL

SEQ ID NO: 10467 - protein, 272 aa, Lactococcus lactis subsp. lactis
MKLNNQIEIPELGLGVFQIPNDETADVVKNAIVNGYRLIDTAKIYENEEGTGQGIKEGLAMTGLSRDDLFITSKLWGDNHSYEETVQNFEKSLKKLDLDYLDLYLIHWPGTHYAYKEAWNAMEDLYKAGKIKAIGVSNFQKSHLEELLSYAKITPVLNQIELHPKLSQEELRNFLELHDIKVQAWSPLMQGQLLDNEVLKKIADKHGKSVAQIILRWDIQQDILVNVKSIKSERMIANRQIFDFSLDSEDMKAINSLNEELRVGPDPEHFNF

SEQ ID NO: 10468 - protein, 221 aa, Lactococcus lactis subsp. lactis
MFKAVLFDLDGVITDTAEYHFRAWKALAEEIGINGVDRQFNEQLKGVSREDSLQKILDLADKKVSAEEFKELAKRKNDNYVKMIQDVSPADVYPGILQLLKDLRSNKIKIALASASKNGPFLLEKMNLTGYFDAIADPAEVAASKPAPDIFIAAAHAVGVAPSESIGLEDSQAGIQAIKDSGALPIGVGRPEDLGDDIVIVPDTSYYTLEFLKEVWLQKQK

SEQ ID NO: 10469 - protein, 447 aa, Lactococcus lactis subsp. lactis
MAANKKRISQISKETGVQNRVLVEKAQEIGLLVKSHSSSVGPGEERRLLEALNVKPVVVEKMDSPKTLARVEVKENGDTFNVKAYEKAVKSYITKRKPLGEALDEEIMDELSVKFGIVDDALEDLFKQIQDAGISIVDKDGNPSPLALVTDEIEKEEVSDTAMDEIVTNVRIDDPVRMYLKEIGRYPLISLDEETKLAEAIIAGGEGAEFAKQMLAEANLRLVVSIAKRYSGRGMQFLDLIQEGNMGLMKAVDKFDHTKGFKFSTYATWWIRQAITRAIADQARTIRIPVHMVETINKLIRVQRNLLQELGRDPSPEEIGKELHMAPDKVREVLKIAQEPVSLETPIGEEDDSHLGDFIEDDVIESPVDYTNRILLREQLDEVMDTLTDREENVLRMRFGLDDGRMHTLEDVGKQFKVTRERIRQIEAKAIKKLRHPRRSKPLRDFM

SEQ ID NO: 10470 - protein, 178 aa, Lactococcus lactis subsp. lactis
MTKITLAVTGSIAAYKAADLTSLLTKEGHDVTVLMTKSATQFITPLTLQVLSKNKVHLDIMDEERPELVNHIDLAKNTELFLVAPATADTISRLAQGRADDIVTSVALALEPSVPKYFAPAMNTKMYQHPLTQKNIEILKKIDYNMIQPKKSLLACGDFGEGALADLPDILSDLKNSL

SEQ ID NO: 10471 - protein, 433 aa, Lactococcus lactis subsp. lactis [sequence omitted]

SEQ ID NO: 10472 - protein, 155 aa, Lactococcus lactis subsp. lactis
MNFTEEEKEFFMKEALKEAQKAAENEEVPIGVVIVKDGEIIARDFNRRELDGRATHHAEVCAIEAANQAVGNWRLLDCALFVTIEPCVMCAGAIGLARIPQVYFGATNPKFGGTVSLYQILEDKRLNHRVQVESGILEDECAKIMQDFFKNRRKK

SEQ ID NO: 10473 - protein, 243 aa, Lactococcus lactis subsp. lactis
MEIKNKNVFVTGSTRGIGKAIALQFAKAGSNLIINGRSAISEELLAEFTAYGVKAVGISGDISKSEDAKQMVAEAIETLGSVDILVNNAGITRDGLSLKMSEEDFESVLKINLTGAFNMTQAVLKPMTRARSGAIINISSVVGLMGNAGQANYAASKAGLIGLTKSIAREVAARNVRVNAVAPGFIESDMTEVLSDKVKDAMKGQIPMKRFGMPEEIATATQFLAEQEYMTGQVLTIDGGVSM

SEQ ID NO: 10474 - protein, 243 aa, Lactococcus lactis subsp. lactis
MKFSGKKVLITGAASGIGLAQTKVFLAEGAEVVAVDLQEFTDESIINSKNLSVKILDVSDAQSVEKLADEVGSIDVLLNTAGVLDAYKTLEETDFAEWQRILSTNLNSMYLMISAFLPKMKAQKSGVIINMASVAGLIAGGGGVAYTTSKHAIVGLTKQLALDEAQHGIQVAAIAPGAINTPMNAADFTENNGQMAQWVADETPAKRWASPREVADLTLFLASPQASYMSGAIVPIDGGWTIK

SEQ ID NO: 10475 - protein, 329 aa, Lactococcus lactis subsp. lactis
MNNLNSVFDYEDIQLIPNKCVINSRLEADTSVKLGNFTFKLPVVPANMQTIIDDKIAEMLAKEGYFYIMHRFEAENRAAFIKKMHQQGLIASISVGVKADEHAFIREISADALIPEFITIDIAHGHADSVIKTIQLIKRLMPQTFVIAGNVGTPEAVRELENAGADATKVGIGPGKVCITKVKTGFGTGGWQLAAVKWCAKAASKPVIADGGIRTHGDIAKSIRMGATMVMVGSLFAAHEESPGQTVERDGQLFKEYFGSASEYQKGEHKNVEGKKILLPHKGSLKDTLKEMEEDLQSSISYAGGRDLSALTKVDYVVVKNSIWNGDAI

SEQ ID NO: 10476 - protein, 280 aa, Lactococcus lactis subsp. lactis
MIEQEKYTLNDGHLIPKIGLGTFQIRGYEGVEQILTAIQSGYRLLDTSTNYDSEGAVGEAIRRSGIPRSNFFVTTKLPGKYHHFEDALKMIEESLLRTGLSYFDLYLIHWPLPKRDNYVEAWKALIAAKKRGLVRSIGVSNFEEDHLDKIIQETGVIPAINQNEIHPYWPQEKLLKINKKYGILTEAWSPLGRGSKELEESLIQNIAQKYGKDTGQIILRWQVERGIIPIVKATSPEHQRRNIDIFDFSLSSEEINKITALKQENGRVDNQDPNEYEEFV

SEQ ID NO: 10477 - protein, 419 aa, Lactococcus lactis subsp. lactis
MKTPFVTKEQLEQITKEFPTPFHLYDEKGIRQKARDLHKAFAWNKGFKEFFAVKATPTPAILKILHEEGCGVDCASYVELLLSEKCGFDGSEMMFSSNDTPAEEFQFANQLGATINLDAYEDIEFLKNLTDFIFPETMSLRYNPGGVFAMGTKIMDNPEESKFGMTKAQLIQGIKDLQKLGVKKFGMHSFLASNTVTNDYYPELANKLFKLALEIREETGITLDFINLSGGIGVNYRPDEEANDIAKIGQGVHEAYDEVLRANGIENLKIYTELGRFMLAPHGHLITKVLHIKETYRKYVGVDASAVNLMRPAFYDAYHHITVAGKEKDEATEIYDITGSLCENNDKFAKERAFPKIEIGDLLVIHDTGAHGFSMGYQYNAKLRSSEVLLQEDGKTRLIRRAEKPADYFATLDGFDFTI

SEQ ID NO: 10478 - protein, 466 aa, Lactococcus lactis subsp. lactis
MLYGKENRDEAEFLEPIFGSESEQVDLPKYKLAQQSIEPRVAYQLVQDEMLDEGNARLNLATFCQTYMEPEAVKLMSQTLEKNAIDKSEYPRTTEIENRCVNMIADLWNASEKEKFMGTSTIGSSEACMLGGMAMKFSWRKRAEKLGLDINAKKPNLVISSGYQVCWEKFCIYWDIEMREVPMDKEHMSINLDKVMDYVDEYTIGVVGIMGITYTGRYDDIKALDNLIEEYNKQTDYKVYIHVDAASGGLYAPFVEPELEWDFRLKNVISINTSGHKYGLVYPGVGWVLWRDKKYLPEELIFKVSYLGGELPTMAINFSHSASQLIGQYYNFVRYGFDGYKAIHERTHKVAMFLAKEIEKTGMFEIMNDGSQLPIVCYKLKEDSNRGWNLYDLADRLLMKGWQVPAYPLPKNLENEIIQRLVIRADFGMNMAFNYVQDMQEAIEALNKAHILYHEEPENKTYGFTH

SEQ ID NO: 10479 - protein, 599 aa, Lactococcus lactis subsp. lactis
MTVLDKVNDPTDIKALTPLELEELATNVRDAILNRVSQYPGGHLGPNLGVVEMTIALHKVFNSPVDKLIWDVSHQSYPHKVLTGRKEFFTDKDKFSGTTGYTDPEENEHDFIRVGHTSTSIATAMGYALARDVQGKKENIVAIIGDGALSGGLAFEGLDGAGTLNGNLIIIVNDNEMAITENHGGIYQHLADLRASKGTSANNLFKSFGLDYRYLEEGNDIQSLIVLFESVKDINRPIVLHIHIEKGHGYKPAVENKEGMHQVFAPFDIATGQPVNSSTNIVRSYNNVFLDFMEEKLAKGDNLIAINAAIPMFFGLSQFAKNHPKNYVDGGIAEQYTVTLGGAIAAAGTRAIIFQNATFLQRAYDQLNHDLALNKEPAIVIISNSQIGGTNDTHQGSFVYSQTSNIPNVIDLAATSEEDLFAMLNWAYNQHEHPVFIHLPEHTLENRPTKITDFSKPQYEVVKSGEKVAILGLGAMLEKAENVAEELEKSGFNPTVVNPFFANLLDVAALDKLSETHGLFVTIEDGTKDGGFGQKVATYLASKGIKTLVYGADTEFIDAVPKEELYNRYHIRPELMATDIIEATKESKGPNFFKKIFSK

SEQ ID NO: 10480 - protein, 433 aa, Lactococcus lactis subsp. lactis
MRKLSPTFIYFFGALGGLLFGYDTGVISGALLFIEKESWQVSSWAWMEGWITAAVLMGAVIGAVVIGPMSDRFGRKRLLLLSAVIFFVGALGSGLSNSAELLIISRVILGMAVGSASALVPTYLSELSPAKIRGGVSTMFQLMIMTGILLAYISNYALKGVSGNWHWMLGLATVPAALLFIGGLFLPESPRFLVRHDNEAGAREILGMINDDPNSIEAEISDIQLMAKEEKQGGLQELFGQMSRPVLIMAIGLAIFQQVMGCNTVLYFAPSIFVAVGFGASAALLAHIGIGIFNVIVTYIAMRVMDKVNRRWMLNFGAWGMGISLVLMSVGMILAENAHIGFGKYLAVIALTVYIAFFSATWGPVMWVMIGESFPLKIRGLGNSFGAAVNWAANWVVSLTFLPLLSFFGTGKIFLIYAACCFLSIWFTSKKSY

SEQ ID NO: 10481 - protein, 113 aa, Lactococcus lactis subsp. lactis
MKKIEAIIRTDKLEDLKAALSDNGLVHGMTVSQVLGYGEQKGFTEYVRGQRIETTLLSKLKIEIVSIDEKVDDIVNVIIKAVQTGEVGDGKIFIQPVERVIRIRTSEEDAQAL

SEQ ID NO: 10482 - protein, 580 aa, Lactococcus lactis subsp. lactis
MSVLEKIDSPADLKKVSNQELEELASEIRTAVLHKVSNIGGHVGPNLGVTELTIALHKVFNSPIDKFIWDVSHQTYPHKILTGRKNGFTDGHFHDITPYTSQRESEHDFFTVGHTSTSIANALGYAKARDLTNDKGNIVAVIGDGSLSGGLAMEALNNAGDFKGNLIILVNDNQMSIAENHGGLYRNLAELRATNGQAENNFFKTFGLDYKYLENGNDIESLIHLFEEVKDIDHPIVLHIHTEKGRGYQPALENKEAFHWHMPFDLETGQSKVIDSGKSYSSVMLDYMDKKVSEGLPLVAINAAIPGIFGLKQFAAKYPDRYIDAGIAEQFTITFGGAMAAAGARPIIFHNSTFVQRAYDQFWHDLAINEEPAIVIVKGGVISGSDETHQGSSAMTWISNIPNIKYLAPTSEEEFISILDWALEQHEEPVVIQMPEHGLESRPTVLTDYSTPSYQMTKSGEKVALLALGGLYSHGEKVAKVLAENGINATLINPLFINDLDQAFLENLVENHQVIATIEDGILDGGFGQKVASFLGKYDVKVLNFGAKREFNDSVPVTELYNRYHLTPELMVADILSLLK

SEQ ID NO: 10483 - protein, 199 aa, Lactococcus lactis subsp. lactis
MNEKKKGFWSEAIRVTKENDPAARTALEVFLTYPGVKALAAHRISHFLWRHHLKLLARMHSQFWRFWTQIEIHPGAEIAHGVFIDHGSGLVIGETAIVEKDVKLYHGVTLGGTGKDKGKRHPTIRQGALISAHSQLLGPIEVGENAKVGASAVVVTDVPPEVTVVGIPAKVVRVKGKKDVERITSLEEKREASYHSSHL

SEQ ID NO: 10484 - protein, 281 aa, Lactococcus lactis subsp. lactis
MQRKLTLNDGNVIPQFGLGLYQLPEGTETQNIVKTALELGYRHLDTSHAYQNETSVGQAIQDSEISNSEIWITSKLWPSDYEQAPEAIERMLKRLKVKQIDLLLLHQQVGNYRKAWIALENAVKEGKVKSIGISNFDGERLVDLFNFADIKPSVIQVETHPYHQQVELQEFLKPYGTKIESWYPLGHGDKNLLEEKIFKKMAKKYNKTVAQIILRWHIQEGIIVFPRSTQKEHLAENINIFDFELSCSEIKEIRKLNKKQPYFTMTYEEQEKNFLSWKLED

SEQ ID NO: 10485 - protein, 450 aa, Streptococcus pyogenes M1 GAS
MTRDIIGNLSTFELAILILLVFVAFYFIHLAVRDYRNARIIRMMSHKIRDLINGRYTDIIDEKADIELMELSDQLNDLSDVFRLTHENLAQEKNRLASILAYMSDGVLATDRSGKIIMINETARKQLNLSKEEALKKNITDLLEGDTSYTYRDLVSKTPVVTVNSRNDMGEFVSLRLRFALNRRESGFISGLVVVLHDTTEQEKEERERRLFVSNVSHELRTPLTSVKSYLEALDEGALKEDIAPSFIKVSLDETNRMMRMISDLLNLSRIDNQVTQLAVEMTNFTAFITSILNRFDLVKNQHTGTGKVYEIVRDYPITSVWIEIDNDKMTQVIENILNNAIKYSPDGGKITVRMKTTDTQLIISISDQGLGIPKTDLPLIFDRFYRVDKARSRAQGGTGLGLAIAKEIIKQHHGFIWAKSDYGKGSTFTIVLPYEKDAAIYEEWEEDVD

SEQ ID NO: 10486 - protein, 264 aa, Streptococcus pyogenes M1 GAS
MENMFSLQGKIALITGASYGIGFEIAKAYAQAGATIVFNDIKQELVDKGLAAYRELGIEAHGYVCDVTDEAGIQQMVSQIEDEVGAIDILVNNAGIIRRTPMLEMAAEDFRQVIDIDLNAPFIVSKAVLPSMIAKGHGKIINICSMMSELGRETVSAYAAAKGGLKMLTKNIASEFGEANIQCNGIGPGYIATPQTAPLRERQADGSRHPFDQFIIAKTPAARWGTTEDLAGPAVFLASDASNFVNGHILYVDGGILAYIGKQP

SEQ ID NO: 10487 - protein, 218 aa, Streptococcus pyogenes M1 GAS
MLMIKGIIFDMDGVLFDTEPFYLRRREDFFKTKGIPIDHLNSKDFIGGNLQELWKELLGKNRDDAIVKAITTDYDAYKQAHKPPYQKLLITEVNSCLEQLEKQGIKLAVASNSKRQDVLLALETTQIKDYFEIILAREDVSRGKPYPDIYNKAVQKLGLQKKQLLVVEDSQKGIAAAKAANLTVFAITDYRYGIDQSQADHKIDHLGQLCVKIGCFGS

SEQ ID NO: 10488 - protein, 435 aa, Streptococcus pyogenes M1 GAS
MSIITDVYAREVLDSRGNPTLEVEVYTESGAFGRGMVPSGASTGEHEAVELRDGDKSRYLGLGTQKAVDNVNNIIAEAIIGYDVRDQQAIDRAMIALDGTPNKGKLGANAILGVSIAVARAAADYLEVPLYTYLGGFNTKVLPTPMMNIINGGSHSDAPIAFQEFMIMPVGAPTFKEGLRWGAEVFHALKKILKERGLVTAVGDEGGFAPKFEGTEDGVETILKAIEAAGYEAGENGIMIGFDCASSEFYDKERKVYDYTKFEGEGAAVRTSAEQVDYLEELVNKYPIITIEDGMDENDWDGWKVLTERLGKRVQLVGDDFFVTNTEYLARGIKENAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 10489 - protein, 369 aa, Streptococcus pyogenes M1 GAS
MTKQKEITTFNVQVAEFIRHHKKEGTAIDDDVTEKLVIPFALDADQIDDLLERLTDGGISITDKEGNPSSKYIVEEPKPEELTDEELIGSNSAKVNDPVRMYLKEIGVVPLLTSEEEKELAVAVAKGDLMAKQRLAEANLRLVVSIAKRYVGRGMQFLDLIQEGNMGLMKAVDKFDYSKGFKFSTYATWWIRQAITRAIADQARTIRIPVHMVETINKLVREQRNLLQELGQDPTPEQIAERMEMTPDKVREILKIAQEPVSLETPIGEEDDSHLGDFIEDEVIENPVDYTTRVVLREQLDEVLDTLTDREENVLRLRFGLDDGKMRTLEDVGKVFNVTRERIRQIEAKALRKLRHPSRSKQLRDFIED

SEQ ID NO: 10490 - protein, 332 aa, Streptococcus pyogenes M1 GAS
MSETKLMALREAVNLAMTEEMRKDENIFLMGEDVGVYGGDFGTSVGMIEEFGPKRVKDTPISEAAISGAAIGAAITGLRPIVDVTFMDFLTIMMDAIVNNGAKNNYMFGGGLITPVTFRVASGSGIGSAAQHSQSLEAWLTHIPGIKVVAPGNANDAKGLLKSAIRDNNIVLFMEPKALYGKKEEVNQDPDFYIPLGKGDIKREGTDLTIVSYGRMLERVLQAAEEVAADGINVEVVDPRTLIPLDKELIIESVKKTGKLMLVNDAYKTGGFIGEIATMITESEAFDYLDHPIVRLASEDVPVPYARVLEQAILPDVEKIKAAIVKMANKGN

SEQ ID NO: 10491 - protein, 327 aa, Streptococcus pyogenes M1 GAS
MFNDIPVFDYEDIQLIPNKCIITSRSQADTSVTLGKYQFKLPVIPANMQTIIDETIAEQLAKEGYFYIMHRFDEDSRKPFIKRMHEQGLIASISVGVKACEYEFVTSLKEDAPEFITIDIAHGHANSVIDMIKHIKTELPETFVIAGNVGTPEAVRELENAGADATKVGIGPGKVCITKVKTGFGTGGWQLAALRWCAKAARKPIIADGGIRTHGDIAKSIRFGASMVMIGSLFAGHFESPGKTVEVDGETFKEYYGSASEYQKGEHKNVEGKKILLPTKGHLSDTLTEMQQDLQSSISYAGGKDLDSLRHVDYVIVKNSIWNGDSI

SEQ ID NO: 10492 - protein, 181 aa, Streptococcus pyogenes M1 GAS
MTKHITLAVSGSISAYKAADLTSQLTKIGYDVHIIMTQAATQFITPLTLQVLSKNAIHLDVMDEHDPKVINHIELAKRTDLFIVAPASANTIAHLAYGFADNLVTSVALALPATTPKLIAPAMNTKMYQNPITQENIKRLSTIGFTEIPPKSSLLACGDKGPGALADIDVILATIDTIWKL

SEQ ID NO: 10493 - protein, 577 aa, Streptococcus pyogenes M1 GAS
MTEMLKGIAASDGVAVAKAYLLVQPDLSFETVTVADTNAEEARLDVALQAAQDELSVIRENAVESLGEEAAAVFDAHLMVLADPEMISQVKETIRAKQTNAETGLKEVTDMFITIFEGMEDNPYMQERAADIRDVAKRVLAHLLGVKLPNPATINEESIVIAHDLTPSDTAQLNKQFVKAFVTNIGGRTSHSAIMARTLEIAAVLGTNDITKRVKDGDVIAVNGITGEVIIDPSEDQVLAFKEAGAAYAKQKAEWSLLKDAHTETADGKHFELAANIGTPKDVEGVNDNGAEAVGLYRTEFLYMDSQDFPTEDEQYEAYKAVLEGMNGKPVVVRTMDIGGDKELPYFDLPKEMNPFLGFRALRISISETGDAMFRTQMRALLRASVHGQLRIMFPMVALLKEFRAAKAVFDEEKANLLAEGVAVADDIQVGIMIEIPAAAMLADQFAKEVDFFSIGTNDLIQYTMAADRMNEQVSYLYQPYNPSILRLINNVIKAAHAEGKWAGMCGEMAGDQQAVPLLVGMGLDEFSMSATSVLRTRSLMKKLDSAKMEEYANRALTECSTAEEVLELSKEYVSED

SEQ ID NO: 10494 - protein, 259 aa, Streptococcus pyogenes M1 GAS
MTHTKEVAFITGAASGIGKQIGETLLKEGKTVVFSDINQEKLDQVVADYTKEGYDAFSVVCDVTKEEAINAAIDTVVEKYGRIDILVNNAGLQHVAMIEDFPTEKFEFMIKIMLTAPFIAIKRAFPTMKAQKHGRIINMASINGVIGFAGKSAYNSAKHGLIGLTKVTALEAADSGITVNAICPGYVDTPLVRGQFEDLSKTRGIPLENVLEEVLYPLVPQKRLIDVQEIADYVSFLASDKAKGVTGQACILDGGYTAQ

SEQ ID NO: 10495 - protein, 279 aa, Streptococcus pyogenes M1 GAS
MVTTVKMTSGYEIPVLGFGTYQAADGEEAYQSTLAAIKAGYRHIDTAAIYKNEESVGRAIKDSGVLREDLFITTKLWNDAHSYEGAKDALAASLDRLGLDYVDLYLIHWPNPKALRNTWKEANAQAWQYMEEAVEAGLIKSIGVSNFMVHHLEALQETAKITPAINQIRLAPGCYQKEVVDYCKANEILLEAWSPLGQGEIFDNETMQQLANKYDKTVAQVALAWSLAEGFIPLPKSVHDERIKENMAIFDVSLTQEDKKTIRYLSGMSAIPNPDTTSF

SEQ ID NO: 10496 - protein, 244 aa, Streptococcus pyogenes M1 GAS
MEIKGKNIFITGSTRGIGLAMAHQFASLEANIVLNGRSAISEELVASFTDYGVTVVTISGDVSEASEAKRMVNEAIESLGSIDVLVNNAGITNDKLMLKMTEEDFERVLKINLTGAFNMTQSVLKPMIKARQGAIINVSSVVGLTGNIGQANYAASKAGMIGFTKSVAREVAARNICVNAIAPGFIESDMTGVLPEKMQEQILSQIPMKRIGKAQEVAHLASFLVEQDYITGQVIAIDGGMTMQ

SEQ ID NO: 10497 - protein, 193 aa, Streptococcus pyogenes M1 GAS
MGWWKESIAIVKALDPAARNSLEVILTYPGIKALAAHRLSHFLWRHHFKLLARMHSQFWRFWTQIEIHPGAQIAPGVFIDHGAGLVIGETAIVEKGVMLYHGVTLGGTGKDCGKRHPTVRQGALISAHAQVIGPIDIGANAKVGAAAVVLSDVPEDVTVVGVPAKIVRVHGQKDNRQIQSLQKQREVSYQLSK

SEQ ID NO: 10498 - protein, 493 aa, Streptococcus pyogenes M1 GAS
MSNWDTKFLKKGYTFDDVLLIPAESHVLPNEVDLKTKLADNLTLNIPIITAAMDTVTGSKMAIAIARAGGLGVIHKNMSITEQAEEVRKVKRSENGVIIDPFFLTPEHKVSEAEELMQRYRISGVPIVETLANRKLVGIITNRDMRFISDYNAPISEHMTSEHLVTAAVGTDLETAERILHEHRIEKLPLVDNSGRLSGLITIKDIEKVIEFPHAAKDEFGRLLVAAAVGVTSDTFERAEALFEAGADAIVIDTAHGHSAGVLRKIAEIRAHFPNRTLIAGNIATAEGARALYDAGVDVVKVGIGPGSICTTRVVAGVGVPQVTAIYDAAAVAREYGKTIIADGGIKYSGDIVKALAAGGNAVMLGSMFAGTDEAPGETEIYQGRKFKTYRGMGSIAAMKKGSSDRYFQGSVNEANKLVPEGIEGRVAYKGAASDIVFQMLGGIRSGMGYVGAGDIQELHENAQFVEMSGAGLIESHPHDVQITNEAPNYSVH

SEQ ID NO: 10499 - protein, 394 aa, Neisseria meningitidis MC58
MTPQVLTILGSTGSIGESTLDVVSRHPEKFRVFALAGHKQVEKLAAQCQTFHPEYAVVADAEHAARLEALLKRDGTATQVLHGAQALVDVASADEVSGVMCAIVGAVGLPSALAAAQKGKTIYLANKETLVVSGALFMETARANGAAVLPVDSEHNAVFQVLPRDYAGRLNEHGIASIILTASGGPFLTADLNTFDRITPAQAVKHPNWRMGRKISVDSATMMNKGLELIEAHWLFNCPPDKLEVVIHPQSVIHSMVRYRDGSVLAQLGNPDMRTPIAYCLGLPERIDSGVGDLDFDALSALTFQKPDFDRFPCLRLAYEAMNAGGAAPCVLNAANEAAVAAFLDGQIKFTDIAKTVAHCLAQDFSDGIGDIGGLLAQDARTRAQARAFIGTLR

SEQ ID NO: 10500 - protein, 451 aa, Neisseria meningitidis MC58
MSEYTPQTAKQGLPALAKSTIWMLSFGFLGVQTAFTLQSSQMSRIFQTLGADPHNLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYDPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 10501 - protein, 272 aa, Neisseria meningitidis MC58
MKKDHLNTTGFDLWHTIREETAAAVSAEPMLASFLHQTVLRHESLGSVLAYHLSSKLGSPIMDVRALFEIYQQALGSDTQIGKCVEADLKAIYERDPACDEYSLPLLYFKGFHAIQAHRINHRLYLDGRKTLAYFLQNRMSEVFGVDIHPAARFGYGLMLDHATGFVAGETAVLGNNISILHGVTLGGSGKEGGDRHPKIGDGVMIGANASILGNIRIGSNAKIGAGSVVVSDVPPSITVVGVPAKPVARSLKTPSADMDQNIQFTEIDFMI

SEQ ID NO: 10502 - protein, 405 aa, Neisseria meningitidis MC58
MEIILGIVMFTVIVLVLALMILFAKSKLVSEGDITIKVNGEKELTMPAGGKLLGALANEGIFIPSACGGGGSCGQCRVVVKSGGGDILPTELSHISKREAREGCRLSCQVNVKTDMDIEVPEEVFGVKKWECTVISNDNKATFIKELKLAIPEGEEVPFRAGGYIQIEAPPHTVAYKDFDIPKEYHEDWDKYNLWQYVSKVDEPILRAYSMASYPEEKGIIMLNVRIATPPPRVPDAPPGQMSSYIWSLKPGDKVTISGPFGEFFAKDTDAEMVFIGGGAGMAPMRSHIFDQLKRLNSKRKITFWYGARSKREMFYVEDFDQLAAEFPNFTWHVALSDPLPEDNWDGYTGFIHNVVYENHLKNHEAPEDCEFYMCGPPIMNQSVIKMLKDLGVEDENILLDDFGG

SEQ ID NO: 10503 - protein, 794 aa, Neisseria meningitidis MC58
MADNYVIWFENLRMTDVERVGGKNASLGEMISQLTEKGVRVPGGFATTAEAYRAFLAHNGLSERISAALAKLDVEDVAELARVGKEIRQWILDTPFPEQLDAEIEAAWNKMVADAGGADISVAVRSSATAEDLPDASFAGQQETFLNINGLDNVKEAMHHVFASLYNDRAISYRVHKGFEHDIVALSAGVQRMVRSDSGASGVMFTLDTESGYDQVVFVTSSYGLGENVVQGAVNPDEFYVFKPTLKAGKPAILRKTMGSKHIKMIFTDKAEAGKSVTNVDVPEEDRNRFSITDEEITELAHYALTIEKHYGRPMDIEWGRDGLDGKLYILQARPETVKSQEEGNRNLRRFAINGDKTVLCEGRAIGQKVGQGKVRLIKDASEMDSVEAGDVLVTDMTDPDWEPVMKRASAIVTNRGGRTCHAAIIARELGIPAVVGCGNATELLKNGQEVTVSCAEGDTGFIYAGLLDVQITDVALDNMPKAPVKVMMNVGNPELAFSFANLPSEGIGLARMEFIINRQIGIHPKALLEFDKQDDELKAEITRRIAGYASPVDFYVDKIAEGVATLAASVYPRKTIVRMSDFKSNEYANLVGGNVYEPHEENPMLGFRGAARYVADNFKDCFALECKALKRVRDEMGLTNVEIMIPFVRTLGEAEAVVKALKENGLERGKNGLRLIMMCELPSNAVLAEQFLQYFDGFSIGSNDMTQLTLGLDRDSGLVSESFDERNPAVKVMLHLAISACRKQNKYVGICGQGPSDHPDFAKWLVEEGIESVSLNPDTVIETWLYLANELNK

SEQ ID NO: 10504 - protein, 290 aa, Neisseria meningitidis MC58
MSQMNNAFALPAIQSGNGSLEQYIHTVNRIPMLTQEEETRLAERQHKGDLNAAKQLILSHLRVVVSIARGYDGYGLNQADLIQEGNIGLMKAVKRYEPGRGARLFSFAVHWIKAEIHEFILRNWRLVRVATTKPQRKLFFNLRSMRKNLNALSPKEAQDIADDLGVKLSEVLEMEQRMTGHDIAIMADNSDDEDSFAPIDWLADHDSEPSRQLSKQAHYALQTEGLQNALAQLDDRSRRIVESRWLQDDGGLTLHQLAAEYGVSAERIRQIEAKAMQKLRGFLTEEAEAV

SEQ ID NO: 10505 - protein, 459 aa, Neisseria meningitidis MC58
MLLDLNRFSFPVFLKEVRLLTTLALPMLLAQVAQVGIGFVDTVMAGGAGKEDLAAVALGSSAFATVYITFMGIMAALNPMIAQLYGAGKTDEVGETGRQGIWFGLFLGVFGMVLMWAAITPFRNWLTLSDYVEGTMAQYMLFTSLAMPAAMVHRALHAYTSSLNRPRLIMLVSFAAFVLNVPLNYIFVYGKFGMPALGGAGCGLATMAVFWFSALALWIYIAKENFFRPFGLTAKFGKPDWAVFKQIWKIGAPIGLSYFLEASAFSFIVFLIAPFGEDYVAAQQVGISLSGILYMIPQSVGSAGTVRIGFSLGRREFSRARYISGVSLVLGWMLAVITVLSLVLFRSPLVSMYNNDPAVLSIAATVLLFAGLFQPADFTQCIASYALRGYKVTKVPMFIHAAAFWGCGLLPGYLLAYRFNMGIYGFWTALIASLTIAAIALVWCLELCSREMVRSHKAV

SEQ ID NO: 10506 - protein, 344 aa, Neisseria meningitidis MC58
MARHVFLPPLSVHRHRPHPLGVCGFESFQTLHPRKRAARPDSRPLYELCRHTCLQDFPKIRHPLCRHGTQQHHYARFGAPAPMAAYEKCGGTRRRTSRRQPPFRTRPATQIRLRMAVPPPTYWAEYSTDRLNKEKKNNKPHFVFCTVSHLRRLKGHDVLLTAFARALAQCPQLRLNIGGSGQEEQRLKQQAADLGITHAVTFLGALQPEAVLDLMRNSDAFVLASRTETFGVVYIEALSQGLPVIATRCGGAESIVSDGNGYLVPVDDDDALADALIKMCEHHSDFEPARLRENCLNEFGENAVIGRLIGIFRQAIAEYGKKIPVKYSGLTKIRTRRRSRRQYK

SEQ ID NO: 10507 - protein, 324 aa, Neisseria meningitidis MC58
MDTLTRFLPEHLQQNQLPEALGGVLLSVVSACTEINAKVRLGALAGVLGMAGTGNIQGEDQKKLDVIANNIMIDTLKANSAVAGLASEEEDTFVNAGENGRYLVLFDPLDGSSNIDVNISVGTIFSILEKPEGALATESFLQTGRQQLAAGYVLYGPQTQLVFTFGHGVYMFTLNAENEFVLTKENPKVPESTKEFAINMSNRRHWLPPVQQYIDELLAGETGTRGKNYNMRWVASMVAEIHRILMRGGVFMYPQDKRDPAKPGKLRLMYEANPMSLILEQAGASASNAYQAMLDIQPENLHQRVAVFMGSSEEVAYLDRLHAK

SEQ ID NO: 10508 - protein, 487 aa, Neisseria meningitidis MC58
MRIVEKAYTFDDVLLVPAHSTVLPRDVKLQTKLTREITLNLPLLSAAMDTVTEARLAISMAQEGGIGIIHKNMPPEMQARAVSKVKRHESGVVKDPVTVAPTTLIREVLEMRAQRKRKMSGLPVVENGKVVGIVTNRDLRFENRVDLPVSAIMTPRERLVTVPEGTSIDEARELMHTHKVERVLVLNEKDELKGLITVKDILKTTEFPNANKDSEGRLRVGAAVGTGGDTEERVKALVEAGVDVIVVDTAHGHSQGVIDRVRWVKETYPHIQVIGGNIATAKAALDLVAAGADAVKVGIGPGSICTTRIVAGVGVPQLTAIHNVAEALKGTGVPLIADGGIRFSGDIAKALAAGAYSVMLGGMFAGTEEAPGEIELYQGRSYKSYRGMGSLGAMSQGSADRYFQDKTDSTDKYVPEGIEGRVPYKGPIVNIIHQLTGGLRSSMGYLGCANIAEMHEKAEFVEITSAGMSESHVHDVQITKEAPNYHR

SEQ ID NO: 10509 - protein, 675 aa, Neisseria meningitidis MC58
MSLSEFIERRTSFNPMVILTTLFFVCVLVVLVLTVPDQVQMWLDRAKEVIFTEFSWFYVLTFSIFLGFLLILSVSSLGNIRLGRDEDVPEFGFLSWLAMLFAAGMGVGLMFFGVAEPLMHYFSDITAGTPEHRQQQALLHTVFHWGVHAWSVYGTIALALAYFGFRYKLPLALRSCFYPLLKEKISGRFGDAIDIMALLATFFGIITTLGFGASQLGAGLQEMGWIAENSFSVQVLIIAAVMSLAVVSAISGVGKGVKVLSELNLGLAFLLLFFVLAAGPTVYLLSAFGDNIGNYLGNLVRLSFKTYAYEREHKPWFESWTVLYWAWWCSWAPFVGLFIARISKGRTIREFVFGVLLIPGLFGVLWFTVFGNTAIWLNDGVAGGMLEKMTSSPETLLFKFFNYLPLPELTSIVSLLVISLFFVTSADSGIYVLNNITSRDKGLSAPRWQAVMWGVLMSAVAVLLMRSGGLGNLQSMTLIVSLPFALLMLIMCFSLWKGLSADKKYFETRVNPTSVFWTGGKWKERLVQIMSQTQEQDILKFLKQTASPAMHELQRELSEEYGLSVRVDKMFHRDEPAIEFVIRKETMRDFMYGIKSVGQDVSDQLINDGKLPHIRHQTTYKPYAYFFDGRVGYDVQYMNKDELIADILKNYERYLMLLDDVGQELMAHEQVELAE

SEQ ID NO: 10510 - protein, 428 aa, Neisseria meningitidis MC58
MSAIVDIFAREILDSRGNPTVECDVLLESGVMGRAAVPSGASTGQKEALELRDGDKSRYSGKGVLKAVEHVNNQIAQALIGIDANEQSYIDQIMIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEATEAAGYKAGEDVLFALDCASSEFYKDGKYHLEAEGRSYTNAEFAEYLEGLVNEFPIISIEDGMDENDWEGWKLLTEKLGGRVQLVGDDLFVTNPKILAEGIEKGVANALLVKVNQIGTLSETLKAVDLAKRNRYASVMSHRSGETEDSTIADLAVATNCMQIKTGSLSRSDRMAKYNQLLRIEEELAEAADYPSKAAFYQLGK

SEQ ID NO: 10511 - protein, 378 aa, Neisseria meningitidis MC58
MEMKQADSTIKSRAAVAFAPNQPLQIVEIDVEMPRKGEVLIRNTHTGVCHTDAFTLSGSDPEGVFPVVLGHEGAGVVVAVGEGVSSVKPGDHVIPLYTAECGECEFCCSGKTNLCVSVRDTQGKGLMPDGTTRFSYQGQPIYHYMGCSTFSEYSVVAEVSLAKINPEANHEQVCLLGCGVTTGIGAVHNTAKVQEGDSVAVFGLGAIGLAVVQGARQAKAGRIIAIDTNPSKFELAKQFGATDCLNPNDYDKPIKDVLLDINKWGIDHTFECIGNVNVMRQALESAHRGWGQSIIIGVAGAGQEISTRPFQLVTGRVWKGSAFGGVKGRSELPKMVEDSMKGDIELEPFVTHTMTLDQINKAFDLMHEGKSIRAVIHY

SEQ ID NO: 10512 - protein, 477 aa, Neisseria meningitidis MC58
MNEYSQLIKHPDISLPPVSDGIKVDNPATGETLAFVRKTDSDKLKNLIQKAAAAQKLWAAKTALERADVLWRWYFQIKENKEALARLMTMEQGKSLTEARGEIDYAASFVRWFAEEARRIDGDVLTSVKASQKLVVLKQPVGVTAAITPWNFPSAMIARKAAPALAVGCAMIVKPASLTPLSAYALASLAYEAGIPQDLLPVVSGSASEIGHEFATNPIIRKISFTGSTEVGAKIFADSAADIKKLSLELGGNAPFIVFDDADLDKAVEGALASKFRNSGQTCVCTNRVYAQSAIYDEFCRKLSEKAAALKLGNGLEDGVNQGPLIEEKAVEKVEQHIADALAKGASCLTGGKRSALGGTFFEPTVLSGVTAQMAVAREETFGPLCPVFRFETEAEVIEAANNTEYGLAAYLFTADTARQWRVGEALEYGMVGINTGLISNEAAPFGGVKRSGLGREGSKYGADEYLELKYLCMDVG

SEQ ID NO: 10513 - protein, 642 aa, Neisseria meningitidis MC58
MSRNQNHEEYQDDTRPLSIEEQRARLRQLIIMGKERGYITYSEINDALPDDMSDADQIDNIVSMISGLGIQVTEHAPDAEDILLSDNAAVTDDDAVEEAEAALSSADSEFGRTTDPVRMYMREMGQVDLLTREDEIIIAKKIENALKNMVQAISACPGSIAEILELIEKIRKDEIRVDEVVEAIIDPNEVLLNELGLGHLETTAPEKPSNDNSDENEDDEESEEDADEISAANLAELKQKVIGHFAQIEKDYKKMIGRLEKHHSRHKDYLAYRDAIANKLLEVRFATRQIDSLSSSLRGKVENIRKLEREIRDICLDRVHMERDYFIQNFLPEITNLEWIEEEIAKGRVWSDALDRFRHAILEKQTELADMEKETRISIEELKEINKNMVSSEKETAAAKQEMIQANLRLVISIAKKYTNRGLQFLDLIQEGNIGLMKAVDKFEYRRGYKFSTYATWWIRQAITRSIADQARTIRIPVHMIETINKMNRISRQHLQETGEEPDSAKLAELMQMPEDKIRKIMKIAKEPISMETPIGDDDDSHLGDFIEDANNVAPADAAMYTSLHEVTKEILESLTPREAKVLRMRFGIDMNTDHTLEEVGRQFDVTRERIRQIEAKALRKLRHPTRSDRLRSFLDSEDSKL

SEQ ID NO: 10514 - protein, 394 aa, Neisseria meningitidis MC58
MGKHILLGVTGSIAAYKSCELVRLLKKQGHSVTVVMSRSATEFVSPLTFQALSGNPVLTDTHGGNGSNGMEHINLTRNADVFLIAPASMNTVAKICNGVADNLLTSLAAARKCPLAIAPAMNVEMWLNPANQRNIAQLVSDGITVYMPGLGEQACGENGMGRMPEPAELLDLLPDLWTPKILKGKKVLITAGATFEAIDPVRGITNISSGKMGVALARACRAAGAEVSLIHGQLQTALPFGISDTVQAVSAENMHRAVHRLIDKQDAFISVAAVSDYRVKNRSTQKFKKDKNAKPLSIELDENPDILASIASLPNPPFCIGFAAETENVMTYAREKRIKKKLPMIVANDVSIAMGKPTNRITIIGDDGELSFPETSKDEAAMRIVERLAVYLSK

SEQ ID NO: 10515 - protein, 359 aa, Neisseria meningitidis MC58
MNIQNIRTLLDTVAVPNTARTLGGEKAVRSVEQRSDGIHIALHFGFPVAHIASETADRIQEILMPETGDTHIHLSMDTEIGTHKVQPGVTTIKGVKNIIAVASGKGGVGKSTTTANLAAAMARMGARVGVLDADLYGPSQPTMLGVDDRKPDQKNQKLIPVESSDGIQVMSIGFLVDTDQAVVWRGPMVSQALQQLMFQSEWDEVDYLFIDLPPGTGDIQLTLSQRIPVTGSVIVTTPQDIALIDARKAVDMFRKVNIPILGVLENMSVHICTNCGHSEALFGTDGGKDFAARLNVPLLGQLPLSLPVREAMDGGTPAQLFDEHPAIARIYTDAAFQIALSIADKGKDFSSRFPKIVVE

SEQ ID NO: 10516 - protein, 637 aa, Neisseria meningitidis MC58
MNPSPLLDLIDSPQDLRRLDKKQLPRLAGELRTFLLESVGQTGGHFASNLGAVELTIALHYVYDTPEDKLVWDVGHQSYPHKILTGRKNQMHTMRQYGGLAGFPKRCESEYDAFGVGHSSTSIGAALGMAAADKLLGSDRRSVAIIGDGAMTAGQAFEALNCAGDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLKDLRSRKGPQLLHVITKKGNGYKLAENDPVKYHAVANLPKESAAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCVPNMIVAAPSDENECRLLLSTCYQADAPAAVRYPRGTGTGAPVSDGMETVEIGKGIIRREGEKTAFIAFGSMVAPALAVAEKLNATVADMRFVKPIDEELIVRLARSHDRIVTLEENAEQGGAGGAVLEVLAKHGICKPVLLLGVADTVTGHGDPKKLLDDLGLSAEAVERRVRAWLSDRDAAN

SEQ ID NO: 10517 - protein, 248 aa, Neisseria meningitidis MC58
MSTQDLNGKIALVTGASRGIGAAIADTLAAAGAKVIGTATSESGAAAISERLAQWGGEGRVLNSAEPETIESLIADIEKAFGKLDILVNNAGITRDNLLMRMKEEEWDDIMQVNLKSVFRASKAVLRGMMKQRSGRIINITSVVGVMGNAGQTNYAAAKAGLIGFSKSMAREVGSRGITVNCVAPGFIDTDMTRALPEETRQTFTAQTALGRFGDAQDIADAVLFLASDQAKYITGQTLHVNGGMLMP

SEQ ID NO: 10518 - protein, 480 aa, Neisseria meningitidis MC58
MKQLAMYINGRFENDFNGEWRDVLNPSTEEAIAREPKGGKADVDRAVAAARAAQPAWERLPAVERGAYLRKIAQGIRERADELTDTIVAEGGKTKDLARVEVMFTADYLDYQAEWARRYEGEIIQSDRPRENILLFKRPLGVIAGILPWNFPFFLIARKMGPALVTGNTIVVKPSSVTPINCHIFAEIVDAVGLPAGVFNVVNGPGAEIGNALSAHPQVDMVSLTGSVEAGRQVMEAASANITKVSLELGGKAPAIVLKDADLDLAVKSILASRVGNTGQICNCAERVYVHSSLKDAFIEKMTAAMKGVRYGNPAEAEAGALEMGPLIEERAVKAVAEKVERAVKQGAKLVCGGKRAEGRGYFFEPTLLTDTDNSMDIMKEETFGPVLPVSAFDTLDQVIALANDCEFGLTSSVYTTNLNEAFYVTRRLQFGETYINRENFEAMQGFHAGWKKSGIGGADGKHGLEEYLQTQVVYLETDI

SEQ ID NO: 10519 - protein, 414 aa, Neisseria meningitidis MC58
MTLFCEQVPYPRLAEAFGTPLYVYSQSALTEAFEHYQTAFAALNPLVCYAVKANGNLSIIKHFASLGSGFDIVSGGELARVLAAGGDAAKTIFSGVGKSEAEIEFALNAGVKCFNMESIPEIDRIQKVAARLGKTAPVSLRINPDVDAKTHPYISTGLKANKFGIAYADALEAYHYAAQQPNLKIIGIDCHIGSQLTDLSPLVEACERILILVDALAAEGIVLEHLDLGGGVGIVYQDENVPDLGAYAQAVQKLIGTRRLKLILEPGRSLVGNAGSLLTRVEFVKYGEEKNFVMVDAAMNDLMRPALYDAYHHIEAVETKDIATLTANIVGPICETGDFLGKDRTIACEEGDLLLIRSAGAYGASMASNYNARNRAAEVLVDGNEYRLIRRRETLEQQMANELACLQAEHQNAV

SEQ ID NO: 10520 - protein, 112 aa, Neisseria meningitidis MC58
MKKIEAIVKPFKLDDVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 10521 - protein, 485 aa, Neisseria meningitidis MC58
MSRHPAPTGEKTFFGHPFQLSTLFHIELWERFSFYGMQGILLIYLYYTADKGGLGIDKTLAGGIVGAYSGSVYLSTILGAWFADRVWGAEKTLFLSGIVVMLGHIVLAAAPGLYGLLIGLIFIALGSGGVKSTASSMVGALYEQDEMRPLRDAGFSIFYIAINIGGFLGPLLTGLLQENIGFHYGFGAAAVGMAFGLWRYSLGRKNLPHPTVPHPLSKGQGKTAAAVGIALIAALATAIKTGLVNLDNFSGILLSTVILAVIAYFARLLTNPRVSSDNKRHIIAYIPLFLTICMFWAVWFQIYTVATVYFDETVNRTIGSFTVPVAWKDSMQSLWVILFSGLMAAMWTKMGRKQPKTPLKFAMAVFVTGASFLGFVPFISSGTPMPIAVFALIVLAITIGELMISPIALSISTKIAPPLFKTQMVALNFLAFSLGFTLGGVLFEKGYQAGDEIGFYRLLFYIGAATGFLLLLLVPKLNKMLEGTD

SEQ ID NO: 10522 - protein, 192 aa, Methanothermobacter thermautotrophicus str. Delta H
MAHGPRYKLAFRRRREGKTDYRARYKMVETGKSRLVVRITTYHVIAQIINVGMNGDETLVSAHSKQLQKMGWLGGTSNTAAAYLTGYLCGKRALKEGIEEAVLDIGLRPAIRGSKVFAALKGAVDAGLNVPHGESVLPDESRIRGEHIMEYAESLDEEELRKRFSKYLERGLSPVDLPEHFDEIKKRIDEEV

SEQ ID NO: 10523 - protein, 416 aa, Methanothermobacter thermautotrophicus str. Delta H [sequence omitted]

SEQ ID NO: 10524 - protein, 484 aa, Methanothermobacter thermautotrophicus str. Delta H
MYRKKLTEAETGYTFDDFLLLPQASYVEPRDVETAGRVSRNIELKIPVISSAMDTVTEYDMAIAMAQEGGMGVIHRNMSIRDQVEQVKKVKRSGDITIRDVITISPDSTLREAHEIMDQEEISGLPVVEDGVLIGIISRRDIEPIFNSDADKKVDQVMTRDVVTVDESITPNEALDIAYENKVERLPVVKDGRIVGMLTMKDILERKRYPNASRDSEGYLRVAAATGPFDLERARALDEAGADVLAIDSAHGHNMNLVKSAGAMKKEIEADLIVGNIATREAAEDLIAQDVDGLKVGIGPGSMCTTRIIAGVGVPQLTAIAEVADVAAEYGVPVIADGGIRYSGDIAKAIAVGADCVMLGNLLAGTYEAPGDVVVMNGRKYKQYRGMGSLGAMTGGIGAGTDRYFQEPRGHMKHTKVVPEGVEGVVPYRGTVSEVLFQLIGGLRASMGYCGAANLSEMKERAKLVRITSSGYQGEPPPRPPHNQ

SEQ ID NO: 10525 - protein, 298 aa, Methanothermobacter thermautotrophicus str. Delta H
MRFDAVGLGALNMDQLHMVERIAGPDEETFVRGLVESCGGSAANTMIGLSRLGLRTAHIGKVADDREGGLLRSNLSSEGVTDFTVVADTGRSGRVMGFVDPDGNRALYVDPGVNDTLRVDEVADEALNTELLHLTSFAGDGINVQVEVIEALDESVTVSLDPGHIYASRGVSELSDILERTDILLTNQRELELMTGSADPEEAASLLGIGVVVVKMGARGVRAWDGESVMVDALSTECVDTTGAGDAFNAGFIYAWLEGFGLEVSCRFGNYIASRCIGGYGATESLPGTGPGCPQEVR

SEQ ID NO: 10526 - protein, 115 aa, Methanothermobacter thermautotrophicus str. Delta H
MKTMRKITAIIRREKLEDVKDALELMGIHGMTVSDVKGRGQQMGIRESYRGMDYCVDLLPKVQLEIVVDSEDLERTVEAISENARTGDVGDGKIFVTDVIDVVRIRTGEHGRDAI

SEQ ID NO: 10527 - protein, 115 aa, Methanothermobacter thermautotrophicus str. Delta H
MIFMKEIVAIIRPEKLEEVKNALEAAGCHGMTVTEVRGRGRQLGITESYRGRDYRIDLLPKTKIEIVVNDEDVDTVVETIVKSAQTGDIGDGKIFISGVDEVVRIRTGESGKKAV

SEQ ID NO: 10528 - protein, 343 aa, Methanothermobacter thermautotrophicus str. Delta H
MLSYPGELQGCRVILYLVGHHLYLIPTTISMCGCPEEGAYMRRLWGYISIITATIFFGISATLDKIMLSSMHPVTIGAYTYIIAGIFLFFIRETPLREHVLNAINRKGESEARIKRNDYLILLLTALLSTVIAPLLFLTGLGDTTAVNASLILNVEVLFIILLGYLIFRETLQLKDFLGIVLIILGAVYLLTEGDFSTILRNVAVTGNFLVMAAAFFWSLDTVLSKFLSRKRDLIFISGVKSSVGGFVLLIIMLILGINTELPLEMLPYALGVSVFSIGCSFILIYIAIREIGASMVGALFPLSSLFGAIFAFIILREPFSIMQGISGIVMLTGVFILYWNGK

SEQ ID NO: 10529 - protein, 455 aa, Methanothermobacter thermautotrophicus str. Delta H
MEMIIDGEGVSGEKIFTVRNPFNGDEVDRVPLAGRSDVERAIRAAHRARDAMADLSARKISEKLYDVADELKTELDEFARLITLESGKPIRFSRDEVKRSVETARLSAEEAGRLYGESIPMDAGIGGKGLTGFTVRIPLGVVAAITPFNYPLNLAIHKVGPALAAGNTTILKPSLEAPLSALKLAWILSEHFPAGAVNAVTGRGSEVGDVIIDSPLVDKITFTGSVEVGRYISARASMKKITLELGGNDPLIVMDDADIDSAVEAAVRGSYLYSGQVCIAVKRMIVHEDVADEFADKLVNITGSLRAGDPMDVRTDVGPLINEDAAIEVERVIGAAVEDGAELLCGGSRRGNFVEPTVLDHVVPGMEVIERETFGPVSPIIRFNGADEAIRIANGTCYALQAGVFTENIRTALRMAREIEAGTVLVNKQSTFRVDHMPFGDSGAVEWVRRVSSTP

SEQ ID NO: 10530 - protein, 363 aa, Methanothermobacter thermautotrophicus str. Delta H
MTYTSGRILGSMCTSSHPLARRVYCDFLESNLGDPGLFRGTRELESGVIGMLGELLSEPDAAGHIITGGTEANLMAMRAARNMAGAEKPEIIVPKSAHFSFRKAADILGLRLREAELDQDYRVDVESVRKLISENTVAVVGVAGTTELGRIDPVEELSEICLDEDIHLHIDAAFGGFIIPFLRETGAELPEFDFKLQGVSSITVDPHKMGLAPIPSGCILFRDASYLDAMSIETPYLTEKQQSTIVGTRTGASAAATWAIMKHMGREGYRKLALRVMGVTRRLRDGLVELDYQLVVEPELNIVAFNHPAMGPHELADRLEELGWAVSVSSCPPAIRVVLMPHIMEEHIELLLRDLEGIRLREE

SEQ ID NO: 10531 - protein, 684 aa, Methanothermobacter thermautotrophicus str. Delta H
MTGARNWLNKPLIFFKFNNHHTASPGDKMVKYVAFFEELGKDDVGIAGGKGANLGELTQAGIPVPPGFVVTAATYDKFMTDTGLQPVVMEMLENLDVNDTKELQRVSAEIKDIITSTEVPEDIQTLIIESYNALCQRIGKDDVYVAIRSSATAEDLPEASFAGQQDTFLNIRGAEDVLDYVRRCWASLFEARAIFYREENNFDHSKVYIAVVVQEMVDAEKAGVMFTVHPSTGEDRILIEGSWGLGEAVVSGSVTPDTYWVDKGTGKLLEFTVGEKNIMFTREDGRTVKKEVPPELRNKRVLSDGEIAALAEMGRRIQDHYGSPQDTEWAIMDGDVYMLQSRPITTLGEATEETEVKSREILVKGLGASPGLASGRVKIIREIHELDKIQIGDILVTVMTTPDMVPAMKRASGIITDEGGVTCHAAIVSRELGIPCVVGTGNATEVLKENQVVSIDGNRGLVYEGSVIEGEKKEAEAETVTVESPLLTVTEVKVNVSMPEAARKAAATGADGVGLLRTEHMMLTTGVHPRKFIEEGREDELVNTLAENILKVADEFYPRPVWYRTLDAPTDEFKTLEGGENEPYEHNPMLGWRGIRRELDEPEILRAEFRAIKKLHEQGYTNIGIMIPLVQHPDELRKAKMIAEEAGLKPHRDVEFGIMVETPAAALIIEDFIEEGIDFVRLEP

SEQ ID NO: 10532 - protein, 276 aa, Methanothermobacter thermautotrophicus str. Delta H
MRCIMTEDAQKLAIMEQDVKIVRALSKIKHKIVVMSGKGGVGKSTVTVKLAEEFSRNGYSVCVLDADVHGPDIPKMMRVREPEITLTGNLINPIPTPVGATVMSIEFFLPSEDTPVIWRGPKKTGAIRQLLADVNWEGIDVLIVDNPPGTGDEPLTVLQSIPGIDGVVIVTTPQEVSIHDVEKCINMVNHLKIPVLGIIENMSYLQCPECGKKVFLFGKDGGKYLADKFDLQFLGEIPFETGISGDNESSASSYINNEMVKIFNKLAKYLKDGGAN

SEQ ID NO: 10533 - protein, 428 aa, Methanothermobacter thermautotrophicus str. Delta H
MFPDIEVNDKGHLLIGGADAVELADEYGTPLYVIDEMRIRENYRRLYRAFSGEYSRFQVFYACKANTNLAVMRILEEEGSGIDAVSPGEIYTALMAGFDPDRILYTGNNVRDDELQFALDSGVRINVDSRSQLLRLSEIAPEGLRISFRVNPLVGAGHHEHCITGGEMSKFGVMEREAPEVYRMAMDLGFEPVGIHAHIGSGILDPEPFMLAVETLMDIAGRVHEATGVEFEFIDFGGGLGIPYTPEEEPLDIDEFASKITGLFKDKLSEYGLGRPMMCLEPGRYIVGDASYLLTRVNTIKESYRKFAGVDAGFNTLLRPAMYGSYHHILVAERPLDEPSEKMDVAGNVCESGDLFARDRQLPEINEGDVLAIMNAGAYSFSMSSQYNSRPRPAEVLVREGKVDVVRERETFSDLLRGQNVPARLLKR

SEQ ID NO: 10534 - protein, 108 aa, Methanothermobacter thermautotrophicus str. Delta H
MLKMKMIRAIIRPEKSEEVIDALDKAGFPALTKMDVAGRGKQRGIRLDEIYYEELPKTMLLIVVDDSDAEKVINTVHETAFTGNIGDGKIFVSPVESAYTIRTREEGL

SEQ ID NO: 10535 - protein, 122 aa, Methanothermobacter thermautotrophicus str. Delta H
MKEIIAIIRSNKMKKTRDVLEVLGFPAMNARRVLGRGHQRAIIDDVNIPFPPEGIEESRGTMRYIPKRMISIMVEDRDVELVVEAIMKVNHTGNIGDGKIFVCPVDDAVRIRTGENGDVALQ

SEQ ID NO: 10536 - protein, 417 aa, Methanothermobacter thermautotrophicus str. Delta H
MPYKVKDISLAPQGEKKIRWVQEHMPVLERIKSDFSEEKPFKGVTIGSCLHLEPKTINLGLTLQAGGAEVAMTGCNPLSTQDDATAAGAKMGLNMYGWRGETNEEYYENIHRVLDHEPEILIDDGADMIFLVHRERPELLDGIIGACEETTTGINRLRAMAADGALKFPVMAVNDAYTKYLFDNRYGTGQSTFDSIMGTTNMLIAGKTVVVCGYGWCGRGIAMRAEGLGASVIVTEVDPIRALEARMDGFRVMKVSDAVKEADILITATGNTDVVSESEFMNMKDGCVMANSGHFNVEINREALEELSRETGKVKEDIEVFIMPDGRKIYLLAEGRLVNLASERGQGHPAEIMDMSFAMQALSARHLLQEKPDPGVYRAPDEIDLMVARMKLDAMGIEIDELTEKQRLYLENWEEGT

SEQ ID NO: 10537 - protein, 336 aa, Methanothermobacter thermautotrophicus str. Delta H
MAHVAEWKKKEVQELHDLIKGYEVVGIANLADIPARQLQKMRQTLRDSALIRMSKKTLISLALEKAGRELENVDSLSDYMEGQPALIFTDMNPFKLFKILEDSKTPAPAKPGAIAPDDIVVPKGDTGFAPGPILGELQQIGIPAKIEKGKIVVSNDHVVVKAGEEIPPKVAGILTRLDIQPLEVGIDLRAAYENQTVYTADVLTIDEEKTLSDIQKAFSQAFNLSVNAVIYTRETMPAIIQKAASKSFNLAYNASILTSETTDLLLAKAYAQMLALAAAAAEINDEAVDDELKEKLSSRAAAPAPEEKEEEVEEEAEEEEEEEEEDAAAGLGALFG

SEQ ID NO: 10538 - protein, 475 aa, Lycopersicon esculentum
MALNLLSPAEIKSISFLDNSKSSYNLSHLKFTGGLSIRRKECSGAFAKRVQCSAQLPPPPAWPGRAVAEPGRQSWDGPKPISIVGSTGSIGTQTLDIVAENPDKFRVVALAAGSNVTLLADQVKTFRPKLVAVRNESLVEELKDALADMEDKPEIIPGEQGVIEVARHPDAVTVVTGIVGCAGLKPTVAAIEAGKDIALANKETLIAGGPFVLPPAHKHKVKILPADSEHSAIFQCIQGLPEGALRRIILTASGGAFRDWPVEKLKEVKVADALKHPNWNMGKKITVDSATLFNKGLEVIEAHYLFGAEYDNIEIVIHPQSIIHSMVETQDSSVLAQLGWPDMRLPILYTLSWPDRVYCSEITWPRLDLCKLGSLTFKAPDNVKYPSMDLAYSAGRAGGTMTGVLSAANEKAVELFISERISYLDIFKIVELTCAKHREELVSSPSLEEIIHYDLWARDYAASLEPSSGLSPALV

SEQ ID NO: 10539 - protein, 204 aa, Homo sapiens [sequence omitted]

SEQ ID NO: 10540 - protein, 117 aa, Beta vulgaris
GEGTYGVVYKARDKVTNETIALKKIRLEQEDEGVPSTAIREISLLKEMQHGNIVRLQDVVHSEKRLYLVFEYLDLDLKKHMDSSPDFAKDPRMIKRFLYQILRGIAYCHSHRVLHRD

SEQ ID NO: 10541 - protein, 411 aa, Cricetulus longicaudatus
MPRERKERDAQDHGGIREEGGPDSSVRSRKRKANVAVFLQDPDEEIARVDKTVKSQDSSQPWDDNSACVDPCAFTPTPNKEEDDELEYPKTAFQPRKIRPPRASPLPVLNWGNREEVWRIMLNKEKIYLRDEHFLQRHPLLQARMRAVLLDWLMEVCEVYKLHRETFHLAQDFFDRYMASQQNILKTLLQLIGISALFIASKLEEIYPPKLHQFAYVTDGACSGDEILQMELMMMKALKWRLSPMTIVSWLNVYVQVAYVNDTSEVLLPQYPQQVFVQIAELLDLCVLDVGCLEFPYGVLAASALYHFSSMELMQKVSGYQWCDIEKCVKWMVPFAMAFREVGSSKLKHFRGVPMENAHNIQTHANSLDLLDKAQAKKAILSEQNRIPPPPSGVLTPPPSSKKQNSEEETE

SEQ ID NO: 10542 - protein, 401 aa, Ciona savignyi
MEIEADKPIGYGAFGVVWAVKDPRDGKQVALKKMPNVFHNIMSAKRVLRELKMLCYFNHENVLSAVDVLPPVDSPYEEMYVITQLMHTDLHKIIVSQQALTTDHIRLFLYQILRGVKYLHGARILHRDIKPGNLLINSDCRLKICDFGLARLEEPDESKYMTQEVVTQYYRAPELLLGARHYGNAVDIWSIGCIFAELLSRRILFQANSPVTQIDMIYNLLVDSNVAPSQQFSHRSNSTLDMEARAQLYQSVSRLPAAPSTFYHLAPNMTHEAAHLISRLLVWDPSKRVSCTEALRHIYLREGRLRYHTSLCRCCCITAEGIRHAADHEFEAMPDIVFDDSYEDDLRTVDDVRNAVTDFINSQPCGRKAPLRINPNSAVFPRFVASTVAHSHPVPTSSKMA

SEQ ID NO: 10543 - protein, 491 aa, Drosophila melanogaster
MASFQIHQDMSNKENPGIKIPAGVKNTKQPLAVIGGKAEKNALAPRANFAVLNGNNNVPRPAGKVQVFRDVRNLNVDENVEYGAKKSNVVPVVEQFKTFSVYEDNNDTQVAPSGKSLASLVDKENHDVKFGAGQKELVDYDLDSTPMSVTDVQSPMSVDRSILGVIQSSDISVGTETGVSPTGRVKELPPRNDRQRFLEVVQYQMDILEYFRESEKKHRPKPRYMRRQKDISHNMRSILIDWLVEVSEEYKLDTETLYLSVFYLDRFLSQMAVVRSKLQLVGTAAMYIAAKYEEIYPPEVGEFVFLTDDSYTKAQVLRMEQVILKILSFDLCTPTAYVFINTYAVLCDMPEKLKYMTLYISELSLMEGETYLQYLPSLMSSASVALARHILGMEMWTPRLEEITTYKLEDLKTVVLHLCHTHKTAKELNTQAMREKYNRDTYKKVAMMESVEMSKDDFDQLCEAYNCKQKEDEHQQPDINTKSNVNLFYKF

SEQ ID NO: 10544 - protein, 490 aa, Drosophila melanogaster
MAAPAACTRFSDNYDIKEELGKGAFSIVKRCVQKSTGFEFAAKIINTKKLTARDFQKLEREARICRKLHHPNIVRLHDSIQEENYHYLVFDLVTGGELFEDIVAREFYSEADASHCIQQILESVNHCHQNGVVHRDLKPENLLLASKAKGAAVKLADFGLAIEVQGDHQAWFGFAGTPGYLSPEVLKKEPYGKSVDIWACGVILYILLVGYPPFWDEDQHRLYSQIKAGAYDYPSPEWDTVTPEAKNLINQMLTVNPNKRITAAEALKHPWICQRERVASVVHRQETVDCLKKFNARRKLKGAILTTMLATRNFSSRSMITKKGEGSQVKESTDSSSTTLEDDDIKAARRQEIIKITEQLIEAINSGDFDGYTKICDPHLTAFEPEALGNLVEGIDFHKFYFENVLGKNCKAINTTILNPHVHLLGEEAACIAYVRLTQYIDKQGHAHTHQSEETRVWHKRDNKWQNVHFHRSASAKISGATTFDFIPQK

SEQ ID NO: 10545 - protein, 606 aa, Caenorhabditis elegans
MKPISKWCPDSSLLIIVGLALGWILHQTSLSGATLDSHTFFLYLLPPIIFDAGYFMPNRALFENFDSVLVFSVFGTIWNTFAIGGSLLLMAQYDLFTMSFTTFEILVFSALISAVDPVAVIAVFEEIHVNEFLFINVFGEALFNDGVTVVLYQMFKSFALIGSENLSVLDYATGGLSFFVVALGGAAVGIIFAIAASLTTKYTYDVRILAPVFIFVLPYMAYLTAEMVSLSSIIAIAICGMLMKQYIKGNVTQAAANSVKYFTKMLAQSSETVIFMFLGLSTISSQHHFDLYFICATLFFCLIYRAIGIVVQCYILNRFRAKKFEMVDQFIMSYGGLRGAIAYGLVVSIPASITAKPMFITATIAVIYFTVFLQGITIRPLVNFLKIKKKEERDPTMVESVYNKYLDYMMSGVEDIAGQKGHYTFIENFERFNAKVIKPVLMRHQKRESFDASSIVRAYEKITLEDAIKLAKVKNNIQNKRLERIKSKGRVAPILPDKISNQKTMTPKDLQLKRFMESGENIDSLYTLFSDLLDRKLHEMNRPSVQITDVDGQDDIQDDYMAEGSRSNLSAMFRSTEQLPSETPFHSGRRQSTGDLNATRRADFNV

SEQ ID NO: 10546 - protein, 350 aa, Trypanosoma brucei
MPDYSRVPSTLMQFLMHNQPKGSRGAFTLLMMAIQTSVKVIEMNIRSAGAQGLFGHLNDGRANATGDAQAKLDVVANNAFKAYLMSSASVSFMGSEEDESIVVVSSGQQGDYVVFFDPLDGSSNIDANISIGSVWGIWCLPKGTKVRTTKDALKVLPRLSGRYLVSSGYAMYGTATNLVITTGSGVNGFTLDTTVGEFIHTHPNITLPQSRPIYSVNEGNLRHWDAWFKQYLHHIKNEGEKAYTARYIGSMVADIHRTLLYGGIFCYPGDKKKPGGKLRLMYEAAPMAFLIEQAGGLALTGDGRLLDVVPKEIHQRAPVFMGSRREVELCMSFKQKYNDRGGVQRERSKL

SEQ ID NO: 10547 - protein, 506 aa, Oryza sativa (japonica cultivar-group); identical to SEQ ID NO: 897

SEQ ID NO: 10548 - protein, 367 aa, Cucumis melo
MPNLTPFSKLDKTFDRASELKAFDQTKAGVKGLVDSGVAEIPGIFYCPPKEASNSIPEETHLGVPVVDLGDIDKDPFKRRQVVEEIREASETGGFFQVINHGVPVSVQEEIINRVRRFFEQDSEVKKQYYTRDYTKSFIYNCNFDLFSSPVANWRDTIVTVMAPNPPNPHDLPQVCRDILFEYSKHIMKLGELIFGLLSEALGLKSTHLVDLDCNEGLRIIGHYYPSSPQPELSIGTTEHSDDTFITVLLQDNMGGLQVRQQNKWVDVPPVPGAFVINVGNLLQLITNDRFVSSEHKVLANREGPRISVASFFSTGRLPTSKLYGPIKELLSEQNPPKYKEITVREYNIYFAEKGLDGTSALPHFKI

SEQ ID NO: 10549 - protein, 335 aa, Homo sapiens [sequence omitted]

SEQ ID NO: 10550 - protein, 297 aa, Mus musculus
MEDYIKIEKIGEGTYGVVYKGRHRVTGQIVAMKKIRLESEEEGVPSTAIREISLLKELRHPNIVSLQDVLMQDSRLYLIFEFLSMDLKKYLDSIPPGQFMDSSLVKSYLHQMLQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRALGTPNNEVWPEVESLQDYKNTFPKWNPGSLASHVKNLDENCLDFLSKMLVYDPAKRISGKMALKHPYFDDLDNQIKKM

SEQ ID NO: 10551 - protein, 199 aa, Drosophila melanogaster
FLDDLDRLGAKDYQPTEQDILRTRVKTTGIVEVHFSFKNLNFKLFDVGGQRSERKKWIHCFEDVTAIIFCVAMSEYDQVLHEDETTNRMQESLKLFDSICNNKWFTDTSIILFLNKKDLFEEKIRKSPLTICFPEYTGGQEYGEAAAYIQAQFEAKNKSTSKEIYCHMTCATDTNNIQFVFDAVTDVIIANNLRGCGLY

SEQ ID NO: 10552 - protein, 620 aa, Legionella pneumophila
MTMNDQDQQSSQITKVISLGKEQGYLTYSQINDLLPNIVDTEHFDVIISMLEGMNIKVFELPPSEDELALLLNTEEVPDIEEAAMVLASVDKETGRTTDPVRMYMREMGTVELLTREGEIRIAKRIEEGIYQVLKSLAHYPETVQLVLEDYDRFLAEEIRLNEIISGFADVDEEIAPATNIGSMLDEEQQEEILLDVDEEDEDGEGGISDVDDGPNPEQAKIYFDELREAFEKAMKALKEHGRTNKKTVELLDSMSESFLKLKLTSRQVDKLTRHFRQLRNHIREFERSIMRLCIEKARIPRKLFIDTFPGQETDLGWLETIISKHAKKLDLQRIEENREEILRLQSKLASFEIEYGLTISEIKDINRKMSIGDEARRAKKEMVEANLRLVISIAKKYTNRGLQFLDLIQEGNIGLMKAVDKFEYRRGYKFSTYATWWIRQAITRSIADQARTIRIPVHMIETINKLNRISRQILQETGREATPEELAEKMELSEDKIRKVLKIAKEPISMETPVGDDDDSHLGDFIEDNNIESPIDMATAEGLREATLEILETLTPREAKVLRMRFGIEMNTDHTLEEVGKQFDVTRERIRQIEAKALRKLRHPSRSEKLRSFLEGDEG

SEQ ID NO: 10553 - protein, 216 aa, Drosophila melanogaster
MDGLLLDTERLYTVATEMILEPYGKTYPFEIKEQVMGLQTEPLARFMVEHYELPMSWEEYARQQRANTEILMRNAQLMPGAERLLRHLHANKVPFCLATSSGADMVELKTAQHRELFSLFNHKVCGSSDKEVVNGKPAPDIFLVAAGRFGVPPKPSDCLVVQDSPNGVTAANSAGMQVVMVPDPRLSQEKTSHATQVLASLADFKPEQFGLPAFTD

SEQ ID NO: 10554 - protein, 75 aa, Drosophila virilis
MSGRGKGGKVKGKAKSRSNRAGLQFPVGRIHRHQRKGNYAERVGAGAPVYLAAVMEYLAAEVLELAGNAARDNKK

SEQ ID NO: 10555 - protein, 33 aa, Drosophila virilis
MTGRGKGGKGLGKGGAKRHRKVLRDNIQGITKP

SEQ ID NO: 10556 - protein, 265 aa, Lycopersicon esculentum
MEVQKRKWRRISKISTDISLINSLDDGCLMHIFSFLSPIPDRYNTALVCHRWRFLACHPRLWLRVDRAVKDLSQPGVYPNIEMAVSAARPGDTILIAAGGSHHVSNIQIEKPLCLIGAGESPDDTTLICSRGSDSALEFMSTCKLANLTVRTELGCCLLHRSGKLTVDGCILQCESNPLDHLSYAIISTAGAAEVIPSALKTCSDAVSVLKTQIAGGAKAVLTSGTLSLQRVRVIYTRTSLFFWFEVEGSDKNTVQSAPVELPIS

SEQ ID NO: 10557 - protein, 255 aa, Nicotiana tabacum
MAREENVYMAKLAEQAERYEEMVSFMEKVSTSLGTSEELTVEERNLLSVAYKNVIGARRASWRIISSIEQKEESRGNEDHVKCIQEYRSKIESELSNICDGILKLLDSCLIPSASAGDSKVFYLKMKGDYHRYLAEFKTGAERKEAAESTLSAYKAAQDIANAELAPTHPIRLGLALNFSVFYYEILNSPDRACNLAKQAFDEAIAELDTLGEESYKDSTLIMQLLRDNLTLWTSDMQDDGADEIKETKADNEQQ

SEQ ID NO: 10558 - protein, 261 aa, Nicotiana tabacum
MASSKERENFVYVAKLAEQAERYDEMVDAMKSVANMDVELSVEERNLLSVGYKNVVGSRRASWRILSSIEQKEESRGNEQNVKRIKEYRQKVETELTSICNDIMVVIDQHLIPSCTAGESTVFYHKMKGDYYRYLAEFKSGNDKKEVAELSLKAYQSATTAAEAELPPTHPIRLGLALNFSVFYYEIMNSPERACHLAKQAFDEAISELDSLNEDSYKDSTLIMQLLRDNLTLWTSDLPEDAEDAQKGDATNKAGGGEDAE

SEQ ID NO: 10559 - protein, 204 aa, Nicotiana tabacum
MAVAPTAREENVYMAKLAEPAEMYQEMVEFMEKVSNSLGSEELTVEERNLLSVAYKNVIGARRASWRIISSIEQKEESRGNEEHVNSIREYRSKIENELSKICDGILKLLDAKLIPSAASGDSKVFYLKMKGDYHRYLAEFKTGAERKEAAESTLTAYKAAQDIATTELAQTHPIRLGLALNFSVFYYEILNSPDRACNLAKQA

SEQ ID NO: 10560 - protein, 520 aa, Trametes versicolor
MSRFHSLFAFVVASLTAVAHAGIGPVADLTITNAAVSPDGFSRQAVVVNGGTPGPLITGNMGDRFQLNVIDNLTNHTMLKSTSIHWHGFFQKGTNWADGPAFINQCPISSGHSFLYDFQVPDQAGTFWYHSHLSTQYCDGLRGPFVVYDPNDPAADLYDVDNDDTVITLVDWYHVAAKLGPAFPLGADATLINGKGRSPSTTTADLSVISVTPGKRYRFRLVSLSCDPNYTFSIDGHNMTIIETDSINTAPLVVDSIQIFAAQRYSFVLEANQAVDNYWIRANPNFGNVGFTGGINSAILRYDGAAAVEPTTTQTTSTAPLNEVNLHPLVATAVPGSPVAGGVDLAINMAFNFNGTNFFINGASFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDARDPSDQ

SEQ ID NO: 10561 - protein, 377 aa, Solanum tuberosum
MSVAELKERHMAATQTVNDLREKLKQKRLQLLDTDVSGYAKTQGKTPVTFGPTDLVCCRILQGHTGKVYSLDWTPEKNRIVSASQDGRLIVWNALTSQKTHAIKLPCAWVMTCAFSPSGQSVACGGLDSACSIFNLNSPIDKDGIHPVSRMLSGHKGYVSSCQYVPDEDTHLITSSGDQTCVLWDITTGLRTSVFGGEFQSGHTADVSSVSISSSNPKLFVSGSCDTTARLWDTRVASRAQRTFHGHESDVTTVKFFPDGNRFGTGSDDGSCRLFDIRTGHQLQVYNQPHGDGDIPHVTSIAFSISGRLLFVGYSNGDCYVWDTLLAKVVLNLGSVQNSHEGRISCLGLSADGSALCTGSWDTNLKIWAFGGHRSVI

SEQ ID NO: 10562 - protein, 355 aa, Homo sapiens [sequence omitted]

SEQ ID NO: 10563 - protein, 709 aa, Homo sapiens [sequence omitted]

SEQ ID NO: 10564 - protein, 454 aa, Botryotinia fuckeliana
PGPTLYADWGDMIQVTLKNSMPDNGTGIHWHGLRQYHTCTEDGVPGITECPLAPGDTKTYTFQATQFGTSWYHSHYSSQYGEGMLGGIVINGPATSNYDVDLGVYTISDWYYTPVFALGERIAHSQAGPPSGDNGLINGSMVAPAGQTGGKYTTNTITAGKKYRLRLINTSVDNHFMVSLDNHAFTVITSDFVPIVPYTANWIFIGIGQRYDVIITANQTVGSYWFRAEVQNGCGTNNNNGNIKSIFTYSGAASTTPSSSATPYTGRCTDETGIIPFWDSFVPSGPLSGNVEQLNVAINIGVDASGPIVTWGINLSAIDVDWKKPILQYVLDGNNSWPASENLIELPNAAQWYYWVIQEVPGNVNGNPVSINVPHPMHLHGHDFFLLGTGVGTYNNTINGPSLDYDNPTRRDVAMLPAGGWMVLAFQTDNPGAWLMHCHIAWHVSEGLAVQFQG

SEQ ID NO: 10565 - protein, 454 aa, Saccharomyces cerevisiae
PGSPSYNGLGLTPQMGWDNWNTFACDVSEQLLLDTADRISDIGLKDLGYTYVILDDCWSSGRSSNGTLVADKEKFPNGMSHVADHLHNNSFLFGMYSSAGEYTCAGYPGSLGHEEGDADFFASNGVDYLKYDNCYNKGQFGAPETSYNRYKAMSDALNKTGRPIFYSLCNWGQDLTFYWGSDIANSWRMSGDIYPEFTRPDSRCPCDGDQFDCAYAGFHCSIMNILNKAAPMGQNAGIGGWNDLDNLEVGVGNLTDDEEKAHFSMWAMVKSPLIIGADVNQLKASSYSIYSQASIIAINQDPKGVPATRVWRHQVPQTDKYGQGEIQFWSGPLDNGDQMIALLNGGSKARSMNTNLEEIFFDSYLGSEQLTSSWDIYDLWANRVDNATSSSILTNNSVGNATIYNATALSYKDGLAKNDTRLFGTKIGSISPDGLLNTTVPAHGIAFYRLRPSS

SEQ ID NO: 10566 - protein, 126 aa, Campanula carpatica
ECAFWMPARSGSILQLSHSLHNLIPFGSTVPMNLPIVHEVFNSAEAIRIPHTCLLARIRPPVGRYNPPEVVAVRVPLLHLSNFQINDWPDLSAKDYAVMVLILPLNGVRNWRDHELELVEVVADQV

SEQ ID NO: 10567 - protein, 172 aa, Campanula carpatica
ECALWMPARSGSILQLSHSLHNLIPFGSTVPMNLPIVHEVFNSAEAIRIPHTCPLARIRPPVGRYNPPEVVAVRVPLLHLSNFQINDWPDLSAKDYAVMVLILPLNGVRNWRDHELELVEVVADQVAVALSHAAILEESMRARDQLMEQNIALDLARQEAELAIRARNDFLA

SEQ ID NO: 10568 - protein, 178 aa, Campanula carpatica
ECALWMPARSGSDLQLSHSLHNLIPFGSTVPINLPIVNEVFNSAEAIRIPHTCPLARIRPPVGRYNPPEVVAVRVPLLHLSNFQINDWPEMSAKDYAVMVLILPLKGVRNWRDHELELVEVVADQVAVALSHAAILEESMQARDQLMEQNIALDLARQEAEMAICARNDFLAVMNHEM

SEQ ID NO: 10569 - protein, 333 aa, Halobacterium sp. NRC-1
MARLLSELQPSEFDITVVAIADTPPDVVSMLPDHVEVKHLKMTRRTALLQLGEISKIVKSTDILVCSLFHATAIGVPLGLLLQVPKLLVWQHSTSYSNQIRSAYYRLAYRAADRVLADSDAVMEMLVDSVGVPDQKISTLPIAGIDVKEYQPSKTHPSHENITVSTVGRLANVKGYDDLIRCARDIGDDLQFQIAGEGEERERLESKTPDNVNFQGMVPNEQIPQFLNNSDIYFQPSKYEGLCMAVIEAMACGLPVVASDVGGITESVVPGETGFLCRPRDIDCFSERLQQLSENPALRKQMGTAGRKRVISEYSQKALARQFRKAIDQTETV

SEQ ID NO: 10570 - protein, 355 aa, Halobacterium sp. NRC-1
MTRGEARRPPQEFDRVLSSMCTTPHPAAREAAQAFLATNPGDPETYPAVAERERDAVALLGEIVGLSSPHGYIAAGGTEANLQAVRAARNRADADAVNVVAPASAHFSFQKAADVLGVELRLAPTDGDHRADVAAVADLVDGDTAVVVGVAGTTEYGRVDPIPALADIAAGVDANLHVDAAWGGFVLPFTDHDWSFADAPVNTMAIDPHKMGQAPVPAGGFLARDPETLDALAIETPYLESDTQPTLGGTRSGAGVAGALASLRALWPDGYREQYERTQGNAEYLAAELAARGYDVVDPELPLVAADMPDAEFQALREEGWRISRTASDALRVVCMPHVTREMLAAFLDDVDALA

SEQ ID NO: 10571 - protein, 752 aa, Halobacterium sp. NRC-1
MAVRWLEDVRADDIDSVGGKGASLGELTDAGLPVPPGFVVTAGTYRTFIEEAGIDQELFDAVGVDAEDSDALADAAARASDLILNTDFPASLREDILSSYDALDDGAAFVAVRSSATAEDLPDASFAGQQETFLNITREALLDHVKRCWASLFTERAIYYRQEQGFDHDRVNIAVVVQRMVDAEKSGVLFTSHPSTGAHEAIVEAAWGLGEAVVSGAVSPDNYVVDRDTDTVEEATVADKKVMHVKDDDTGETVSRDVPDRKRTQRVLDDGEISDLVTIGERVEAHYDAPQDVEWAIVDGDVYMLQSRPITTIEDDTDGAVANTDGGGGDAVVTGLGASPGVASGPARVVTSLDELDKIGEGDIIATEMTTPDMVPAMKRAAGIVTDEGGMTSHAAIVSRELGCPAVVGATDATTTLCDDQAVTLDGDRGVVRDGREETTTEHDPIEDARPTTPVKPMTATEVKVNVSIPEAAERAAATGADGVGLLRMEHMILSTNKTPKRYIDDHGEDAYVQELVDGIRGVAEEFYPRPVRVRTLDAPTDEFRQLEGGNDEPHEHNPMLGYRGVRRSLDRPDVFKHELSAFRRLYEMGYDNVEVMFPLVNDAQDVARARDLMADAGIDVEKRSWGVMIETPAAALAIEEIAQEGVDFASFGTNDLTQYTLAVDRNNGSVADRFDELHPSVLTLIERTIDACREHDVATSICGQAGSKPEMVDFLVETGVSSISANIDAVRDVQHEVKRVEQRLLLESARE

SEQ ID NO: 10572 - protein, 277 aa, Halobacterium sp. NRC-1
MRMAQDTQQRAAVVEEMPEFGLGTWENEDPSACADSVRTALEMGYRHIDTAQIYENEDAVGDGIAAADVDREDVFLATKVWTSELGDGDVAPATEQSLEKLGVDYVDLLYVHWPANQYDATETLAALADLQADGVTERIGVSNFEPRHLDEAEDVLGELPFANQVEFHPLLQQEELREYADGEDIELVAYSPLARGEVFDVPEIQAVAEKHGVSEAQVSLAWVRRKGVTAIPKATGEDHIADNWASLDLELDDEDVAKIDGIDRRERQVDPEFGPWN

SEQ ID NO: 10573 - protein, 287 aa, Halobacterium sp. NRC-1
MADVIDAVFDAIADAAPEVRAGLPDHRATRDDQNASGDTQLEADVWADDLLFDRTESIEGVNWYASEERDAVVTVGDAEGGYAVALDPLDGSSNVKSNNPCGTVVGIYDQPLPAPGSSLVAAGFVLYGPTTTMVVARDDTVRESLVSETGATTDLGPVELPADPTVYGFGGRVPDWTPAFESFVRDVEDDLKLRYGGAMIADVNQVLVYGGVFGYPGMESAPDGKLRAQFEALPIAYIVETAGGASSDGTQSLLDVAPTRLHERTPTFVGTDDVIAALDAALPDHTN

SEQ ID NO: 10574 - protein, 503 aa, Halobacterium sp. NRC-1
MTYQHYINGEWVDGDGTETFDSRNPANGETLGTFQRGTTTDVEAAIAAADDAEDEWQSLSRIDRAEYLWDIYHELKDRHQELGEVVTKECGKEISEGKADVTEAWQMVEWAAGDARHPKGDVVPSEIPEKDAYMRRQPRGVVGCITPWNFPVAIPFWHMAVALVEGNTVVWKPAEQTPWCGQIIAEMFADAGIPDGVFNMVQGFGDAGARIVDHDDIDTVLFTGSAEVGEEVARTVADDPGKLAACEMGGKNGIVVTEKADLDIAVHAAVMSSFKTTGQRCVSSERLIVHEDLYDEFKQRFVEIAESVAVDDPLDEETFMGPAIEPAHVEKIQTYNDIAREEAENVLVDRTELGDDEIPDGHEDGNWVGPFVYEVDYDPDLRSITEEVFGPHVALIEYSGDIERAVEIHNDTPYGLAGAVISEDYRQINYYRDNAEVGLAYGNLPCIGAEVQLPFGGMKKSGNGYPSAREVIEAVTERTAWTLNNSKDIEMAQGLSADINTDE

SEQ ID NO: 10575 - protein, 453 aa, Halobacterium sp. NRC-1
MDDINPATGARIDTYETDTAADIEAALARAADAANDWRDRPIRERERHVAAAGDVLRENTQTYAELITAEMGKPITQARAEIEKCAAVCDHYATHASAYLQPDGHPSPAGADVQTVYEPLGPVLAVMPWNFPFWQVFRFAAPALAAGNVALLKHASNVPGCAEAIADVFEAAGLPAGVFQTLLVGADAVEDVIRDDRVRAATLTGSEPAGSAVAATAGETLKKTVLELGGSDPFVVLDDADVAAAAASGAWARTLNSGQSCIAAKRFIVHTDVYEAFRDAFVSEIDSLTVGDPTREETDVGPQASAAGLDTTHEQVRASVDAGATVVTGGQPSDREGAFYEPTVLTDVPAGCPADTEELFGPVAAVFEVPDEAAAIAKANATAFGLGASVWTADRDRGRRVARAMDAGCAYVNQPVTSDPRVPFGGIGRSGYGRELAGAGIRAFVNRKTLWVE

SEQ ID NO: 10576 - protein, 480 aa, Halobacterium sp. NRC-1
MEQNAIQRRERPFVAGEWVSDGEPLPVSDLADGGTFASVAAADTSDAERALSAATGVHADLRETTVPERVEWLESIADGIRRREDELAEVIVREAGKPISSARGEVQSAAERFDRAVGELRHLTGEYRTGTTAGHEDWQAIVKHEPMGTVLCITPYNYPLSTMALQVAPAIAAGNAVIVKPASKTPISGAILADIAADAGLPDGAYNFVPGESSVIGDPLASDARVDAIAMTGSSGAGEHVARQSGITRLHMELGGNAPAIVFEDADLDAAADAATAGSLKYAGQRCSAVSRVLAHESVHDELVSRIDDAMAEWSIGDLFDTDTTLGPLVSADQADWVAELVDDAVDRGATVVRGGERHVEDGVHYYEPTLLADVPRDARIVDEEQFGPVCAVTTVTDEDDAVRTANGSELALDAAVFTADHDRAMRVAERVNAGAVRINGAPSHGLGDVPFGGNDASGIGREGLDSTIHEFVREKSIIL

SEQ ID NO: 10577 - protein, 527 aa, Halobacterium sp. NRC-1
MVVSPTYLRPVTFAQSRNAFAVSHRPFDMANDSSTDGRFSEKLRVPEALTFDDVLLRPAESRVEPDDADVATRVSTNVELEVPVLSAAMDTVTESRLAIAMAREGGLGVLHQNMDTDRVVAEVERVKRADELVIDRENVVTAAPEQTVEAVDEMMDRSDVSGAPVVDDDDTVRGIISATDIRPYLEVGESDAVREAMTDEVITAPEDITARDALELMYEHKIERVPIVNDEQHLVGLVTMQGILERREHGSAARDQNGRLRVGVAVGPFDTERATAVDEAGADVLFIDCAHAHNLNVIDSAREIKASVDADVVVGNVGTREAAEAVVDFADGIKVGIGPGSICTTRVVTGSGMPQITAVSQVADVAAPAGVPVIADGGIRYSGDAAKAIAAGADAVMLGSYFAGTDEAPGRVITMNGKKYKQYRGMGSVGAMQSGGSDRYLKDDDEDEEYVPEGVEAATPYKGSLASELHQLVGGIQSGMGYVGAESIPAFKADAEFVRVSAAGQTEGHPHDVMITDEAPNYSPQGE

SEQ ID NO: 10578 - protein, 600 aa, Halobacterium sp. NRC-1
MVINLTSHAAHADVTEACLAAGRHVFSEKPLAMDAARAADLVAAAERHDLGLGCAPITPGCDAQRHARALAADGRLGGVQFAAATANVGRVDEWHDRPASFLDVGPLYDGAVYPLALLVAWFGRVTEVRTADAVAAWPPAQRDGDDAPDGLPHVEATLSFSDGPVVSLRASFYVDHRSREFYGLELHGDDGTLYLRDTGALGAPRDAVTVRGGDREPTVAPQPQPRCSRAYAAGPERLADRVAGGCGSSARASARRGAHVVAVCNAIERAATDGGPVAVPEPGVSLARPEQRRPAPVAAAPSGFQPGGRALRLPPVGFGCSRYRDGTYVTPAMGAAVDAGYRLFDTAELYGNEWRLGDLVAAPGGPDRESVFLVGKPWRTNHGPGDLREACTGSLDELGVAAFDCYALHWPGAWAHRGALTRLSERPVEEQERLTMPTAADGTPARAPHGLVETWRRMEALHDDGLARSLGVCNVTLPQLAGLTDAARVRPALVQVECHPYRPRDALVSWCHRHGVRVVAHSPLSAPGLLDEPVVHAVADEHGVSPATAVLAWHCTRGVVPIPSTTTREHVVANLAAPRHSLTDDQRDRMAGLADPTFQR

SEQ ID NO: 10579 - protein, 544 aa, Halobacterium sp. NRC-1
MSRRVWYLLGLEDATWPERALFAVTMAAMLALAVAGFRRPTQLSTVLNGAFDWVLRYFGWWFILLGFVLLVLVLGVTWSRYGRLRIGGPDAEPEFDTFSWLSMVFTVGFGASILIWGVGEPVSIVQQPPPEPWPVGGASAKSLALAFMFVHEVFPGLAMWYLPVALAFGIIVYTRGIGEYKVSTMLAGIMPAGDHPVVLWAVDVAAIIATIGGIATTLGFSSQTMAAILGGVFGLQSAWLTYGIFAAIGAVFLVDVWLGLRSGIRNAARATMLLIGVAMAVLVVVGPTLFTFQLGLDATGVWLNNVVRLMLYTDPTAAGHWAANWTGFWWAWWAAWSIFVGSFVARVSKGRTVREMFIVLVVAPGVLSWVQHTLIGGWVLAPDYVGPVGNALSANGIPAAIARALSITPYGSVLALLFVLVIAGYIITSLDSAVFMIAAITLGDEDPNPRNRACWGLLLAAFGVMSLELSSFEAIEALSPVLALPFTLFLLVIVYASYVAAREYARDRDDVAVSPGGLLSSRSSASDTDPEAGSGTDAAPTGDD

SEQ ID NO: 10580 - protein, 352 aa, Halobacterium sp. NRC-1
MSAEEQRTTEEVPEWKRQEVAELVDLLETYDSVGVVNVTGIPSKQLQDMRRGLHGQAALRMSRNTLLVRALEEAGDGLDTLTEYVEGEVGLVATNDNPFGLYQQLENSKTPAPINAGEVAPNDIVVPEGDTGIDPGPFVGELQTIGANARIQEGSIQVLDDSVVTEEGETVSDDVSNVLSELGIEPKEVGLDLRGVFSEGVLFTPEELEIDVDEYRADIQSAAASARNLSVNAAYPTERTAPDLIAKGRGEAKSLGLQASVESPDLADDLVSKADAQVRALAAQIDDEDALPEELQDVDAPAAPAGGEADTTADEQSDETQASEADDADDSDDDDDDDDGNAGAEGLGEMFG

SEQ ID NO: 10581 - protein, 343 aa, Halobacterium sp. NRC-1
MNDDDVMELLASVTDPALGDDIVSLGLVNDLSVDDGTVTISLALGAPYSPAETEIAAHVRETLEAEGLETDLTAAIPDRSETEVLPGVKNVVAVASGKGGVGKSTVAVNLAAALSDRGARVGLFDADIYGPNVPRMVDADDHPQATETETIVPPEKHGMKLMSMAFMVGEDDPVIWRGPMVHKVLTQLIEDVEWGYLDYLVVDLPPGTGDTQLTLLQTLPLTGSVVVTTPEDVAVDDARKGLRMFGRHDTTVLGVVENMSSFVCPDCGGTHDIFGAGGGEEFATANELPFLGSIPLDPSVRAGGDNGQPVALDPDNETGASFRTFAAETADMLGLVQRRGVGE

SEQ ID NO: 10582 - protein, 398 aa, Halobacterium sp. NRC-1 [sequence omitted]

SEQ ID NO: 10583 - protein, 255 aa, Halobacterium sp. NRC-1
MTDRSVVSGTAIVTGASSGIGRATAERLAADGARVVLCSRDHADVDAVADAIRTDGGTALPVECDVTDRDAVDALVEATVHEFGGLDVLVNNAGASFVAPFDDISRNGWDRIIDVNLGGTYNCTQAAAEQLKRDGGGAVVNVASVAGQEGSPHMSHYAAAKAGIITLTRTLAAEWAPAGVRVNCIAPGFVATPGLDAQMGVSAADIDRREVARRIGTSAEIADAIRFLASPAASFVVGETLTAAGVPQGEEVPSP

SEQ ID NO: 10584 - protein, 313 aa, Halobacterium sp. NRC-1
MSFRRPTLGETPTTVLFLLLAAIWGSSFVAIKIGIADVPALSFAAIRYSIAGLIVLAYAAHTTDRWRPRGRREWVLAATVGLFVIGIYHGALYLGEHDVSAPIAAIVISLAPILTAGFASKLHENVTIDGTQAAGLLAGLAGVVIVANPGSAGSVDLGGLLLVFLAAASFALGGVLTGKLPGGGGLPVETMEAWAMLIGSLALWVGAAVRGENVTAVHWTPTALASLAYLTLVCGAGGFLLYFVLLERAGATEINLVSYLEPIGASVVAWALFGDVVSPRALAGFAVIFAGFALVKHRYIGAAVRNTTDDAEL

SEQ ID NO: 10585 - protein, 674 aa, Halobacterium sp. NRC-1
MTSVQNTESETAAGATTIGVLFAGSDPETGPAACDLDEDGRFDVTQIRDFVAARDRVDDPDIDCVVAVHEPDGFDGVAFLEAVRQTHAEFPVVVVPTAVDEDVARRAVDADATGLVPAVSEDATAAIADRIEQSAPAHSEDTETRMPISDLTVESERRLKEQALDEAPIGITISDATDPEEPIIYINDSFEDITGYSPDEVVGANHRFLQGPKTNEDRVAEFWTAITEDHDTQVVLRNYRRDGSLFWNQVDISPIYDEDGTVSHYVGFQMDVSERMAAQQELQGERQSLDRLLDRVNGLMNDVTSALVRAADREEIETRITDRIGTGGEYAGAWFGRYDATEDTITVAEAAGDCEGCDGDVFDLASAGEAVALLQDVVEQREALVSTDADGVSGTADGDACVLVPVTYRSTTYGVLAVSTAEHRIDDREQVLLRSLGRTTGASINDALTRRTIATDTVLNIGVELSDTALFLVELAGATDTTFEQEATIADSQTQGVLMLVTTPHDDPQAVVDTALGYDAVQDAEVIVSTDDESVVQFDLSSSPLVDVLSECGSRVIRMHADRTTLELDVRVGTEGAARRVLSTLRDKYADVELVAYHEDDPEQTPHGFREELRNDLTDRQLTALQKAYVSGYFEWPRRAEGKQLAESMDIVPSTYHQHLQAAKQKLVGAFFEE

SEQ ID NO: 10586 - protein, 171 aa, Halobacterium sp. NRC-1
MYARIREDVRAMRRRDPAAGSRLDVALTYPGLHAVWAHVFLAGPLYDRWPTAGRLVAYWVRLLTGIEIHPDADIGRRVTIDHGHGVVIGETAVVGDDVHMYHGVTLGGNDSRPVDRHPTVRAGVTLGANATLLGDIEIGANASVGAASVVTDDVAAGATVTGVPAQRVDDA

SEQ ID NO: 10587 - protein, 254 aa, Halobacterium sp. NRC-1
MVAYAALVADDWLPRSRTDWTTVGIAAVLMIAAYHAFLFVGEQTTSSAVAAIVVSLSPVLTAGFARAVLPGERLSIGGVVGLGLGLAGVVVLSNPDPSNLVSSTSQGVGLVFAATASFALGSVLTQRIDDALDSEALEAWAMVFGAVVMHVASIAAGEPQTIPWTAEAVFAVAYLSVGASAVGFLIYFRLLDSLGPIEINLVGYVAPVFAAAVGLLWRGEAITTPTIGGFCIVFTGFCVLKRRAIAAELRALSE

SEQ ID NO: 10588 - protein, 183 aa, Halobacterium sp. NRC-1
MATGPRYKVPMRRRREVRTDYHQRLRLLKSGKPRLVARKSNKHVTAQLVTTGPDGDETVASAHSSDLDAYGWAAPTGNLPAAYLTGLLAGQRAVDAGVEEAVLDIGLNTATPGSKVFAIQEGAIDAGLDVPHNDSVLADWSRTRGEHIAEYAESLDEPLYSGDFDATALPAHFDETREAIMED

SEQ ID NO: 10589 - protein, 295 aa, Halobacterium sp. NRC-1
MSRVVAAGHVNWDVTLRVDALPEPDGEAEIVSQRRSGGGSAANVACALAGFDIDAGLVGSVGDDEHGLLAQRELQAAGVDLAGLRVVDGLETSVKYLLVDSRGEVMVLGNDGANEAVAPGDLDPAVVGADCEHVHLTSQRPATAARLTALAREHDATVSFDPGRRLRDRDYGDALARTDILFVNDNEAGAVLDDDGGPTAPDSDRVVVVKHGSEGATVHTPSGSVTHPGFAVDPVDTTGAGDAFAAGFVAVVLDGGDHERALEFGNACGALAAQHEGARTAPTRADAASFLDSQF

SEQ ID NO: 10590 - protein, 261 aa, Halobacterium sp. NRC-1
MELGLDGDVAVVTASSSGLGKASAAALAREGADVVVCSRDEERVVAAAEEIGADAAGSVRGVPADITDGADVAAVVETAVETFGGLDHVVTSAGGVPSGQFTAVTDDDWTDAFELLVMSVVRTLDAAHEHLVAGDGGTVTCITSTSVSEPIEGLVLSNAVRRGVVGLAKTVAREWAPDVRANVVQPGPHETARIEELVSAAVARGEADSYEAGLAGWSEEVPLDRLGEPSELGDVVAFLASDRASFVTGASVPVDGGRLWG

SEQ ID NO: 10591 - protein, 427 aa, Halobacterium sp. NRC-1
MTTAPAISSRLDDPESARETGRAKIDWAFEHMPILSALREEFDANQPLAGETIGMAMHVEAKTAALVETMADAGAEIAITGCNPLSTHDGVSAALDAHESITSYAERGAEGEAYYDAIDAVLAHEPTVTVDDGGDLVFRVHEDHPELIDTIIGGTEETTTGVHRLRAMDDDDALEYPVFAVNDTPMKRLFDNVHGTGESALANIAMTTNLSWAGKDVVVAGYGDCGRGVAKKAAGQNANVIVTEVEPRRALEAHMEGYDVMPMAEAAEVGDVFLTTTGNKNVITRAHFERMDDGVVLANAGHFDVEVNLDHLSELAVSEREAREGVREYELADGRRLNVLAEGRLVNLASPIGLGHPVGVMDQSFGVQAVCVRELVANREEYAAGVHNVPDELDIEIAEIKLAAEGVEYDALTDDQAEYMDSWQHGT

SEQ ID NO: 10592 - protein, 489 aa, Halobacterium sp. NRC-1
MSDLDFGDVDWNVQYIDGEYVPPGDRGTLEVDDPSTRELFTEIPAGTTDDVDAAYEAAADAQTEWADTPPQERARIVAAASEILASHRDEVVDLLATESGTTYTKGAAEFEASVGITDEAASFPTRMNGDHKQSVVEGKENIVVREPQGVVGIISPWNFPLNLSIRAVAPAVAAGNSVVLKPASNTPVTGGLLIAKVFEAAGLPEGVFNVVTGKGSEIGDRIAGHPHADVISFTGSTAIGRQVAATAGENLALPAMELGGNNVHIVTEDADLDDAVDSGVFGSFLHSGQICISINRHVVHEDVYDEYVERLTERAAALPTGTAHDADTVVGPIIDESQRDQILDYIERTVDAGATLETGGDHDGLVVEPTVLSDATNDMAAACNEHFGPVAPVIPFSDDDEAVEIANSTEYGLSGSVHAGDTGRARDIADRIDTGMIHINDQPVNQEPHLPFGGYKNSGLGRYNGEYVLNEFTQEKWVSIQRETRDYPF

SEQ ID NO: 10593 - protein, 347 aa, Halobacterium sp. NRC-1
MRAAVYQGPGEIAVEEVPKPDIESPEDAVIRVTHTAVCGSDLWFYRGDSDREAGSRVGHEPMGIVEEVGDDVTSVAPGDRVIAPFAISCGECEFCRQGLYTSCVEDESWGSEANGGGQGEYVKCPFADGTLVRVPDRYADDEDVLESLLPLTDVMGTGHHAAVSAGVGEGDTAVVVGDGAVGLCGVLAAQRLGAERIIAMGHHEDRLELAAEFGATDTISARGDDAIERARDLTHGGANHVMECVGAASAMDSAIAIARPGGTVGYVGVPYGVEDGGLDVFTMFSDNITIRGGVAPVRAYAEELMADVLQGTLDPSPIFTKTVDLDGVPEGYAAMDDREAIKVLVKA

SEQ ID NO: 10594 - protein, 665 aa, Campylobacter jejuni subsp. jejuni NCTC 11168
MMYKKQNLPELTLRGLILGSILTIIFTASNVYLGLKVGLTFSSSIPAVVISMAVLSLFKTSNILENNMVQTQASAAGTLSSVIFVIPGLFMCGYWSEFPLWQTFMICLCGGGLGVLFTIPLRRTMVVESKLAYPEGRAAAEILKVANKDQSSKKGKQGIKEIALGSFIAAIFSLLSNGFKLAASESNFAFIWNKMAFGFSMGYSLALLGAGYLVGLAGAIALFVGMFLAWGIFTPYLSNFEFDSTKNAVDLASSVWSSKVRLIGTGAIAIAALWTLIELLKPVIEGIKEIVKNVKITNQEKNERTNIDLSLKSIFILFVLMVVGLFITFYSFVEDANLSIYYQMLFSFVGTLVSVLIGFFVAAACGYMAGLVGSSSSPISGIGLIGVIISSIVFLVLGVELFQDPMLSKFAVALAIFTTSVILATAAISNDNLQDLKTGHLVGATPWKQQVALLVGCVFGALAIVPVLNLLYQAYGFVGAMPREGMDASSALAAPQANLMSTIAQGIFHHNIEWGYMAFGVFVGILMIIIDKILKGTQKMSLPPLAVGIGIYLPPAVNIPLVIGGILKYIVMQHLTKKYAKNSHKEEKLASCEQRGTLFASGLIVGESIFGVIIAGITVFSVSMGGSENPLALNLANFHDSELFALIFFVGVVLYFIKRIVKKDA

SEQ ID NO: 10595 - protein, 231 aa, Campylobacter jejuni subsp. jejuni NCTC 11168
MSLYDRDYSRSKEFENTRSSELSIFIKQTYQLFAASLLAATVGAYVGIFALASFFIQSQVTFWILFAVEIGLLFALQWKKREAPLNLVLLFGFTFCSGLTLTPLLISVLALPAGGIIIAQAFALTTVAFAGLSVFAMNTKKDFTVMGKALFIVLIVIVAASLLNLFFQSSIVNLAISAVAAILFSFYILYDTQNIIRGNYETPIEGAVALYLDFVNLFVSLLNILRSFNSR

SEQ ID NO: 10596 - protein, 402 aa, Campylobacter jejuni subsp. jejuni NCTC 11168
MDYKQLKQEFNTPFYIYNFDFIKERFLNLKEAFKARKSQIFYAVKANSNLSLLQMLANLDSGFDCVSIGEVKRALKAGAKAYKIIFSGVGKTKEELRQALEYDILYINLESEAEMMLLESVAKELNLKARISIRVNPNVDAKTHPYISTGLNENKFGVEIDIARKMYLYAKNSSFLEPVGVHFHIGSQLLDISPIHEAAAIVAKLVRELKALQIDLKFFDIGGGLGVAYEKNECEPDLYDYAQGILAQLHGLDLTIGMEPGRYLVAKSGEFVCSVLYEKQNKTKRFVVVDGAMNDLIRPSLYEAYHEIILPYNQGEESLCDVVGGICESGDFFAKARSLPSTQSDDIMVIKNTGAYGFSMSSNYNTRNKVCELALEEGQVRLIRQRENFEDQIALEEKFLKA

SEQ ID NO: 10597 - protein, 615 aa, Campylobacter jejuni subsp. jejuni NCTC 11168
MSKKFAHTQEELEKLSLKELENLAASMREKIIQVVSKNGGHLSSNLGAVELSIAMHLVFDAKKDPFIFDVSHQSYTHKLLSGKEEIFDTLRQINGLSGYTKPSEGDYFVAGHSSTSISLAVGACKAIALKGEKRIPVALIGDGALSAGMAYEALNELGDSKFPCVILLNDNEMSISKPIGAISKYLSQAMATQFYQSFKKRIAKMLDILPDSATYMAKRFEESFKLITPGLLFEELGLEYIGPIDGHNLGEIISALKQAKAMQKPCVIHAQTIKGKGYALAEGKHAKWHGVGAFDIDSGESVKKSDTKKSATEIFSKNLLDLASKYENIVGVTAAMPSGTGLDKLIEKYPNRFWDVAIAEQHAVTSMAAMAKEGFKPFIAIYSTFLQRAYDQVIHDCAIMNLNVVFAMDRAGIVGEDGETHQGVFDLSFLAPLPNFTLLAPRDEQMMQNIMEYAYLHQGPIALRYPRGSFILDKEFNPCEIKLGKAQWLVKNNSEIAFLGYGQGVAKAWQVLRALQEMNNNANLIDLIFAKPLDEELLCELAKKSKIWFIFSENVKIGGIESLINNFLQKYDLHVKVVSFEYEDKFIEHGKTSEVEKNLEKDVNSLLTKVLKFYH

SEQ ID NO: 10598 - protein, 247 aa, Campylobacter jejuni subsp. jejuni NCTC 11168
MKFSGKNVLITGASKGIGASIAKTLAGFGLKVWINYRSKPELADALKDEIIASGGVAAVIKFDASKEDEFENGVKTIVESDGELSYLVNNAGVTNDKLALRMKLEDFSGVVDTNLSSAFLGCREALKTMSKKRFGAVVNIASIVGEMGNAGQVNYSASKGGMIAMTKSFAKEGASRNLRFNCVTPGFIKSDMTEVLSNEIKQTYQDNIPLKRFAEPEEVANCVAFLLSDYASYVTGDVLKINGGLYM

SEQ ID NO: 10599 - protein, 212 aa, Campylobacter jejuni subsp. jejuni NCTC 11168
MNFWGIIKEDFSQPKAQDPAFNSCIELFFNYPGVWAVVNYRFAHFFYIRNFKRIARMISGISQFLTGVDLHPGAELGRRIFIDHANGVVIGQTAIIEDDVLIYQGVTLGGTSLEKGTKRHPTIKKGVIIGSGAKVLGNITIGENAKIGSNAVVVKDIGANLTAVGIPAYIIEERKNKNIRAIDANCDDKLEKLEKKILELENLILKQPESQK

SEQ ID NO: 10600 - protein, 280 aa, Campylobacter jejuni subsp. jejuni NCTC 11168
MQEVISYIQKAVLEISNALKFPDTSYSQNQNFTGDTQLKFDVLSDEIITKTLSQCSSIKAIISEEKDEILTLNERANFIVAYDPLDGSSLMDVNFAIGSIFAIYEEKASAKNLRAALYSMYGARLELVICKDQPKLYRLNANNEFIFIKDLRMNEKGKINATGGTQKFWEEKHAKFIKSLFDEGYRLRYSGAMVSDINQILLKGGGIFSYPATQDAPNGKLRAFFEVFPLAFIIEKAGGKTTNGKNRSLLELEFDKIHATTPCFFGSEYEISKLLKAYNE

SEQ ID NO: 10601 - protein, 622 aa, Campylobacter jejuni subsp. jejuni NCTC 11168
MNAKTQEAELEELFQENAKDYITYEKLVKYLTKQPSASTTKKVQALMKKHKVQLFSAAEIAQMKNIEDAKRLQEEKQKLQDTSLENEFDLANENDLLEWSRSDSPVRMYLREMGQIALLNKDEEIEISKKIELGEDIIIDAFCSVPYLIDFILDYKEPLINRERRVKELFKSFDDEEKSDDKLDELDIDEDEENETELESDEENTKKNSKKEDERTLKVIEKFKALEKAKKDWLKTSKDKESGDELLDKLSIAFKKNILKEKLMDLGPTSKLISEIVKSMETALKSDEEFDKELKRLEYRLPMFSDELKKRHADILKDITKLSKEEITERALETTMVSTYMEIKKLFQTKEASEKSFDLEKSRLKEILEQIKRGKKISDEAKGRMAKSNLRLVVSIAKRYTNRGLPFLDLIQEGNIGLMKAVDKFEYKRGYKFSTYATWWIRQAISRAIADQARTIRIPIHMIETINQINKIIREHLQKDGKEPDVSVIAKEVGLSVDKVKQVIKITKEPISLEAPIGNEDDGKFGDFVEDRNSLSPMDHILKDDLKEQIDEVLDQLNDREKAVIRMRFGLMDDESDRTLEEIGKELNVTRERVRQIESSAIKKLKHPKVGRKLKNYIEGWK

SEQ ID NO: 10602 - protein, 485 aa, Campylobacter jejuni subsp. jejuni NCTC 11168
MKIVKRALTFEDVLLRPGYSEVLPKEVKIHTKLTKNITLNMPLISAAMDTVTEHRAAIMMARLGGLGVIHKNMDIASQVREVKRVKKSESGVIIDPIFVSPKASVAEALEIMAEYRISGVPVVDEDKKLIGILTNRDLRFESDFSNLVENVMTKMPLITAPKGCTLDDAEKIFSTNKVEKLPIVDEQGRLEGLITIKDLKKRKEYPDANKDNFGRLRVGAAIGVGQMDRVDALVEAGVDVVVLDSAHGHSKGIIDTVKAIKAKYPNLDLIAGNIATAAAAKALCEAGVDAVKVGIGPGSICTTRIVSGVGVPQISAIDECVEEANKFGVPVIADGGIKYSGDIAKALAVGASSVMIGSLLAGTDESPGELFTYQGRQYKSYRGMGSLGAMQKGSSDRYFQQGTAQDKLVPEGIEGRVPYVGSIRSVVHQLLGGLRSSMGYVGAKDIEDFQKRAEFVEITTAGLKESHVHDVTITHEAPNYKVNHQ

SEQ ID NO: 10603 - protein, 330 aa, Campylobacter jejuni subsp. jejuni NCTC 11168
MNLPILDLQAYEKDKSTFLKNLREIASKIGFFYLINTSIDKNLNEKLFKLGKEFFNLSRSSKELISMVHSPQFRGYTSEGFEYTAGSKDYREQLDIGTERDALNWNLNSPLWQRLEGPNLWPSEIPELKKTFLTWHKQTKKACLKLLKAFAQALDLPNNAFDKLYGENSYEHCKIIHYPKSSKNITQGVGSHKDGGLITFVFQEKQSGFEAFIDGKWLSIPPLENSVVVNIGEFLELATNGYLKATIHRVNLSPKERFSIAYFLGVQLDKDIPIFKLNPELAKESKGVDTDPKNPLLRNVASNYFKRMIRSHPDVASIYHSDLIEKFSFA

SEQ ID NO: 10604 - protein, 356 aa, Campylobacter jejuni subsp. jejuni NCTC 11168
MILFGSTGSIGVNALKLAALKNIPISALACGDNIALLNEQIARFKPKFVSIKDSKNKHLVKHDRVFIGQEGLEQILTECQDKLLLNAIVGFAGLKSTLKAKELGKNIALANKESLVVAGSFLKGAKFLPVDSEHAALKFLLEGKKNIAKLYITASGGAFYRYKIKDLNQVSVKDALKHPNWNMGAKITIDSATMANKLFEIIEAYHLYDFKEIDALIEPRSLVHAMCEFKNGASTAYFSKADMKLAISDAIFEKQDTPILEAVDFSKMPALKFHPISTKKYPIFKLKNTFLKEPNLGVIINAANEVGVYNFLENKSGFLDIAKCIFKALDHFGVPKISSIEEVFEYDFKTREYLRS

SEQ ID NO: 10605 - protein, 513 aa, Campylobacter jejuni subsp. jejuni NCTC 11168
MNRRNFLKFNALTLASMGVAYANPMHDMHSMHKNHSINHDLDTSFINFAPKNLKLLDPKQFPQGEILKALPLLKNESKEKNIFRATLEIKENHIELIKGKKTLFYTYNGLVPAPKIEVFEGDKLEILVKNKLKEATTIHWHGVPVPPDQDGSPHDPILAGEERIYRFEIPQDSAGTYWYHPHPHYTASKQVFMGLAGAFVIKAKKDALSHLKEKDLMISDLRLDENAQIPNNNLNDWLNGREGEFVLINGQFKPKIKLATNERIRIYNATAARYLNLRIQGAKFILVGTDGGLIEKAIYKEELFLSPASRVEVLIDAPKDGNFKLESAYYDRDKMMVKEESNTLFLANINLKKEKLELPKNLKIFKPLEEPKEFKEIIMSEDHMQMHGMMGKSENELKIALASMFLINGKSYDLKRIDLSSKLGVVEDWIVINKSHMDHPFHIHGTQFELISSKLNGKVQKAEFRAFRDTINVRPNEELRLKMKQDFKGLRMYHCHILEHEDLGMMGNLEVKE

SEQ ID NO: 10606 - protein, 140 aa, Campylobacter jejuni subsp. jejuni NCTC 11168
MTKEQIQIIKDCVPILQKNGEDLTNEFYKIMFNDYPEVKPMFNMEKQISGEQPKALAMAILMAAKNIENLENMRSFVDKVAITHVNLGVKEEHYPIVGACLLKAIKNLLNPDEATLKAWEVAYGKIAKFYIDIEKKLYDK

SEQ ID NO: 10607 - protein, 368 aa, Campylobacter jejuni subsp. jejuni NCTC 11168
MKEQILEKLKTVKYPGFEKDIVSFNFVKDIKIQDDGVFIDIEIVSANPEVANEIRKNTIEALSSLALKNIELNIITPKIPEEKSNSRSGKNIAPQVKNFIMVSSGKGGVGKSTTTVNLAISMAKMGKRVGILDADIYGPNIPRMLGETKTQPEVVGQRLKPILTHGVYMMSMGVLIEEGQGLMWRGAMIMKAIEQLLADVIWPELDVLFLDMPPGTGDAQITSAQSIPIAAGVCVSTPQTVSLDDSKRALDMFNKLHIPIAGVIENMSGFLCPDNGKEYDIFGKGTAEDMAKAYKSEVLAQIPIEMIVREGGDEGKPVSFYHPESVSSKRYLMAAEKIWSFIEKINNEGGADNSAIQPVMNGKSACSH

SEQ ID NO: 10608 - protein, 414 aa, Campylobacter jejuni subsp. jejuni NCTC 11168 [sequence omitted]

SEQ ID NO: 10609 - protein, 394 aa, Neisseria meningitidis Z2491
MTPQVLTILGSTGSIGESTLDVVSRHPEKFRVFALAGHKQVEKLAAQCQTFHPEYAVVADAEHAARLEALLKRDGTATQVLHGAQALVDVASADEVSGVMCAIVGAVGLPSALAAAQKGKTIYLANKETLVVSGALFMETARANGAAVLPVDSEHNAVFQVLPRDYTGRLNEHGIASIILTASGGPFLTADLNTFDSITPDQAVKHPNWRMGRKISVDSATMMNKGLELIEAHWLFNCPPDKLEVVIHPQSVIHSMVRYRDGSVLAQLGNPDMRTPIAYCLGLPERIDSGVGDLDFDALSALTFQKPDFDRFPCLKLAYEAMNAGGAAPCVLNAANEAAVAAFLDGQIKFTDIAKTVAHCLSQDFSDGIGDIGGLLAQDARTRAQARAFIGTLR

SEQ ID NO: 10610 - protein, 485 aa, Neisseria meningitidis Z2491
MSRHPARTGEKTFFGHPFQLSTLFHIELWERFSFYGMQGILLIYLYYTADKGGLGIDKTLAGGIVGAYSGSVYLSTILGAWFADRVWGAEKTLFLSGIVVMLGHIVLAAAPGLYGLLIGLIFIALGSGGVKSTASSMVGALYEQDEMRPLRDAGFSIFYIAINIGGFLGPLLTGLLQENIGFHYGFGAAAVGMAFGLWRYSLGRKNLPHPTVPHPLSKGQGKTAAAVGIALIAALATAIKTGLVNLDNFSGILLSTVILAVIVYFTRLLTNPRVSSDNKRHIIAYIPLFLTICMFWAVWFQIYTVATVYFDETVNRTIGSFTVPVAWKDSMQSLWVILFSGLMAAMWTKMGRKQPKTPLKFAMAVFVTGASFLGFVPFISAGTPMPIAVFALIVLAITIGELMISPIALSISTKIAPPLFKTQMVALNFLAFSLGFTLGGVLFEKGYQAGDEIGFYRLLFYIGAATGFLLLLLVPKLNKMLEGTD

SEQ ID NO: 10611 - protein, 112 aa, Neisseria meningitidis Z2491
MKKIEAIVKPFKLDDVREALTEIGITGMTVSEVKGFGRQKGHTEIYRGAEYAVDFLPKVKIELVLADDAVERAIDVIVEVARSGKIGDGKIFVLPVEEAIRIRTGERADAAV

SEQ ID NO: 10612 - protein, 406 aa, Neisseria meningitidis Z2491
MTLFCEQVPYPRLAEAFGTPLYVYSQSALTEAFEHYQTAFAELSPLVCYAVKANGNLSIIKHFASLGSGFDIVSGGELARVLAAGGDAAKTIFSGVGKSEAEIEFALNAGVKCFNMESIPEIDRIQKVAARLGKTASVSLRVNPDVDAKTHPYISTGLKANKFGIAYADALEAYRHAAQQPNLKIIGIDCHIGSQLTDLSPLVEACERILILVDALAAEGIVLEHLDLGGGVGIVYQDEDVPDLGAYAQAVQKLIGTRRLKLILEPGRSLVGNAGALLTRVEFVKYGEEKNFVMVDAAMNDLMRPALYDAYHHIEAVEPKNIAPLTANIVGPICETGDFLGKDRTIACEEGDLLLIRSAGAYGASMASNYNARNRAAEVLVDGNEYRLIRRRETLEQQMANELACL

SEQ ID NO: 10613 - protein, 480 aa, Neisseria meningitidis Z2491
MKQLAMYINGRFENDFNGEWRNVLNPSTEEAIAREPKGGKADVDRAVAAARAAQPAWERLPAVERGAYLRKIAQGIRERADELTDTIVAEGGKTKDLARVEVMFTADYLDYQAEWARRYEGEIIQSDRPRENILLFKRPLGVIAGILPWNFPFFLIARKMGPALVTGNTIVVKPSSVTPINCHIFAEIVDAVGLPAGVFNVVNGPGAEIGNALSAHPQVDMVSLTGSVEAGRQVMEAASANITKVSLELGGKAPAIVLKDADLDLAVKSILASRVGNTGQICNCAERVYVHSSLKDAFIEKMTAAMKGVRYGNPAEAEAGALEMGPLIEERAVKAVAEKVERAVKQGAKLVCGGKRAEGRGYFFEPTLLTDTDNSMDIMKEETFGPVLPVSAFDTLDQVIALANDCEFGLTSSVYTTNLNEAFYVTRRLQFGETYINRENFEAMQGFHAGWKKSGIGGADGKHGLEEYLQTQVVYLETDI

SEQ ID NO: 10614 - protein, 248 aa, Neisseria meningitidis Z2491
MSTQDLSGKIALVTGASRGIGAAIADTLAAAGAKVIGTATSESGAAAISERLAQWGGEGRALDSAEPETIESLIADIEKAFGKLDILVNNAGITRDNLLMRMKEEEWDDIMQVNLKSVFRASKAVLRGMMKQRSGRIINITSVVGVMGNAGQTNYAAAKAGLIGFAKSMAREVGSRGITVNCVAPGFIDTDMTRALPEETRQAFTAQTALGRFGDAQDIADAVLFLASDQAKYITGQTLHVNGGMLMP

SEQ ID NO: 10615 - protein, 637 aa, Neisseria meningitidis Z2491
MNPSPLLDLIDSPQDLRRLDKKQLPRLAGELRTFLLESVGQTGGHFASNLGAVELTVALHYVYNTPEDKLVWDVGHQSYPHKILTGRKNQMHTMRQYGGLAGFPKRCESEYDAFGVGHSSTSIGAALGMAAADKQLGSDRRSVAIIGDGAMTAGQAFEALNCAGDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLEDLRGRKGPQLLHVITKKGNGYKLAENDPVKYHAVANLPKESAAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCIPNMIVAAPSDENECRLLLSTCYQADAPAAVRYPRGTGTGVPVSDGMETVEIGKGIIRREGEKTAFIAFGSMVAPALAVAGKLNATVADMRFVKPIDEELIVRLARSHDRIVTLEENAEQGGAGSAVLEVLAKHGICKPVLLLGVADTVTGHGDPKKLLDDLGLSAEAVERRVRAWLSDRDAAN

SEQ ID NO: 10616 - protein, 375 aa, Neisseria meningitidis Z2491
MYTFRPFPKLHTETHIMNIQNIRTLLDTVAVPNTARTLGGEKAVRSVEQRSDGIHIALHFGFPVAHIASETADRIQEILMPLTGDTHIHLSMDTEIGTHKVQPGVTTIKGVKNIIAVASGKGGVGKSTTTANLAAAMARMGARVGVLDADLYGPSQPTMLGVDDRKPDQKNQKLIPVESSDGIQVMSIGFLVDTDQAVVWRGPMVSQALQQLMFQSEWDEVDYLFIDLPPGTGDIQLTLSQRIPVTGSVIVTTPQDIALIDARKAVDMFRKVNIPILGVLENMSVHICTNCGHSEALFGTDGGKDLAARLNVPLLGQLPLSLPVREAMDGGTPAQLFDEHPAIARIYTDAAFQIALGVADKGKDFSSRFPKIVIE

SEQ ID NO: 10617 - protein, 405 aa, Neisseria meningitidis Z2491
MEIILGIVMFTVIVLVLALMILFAKSKLVSEGDITIKVNGEKELTMPAGGKLLGALANEGIFIPSACGGGGSCGQCRVVVKSGGGDILPTELSHISKREAREGCRLSCQVNVKTDMDIEVPEEVFGVKKWECTVISNDNKATFIKELKLAIPEGEEVPFRAGGYIQIEAPPHTVAYKDFDIPEEYHEDWDKYNLWQYVSKVDEPILRAYSMASYPEEKGIIMLNVRIATPPPRVPDAPPGQMSSYIWSLKPGDKVTISGPFGEFFAKDTDAEMVFIGGGAGMAPMRSHIFDQLKRLNSKRKITFWYGARSKREMFYVEDFDQLAAEFPNFTWHVALSDPLPEDNWDGYTGFIHNVVYENHLKNHEAPEDCEFYMCGPPIMNQSVIKMLKDLGVEDENILLDDFGG

SEQ ID NO: 10618 - protein, 794 aa, Neisseria meningitidis Z2491
MADNYVIWFENLRMTDVERVGGKNASLGEMISQLTEKGVRVPGGFATTADAYRAFLAHNGLSERISAALAKLDVEDVAELARVGKEIRQWILDTPFPEQLDAEIEAAWNKMVADAGGADISVAVRSSATAEDLPDASFAGQQETFLNINGLENVKEAMRHVFASLYNDRAISYRVHKGFEHDIVALSAGVQRMVRSDSGASGVMFTLDTESGYDQVVFVTSSYGLGENVVQGAVNPDEFYVFKPTLKAGKPAILRKTMGSKHIKMIFTDKAEAGKSVTNVDVPEEDRNRFSITDEEITELAHYALTIEKHYGRPMDIEWGRDGLDGKLYILQARPETVKSQEEGSRNLRRFSINGEKTVLCEGRAIGQKVGQGKVRLIKDASEMDSVEAGDVLVTDMTDPDWEPVMKRASAIVTNRGGRTCHAAIIARELGIPAVVGCGNATELLKNGQEVTVSCAEGDTGFIYSGLLDVQITDVALDNMPKAPVKVMMNVGNPELAFSFANLPSEGIGLARMEFIINRQIGIHPKALLEFDKQDDELKAEITRRIAGYASPVDFYVDKIAEGVATLAASVYPRKTIVRMSDFKSNEYANLVGGNVYEPHEENPMLGFRGAARYVADNFKDCFALECKALKRVRDEMGLTNVEIMIPFVRTLGEAEAVVKALKENGLERGKNGLRLIMMCELPSNAVLAEQFLQYFDGFSIGSNDMTQLTLGLDRDSGLVSESFDERNPAVKVMLHLAISACRKQNKYVGICGQGPSDHPDFAKWLVEEGIESVSLNPDTVIETWLYLANELNK

SEQ ID NO: 10619 - protein, 290 aa, Neisseria meningitidis Z2491
MPQMNNAFALPAIQSGNGSLEQYIHTVNSIPMLSQEEETRLAERRIKGDLNAAKQLILSHLRVVVSIARGYDGYGLNQADLIQEGNIGLMKAVKRYEPGRGARLFSFAVHWIKAEIHEFILRNWRLVRVATTKPQRKLFFNLRSMRKNLNALSPKEAQDIADDLGVKLSEVLEMEQRMTGHDIAIMADNSDDEDSFAPIDWLADHDSEPSRQLSKQAHYALQTEGLQNALAQLDDRSRRIVESRWLQDDGGLTLHQLAAEYGVSAERIRQIEAKAMQKLRGFLTEEAEAV

SEQ ID NO: 10620 - protein, 459 aa, Neisseria meningitidis Z2491
MLLDLNRFSFSVFLKEVRLLTALALPMLLAQVAQVGIGFVDTVMAGGAGKEDLAAVALGSSAFATVYITFMGIMAALNPMIAQLYGAGKTDEVGETGRQGIWFGLFLGVFGMVLMWAAITPFRNWLTLSDYVEGTMAQYMLFTSLAMPAAMVHRALHAYASSLNRPRLIMLVSFAAFVLNVPLNYIFVYGKFGMPALGGAGCGLATMAVFWFSALALWIYIAKENFFRPFGLTAKFGKPDWAVFKQIWKIGAPIGLSYFLEASAFSFIVFLIAPFGEDYVAAQQVGISLSGILYMIPQSVGSAGTVRIGFSLGRREFSRARYISGVSLVSGWMLAVITVLSLVLFRSPLVSMYNNDPAVLSIAATVLLFAGLFQPADFTQCIASYALRGYKVTKVPMFIHAAAFWGCGLLPGYLLAYRFDMGIYGFWTALIASLTIAAIALVWCLELCSREMVRSHKAV

SEQ ID NO: 10621 - protein, 230 aa, Neisseria meningitidis Z2491
MAVPPPNILGGIFNRPFEQREKNNKPHFVFCTVSHLRRLKGHDVLLTAFARALAQCPQLRLNIGGSGQEEQRLKQQAADLGITHAVTFLGALQPEAVLDLMRNSDAFVLASRTETFGVVYIEALSQGLPVIATRCGGAESIVSDGNGYLVPVDDDDALADALIKMYEHHSDFEPARLRENCLNEFGENAVIGRLIGIFRQAIAEYGKKIPVKYSGLTKIRTRRRSRRQYK

SEQ ID NO: 10622 - protein, 324 aa, Neisseria meningitidis Z2491
MDTLTRFLPEHLQQNQLPEALGGVLLSVVSACTEINAKVRLGALAGVLGMAGTGNIQGEDQKKLDVIANNIMIDTLKANPAVAGLASEEEDSFVSAGENGRYLVLFDPLDGSSNIDVNISVGTIFSILEKPEGALATESFLQTGRQQLAAGYVLYGPQTQLVFTFGHGVYMFTLNAENEFVLTKEKPKVPESTKEFAINMSNRRHWLPPVQQYIDELLAGETGTRGKNYNMRWVASMVAEIHRILMRGGVFMYPQDKRDPSKPGKLRLMYEANPMALILEQAGASASNARQDILGIRPESLHQRVAVIMGSSEEVDYLNRLHSK

SEQ ID NO: 10623 - protein, 487 aa, Neisseria meningitidis Z2491
MRIVEKAYTFDDVLLVPAHSTVLPRDVKLQTKLTREITLNLPLLSAAMDTVTEARLAISMAQEGGIGIIHKNMPPEMQARAISKVKRHESGVVKDPVTVAPTTLIREVLEMRAQRKRKMSGLPVVENGKVVGIVTNRDLRFENRVDLPVSAIMTPRERLVTVPEGTSIDEARELMHTHKVERVLVLNEKDELKGLITVKDILKTTEFPNANKDSEGRLRVGAAVGTGGDTEERVKALVEAGVDVIVVDTAHGHSQGVIDRVRWVKETYPHIQVIGGNIATAKAALDLVAAGADAVKVGIGPGSICTTRIVAGVGVPQLTAIHNVAEALKGTGVPLIADGGIRFSGDIAKALAAGAYSVMLGGMFAGTEEAPGEIELYQGRSYKSYRGMGSLGAMSQGSADRYFQDKTDSADKYVPEGIEGRVPYKGPIVNIIHQLTGGLRSSMGYLGCANIAEMHEKAEFVEITSAGMSESHVHDVQITKEAPNYHR

SEQ ID NO: 10624 - protein, 660 aa, Neisseria meningitidis Z2491
MVILTTLFFVCVLVVLVLTVPDQVQMWLDRAKEVIFTEFSWFYVLTFSIFLGFLLILSVSSLGNIRLGRDEDVPEFGFLSWLAMLFAAGMGVGLMFFGVAEPLMHYFSDITAGTPEHRQQQALLHTVFHWGVHAWSVYGTIALALAYFGFRYKLPLALRSCFYPLLKEKISGRFGDAIDIMALLATFFGIITTLGFGASQLGAGLQEIGWIAENSFSVQVLIIAAVMSLAVVSAISGVGKGVKVLSELNLGLAFLLLFFVLAAGPTVYLLSAFGDNIGNYLGNLVRLSFKTYAYEREHKPWFESWTVLYWAWWCSWAPFVGLFIARISKGRTIREFVFGVLLIPGLFGVLWFTVFGNTAIWLNDGVAGGVLEKMTSSPETLLFKFFNYLPLPELTSIVSLLVISLFFVTSADSGIYVLNNITSRDKGLSAPRWQAVMWGVLMSAVAVLLMRSGGLGNLQSMTLIVSLPFALLMLIMCFSLWKGLSADKKYFETRVNPTSVFWTGGKWKERLVQIMSQTQEQDILKFLKHTASPAMHELQRELSEEYGLSVRVDKMFHQDEPAIEFVIRKETMRDFMYGIKSVGQDVSDQLINDGKLPHIRHQTTYKPYAYFFDGRVGYDVQYMNKDELIADILKNYERYLMLLDDVGQELMAHEQVELAE

SEQ ID NO: 10625 - protein, 428 aa, Neisseria meningitidis Z2491 [sequence omitted]

SEQ ID NO: 10626 - protein, 477 aa, Neisseria meningitidis Z2491
MNEYSQLIKHPDISLSPISDGIGVGNPATGEILAYVRNTGSDKLKNLIQKAAAAQKLWAAKTALERADILWRWYFLVKENKEALARLMTMEQGKSLTESRGEIDYAASFVRWFAEEARRIDGDVLTSVKASQKLIVLKQPVGVTAAITPWNFPSAMIARKAAPALAVGCAMIVKPASLTPLSAYALVVLAYEAGVPQDLLPVVSGRASEIGREFATNPIIRKISFTGSTEVGAKIFADSAADIKKLSLELGGNAPFIVFDDADLDKAVEGALASKFRNSGQTCVCTNRVYAQSGIYDAFCRKLSEKAAALKLGNGLEDGVNQGPLIEEKAVEKVEQHIADALSKGAVCLTGGKRSALGGTFFEPTVLSGVTAQMAVAREETFGPLCPVFRFETEAEVIEAANNTEYGLAAYLFTADTARQWRVGEALEYGMVGINTGLISNEAAPFGGVKRSGLGREGSKYGADEYLELKYLCMDVG

SEQ ID NO: 10627 - protein, 642 aa, Neisseria meningitidis Z2491
MSKNQNHEEYQDDARPLTIEEQRARLRQLIIMGKERGYITYSEINDALPDDMSDADQIDNIVSMISGLGIQVTEHAPDAEDILLSDNAAVTDDDAVEEAEAALSSADSEFGRTTDPVRMYMREMGQVDLLTREDEIIIAKKIENALKNMVQAISACPGSIAEILELIEKIRKDEIRVDEVVEAIIDPNEVLLNELGLGHLETTAPEKPSNDNSDENEDDEESEEDADEISAANLAELKQKVIGHFAQIEKDYKKMIGRLEKHHSRHKDYLAYRDAIANKLLEVRFATRQIDSLSSSLRGKVENIRKLEREIRDICLDRVHMERDYFIQNFLPEITNLEWIEEEIAKGRVWSDALDRFRHAILEKQTELADMEKETRISIEELKEINKNMVSSEKETAAAKQEMIQANLRLVISIAKKYTNRGLQFLDLIQEGNIGLMKAVDKFEYRRGYKFSTYATWWIRQAITRSIADQARTIRIPVHMIETINKMNRISRQHLQETGEEPDSAKLAELMQMPEDKIRKIMKIAKEPISMETPIGDDDDSHLGDFIEDANNVAPADAAMYTSLHEVTKEILESLTPREAKVLRMRFGIDMNTDHTLEEVGRQFDVTRERIRQIEAKALRKLRHPTRSDRLRSFLDSEDSKL

SEQ ID NO: 10628 - protein, 394 aa, Neisseria meningitidis Z2491
MGKHILLGVTGSIAAYKSCELVRLLKKQGHSVTVVMSRSATEFVSPLTFQALSGNPVLTDTHGSNGSNGMEHINLTRNADVFLIAPASMNTVAKICNGVADNLLTNLAAARKCPLAIAPAMNVEMWLNPANQRNIAQLVSDGITVYMPGLGEQACGENGMGRMPEPAELLDLLPDLWTPKILRGKKILITAGATFEAIDPVRGITNTSSGKMGVALARACRAAGAEVSLIHGQLQTELPFGISDTVQAVSAEDMHRAVHRLIEKQDAFISVAAVSDYKVKNRSTQKFKKDKNAKPLSIELDENPDILASIASLPNPPFCIGFAAETENVMAYAREKRIKKKIPVIVANDVSIAMGKPTNRITIIGDDGELSFPETSKDEAAMQIVERLAGYLNK

SEQ ID NO: 10629 - protein, 354 aa, Neisseria meningitidis Z2491
MEKEFRILNIVSAKIWGGGEQYVYDVSKALGLRDCTMFTAVNKNNELMHRRFSEVSSVFTTRLHTLNGLFSLYALTRFIRKNRISHLMIHTGKIAALSILLKKLTGVRLIFVKHNVVANKTDFYHRLIQKNTDRFICVSRLVYDVQTADNPFKEKYRIVHNGIDTGRFPPPQEKPDSRFFTVAYAGRISPEKGLENLIEACVILHRKYPQIRLKLAGDGHPDYMCRLKRDVSASGAEPFVSFEGFTEKLASFYRQSDVVVLPSLVPEAFGLSLCEAMYCRTAVISNTLGAQKEIIEHHQSGILLDRLTPESLADEIERLVLNPETKNALATAGHQCVANRFTINHTADKLLDAI

SEQ ID NO: 10630 - protein, 451 aa, Neisseria meningitidis Z2491
MSEYTPQTAKQGLPALAKSTIWMLSFGFLGVQTAFTLQSSQMSRIFQTLGADPHSLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYNPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 10631 - protein, 602 aa, Arabidopsis thaliana
MAATMVKHEILNYSEDEEENYSDEGDWGDWKADDNGIEGGEEEEEDDGDDSESDFLCLFCDSHFVSCDLLFEHCRLSHGFDFHGVRKELKLDFYSSFKLINYIRSQVAENMCFSWKIEADDYKDVKFPWDEEKYLKPFWQEDSLLYSFADDEEDEEVTFDREEVMEELQKLGDLSIDVEALGESSMSNSDKCNINGSKDVTSLSNCNGLKQSSADDLIVNGKDAEPKVCDGRLVNRNIRKVNENYFGSYSSFGIHREMLSDKVRTEAYRDALLKNPTLLNGSVVMDVGCGTGILSLFAAKAGASRVVAVEASEKMAKVATKQIAKDNKVFNDNEHNGVLEVAHSMVEELDKSIQIQPHSVDVLVSEWMGYCLLYESMLSSVLYARDRWLKPGGAILPDTATMFVAGFGKGATSLPFWEDVYGFDMSSIGKEIHDDTTRLPIVDVIAERDLVTQPTLLQTFDLATMKPDEVDFTATATLEPTESEAKTRLCHGVVLWFDTGFTSRFCKENPTVLSTSPYTPPTHWAQTILTFQEPISVAPASVLSGNDRREAIGTEECPASSIHLRVSVARAHEHRSIDISLEATGLSSKGQKRHWPVQIFNL

SEQ ID NO: 10632 - protein, 742 aa, Deinococcus radiodurans
MEWGEDADGPVHLVVGIAAASDEHLQILRRLTRVLGDEALVERLWTTTDAGDLIEALTGERPVAAAAAAPGLPYSAQVTLPNPQGLHARPATLLAGMVKKAGAKARLTRDDGRSADATKLMELLSLGLTRGTPLTVSTDQQALLRPLVDAIQSGLGDDLSAAAPQAAAPPTTRTPDWVPQQVGAALEGVGAADGLVVGTTRQHLQRSLTVTDEPADPAQGAAQLDAALQAAAADLDSMMADVHARFGADKAAIFAAHKELLADEGTVQDAVSRILDGHGPAWAYQQATNERIAQLQKLDDPVLAGRASDLGDVQRRVLRHLLGLGEDTVQTGAAPVILLAPDLTPSDTARLGPDTLLGFATAQGGPTSHTAIIARGLGLPAIVAAGAGVLEVPDGTLAILDGSAGRLYLNPSENDVQAARERMAVLTAEREAARAARHQPGGTRDGVRVEIAANINRAADAAGALDAGAEGVGLMRTEFLFLERDSAPSEANQEQEYRAMAAALGERPLIIRTLDIGGDKEVPYLGLAREDNSFLGMRGIRLCFERPDLFLPQLRAIARVAKDHPNVHVMFPMIATLEDFRRARAILDEVRAEVGAPHIPLGVMIEVPSAALLAEALAPEVDFFSVGTNDLTQYTLAMDRLHPQLARQTDAMHPAVLWLIKRTVNAAQRHGKWVGVCGGAAGDDVGALVLTGLGVKELSVSTPQVAAVKAALRGRSSQDLQQLAAQALTQTDAAAVRALVRG

SEQ ID NO: 10633 - protein, 1095 aa, Drosophila melanogaster
MTKKYEFDWIIPVPPELTTGCVFDRWFENEKETKENDFERDALFKVDEYGFFLYWKSEGRDGDVIELCQVSDIRAGGTPKDPKILDKVTKKNGTNIPELDKRSLTICSNTDYINITYHHVICPDAATAKSWQKNLRLITHNNRATNVCPRVNLMKHWMRLSYCVEKSGKIPVKTLAKTFASGKTEKLVYTCIKDAGLPDDKNATMTKEQFTFDKFYALYHKVCPRNDIEELFTSITKGKQDFISLEQFIQFMNDKQRDPRMNEILYPLYEEKRCTEIINDYELDEEKKKNVQMSLDGFKRYLMSDENAPVFLDRLDFYMEMDQPLAHYYINSSHNTYLSGRQIGGKSSVEMYRQTLLAGCRCVELDCWNGKGEDEEPIVTHGHAYCTEILFKDCIQAIADCAFVSSEYPVILSFENHCNRAQQYKLAKYCDDFFGDLLLKEPLPDRPLDPGLPLPPPCKLKRKILIKNKRMKPEVEKVELELWLKGELKTDDDPEEDASAGKPPEAAAAPAPAPEAAAAAEGAAEGGGGAEAEAAAANYSGSTTNVHPWLSSMVNYAQPIKFQGFDKAIEKNIAHNMSSFAESAGMNYLKQSSIDFVNYNKRQMSRIYPKGTRADSSNYMPQVFWNAGCQMVSLNFQSSDLPMQLNQGKFEYNGGCGYLLKPDFMRRADKDFDPFADAPVDGVIAAQCSVKVIAGQFLSDKKVGTYVEVDMFGLPSDTVKKEFRTRLVANNGLNPVYNEDPFVFRKVVLPDLAVLRFGVYEESGKILGQRILPLDGLQAGYRHVSLRTEANFPMSLPMLFVNIELKIYVPDGFEDFMAMLSDPRGFAGAAKQQNEQMKALGIEEQSGGAARDAGKAKEEEKKEPPLVFEPVTLESLRQEKGFQKVGKKQIKELDTLRKKHAKERTSVQKTQNAAIDKLIKGKSKDDIRNDANIKNSINDQTKQWTDMIARHRKEEWDMLRQHVQDSQDAMKALMLTVQAAQIKQLEDRHARDIKDLNAKQAKMSADTAKEVQNDKTLKTKNEKDRRLREKRQNNVKRFMEEKKQIGVKQGRAMEKLKLAHSKQIEEFSTDVQKLMDMYKIEEEAYKTQGKTEFCA

SEQ ID NO: 10634 - protein, 504 aa, Escherichia coli O157:H7 EDL933
  unsure (1)..(504): unsure at all Xaa locations
MKNEKRKTGIEPKVFFPPLIIVGILCWLTVRDLDAANVVINAVFSYVTNVWGWAFEWYMVVMLFGWFWLVFGPYAKKRLGNEPPEFSTASWIFMMFASCTSAAVLFWGSIEIYYYISTPPFGLEPNSTGAKELGLAYSLFXWGPLPWATYSFLSVAFAYFFFVRKMEVIRPSSTLVPLVGEKHAKGLFGTIVDNFYLVALIFAMGTSLGLATPLVTECMQWLFGIPHTLQLDAIIITCWIILNAICVACGLQKGVRIASDVRXYLSFLMLGWVFIVSGASFIMNYFTDSVGMLLMYLPRMLFYTDPIAKGGFPQGWTVFYWAWWVIYAIQMSIFLARISRGRTVRELCFGMVMGLTASTWILWTVLGSNTLLLIDKNIINIPNLIEQYGVARAIIETWAXLPLSTATMWGFFILCFIATVTLVNACSYTLAMSTCREVRDGEEPPLLVRIGWSILVGIIGIVLLALGGLKPIQTAIIAGGCPLFFVNIMVTLSFIKDAKQNWKD

SEQ ID NO: 10635 - protein, 347 aa, Escherichia coli O157:H7 EDL933
MRIEEDLKLGFKDVLIRPKRSTLKSRSDVELERQFTFKHSGQSWSGVPIIAANMDTVGTFSMASALASFDILTAVHKHYSVEEWQAFINNSSADVLKHVMVSTGTSDADFEKTKQILDLNPALNFVCIDVANGYSEHFVQFVAKAREAWPTKTICAGNVVTGEMCEELILSGADIVKVGIGPGSVCTTRVKTGVGYPQLSAVIECADAAHGLGGMIISDGGCTTPGDVAKAFGGGADFVMLGGMLAGHEESGGRIVEENGEKFMLFYGMSSESAMKRHVGGVAEYRAAEGKTVKLPLRGPVENTARDILGGLRSACTYVGASRLKELTKRTTFIRVQEQENRIFNNL

SEQ ID NO: 10636 - protein, 398 aa, Escherichia coli O157:H7 EDL933
MKQLTILGSTGSIGCSTLDVVRHNPEHFRVVALVAGKNVTRMVEQCLEFSPRYAVMDDEASAKLLKTMLQQQGSRTEVLSGQQAACDMAALEDVDQVMAAIVGAAGLLPTLAAIRAGKTILLANKESLVTCGRLFMDAVKQSKAQLLPVDSEHNAIFQSLPQPIQHNLGYADLEQNGVVSILLTGSGGPFRETPLRDLATMTPDQACRHPNWSMGRKISVDSATMMNKGLEYIEARWLFNASASQMEVLIHPQSVIHSMVRYQDGSVLAQLGEPDMRTPIAHTMAWPNRVNSGVKPLDFCKLSALTFAAPDYDRYPCLKLAMEAFEQGQAATTALNAANEITVAAFLAQQIRFTDIAALNLSVLEKMDMREPQCVDDVLSVDASAREVARKEVMRLAS

SEQ ID NO: 10637 - protein, 267 aa, Escherichia coli O157:H7 EDL933
MAIPAFGLGTFRLKDDVVISSVKTALELGYRAIDTAQIYDNEAAVGLAIAESGVPRHELYITTKIWIENLSKDKLIPSLKESLQKLRTDYVDLTLIHWPSPNDEVSVEEFMQALLEAKKEGLTREIGISNFTIPLMEKAIAAVGAENIATNQIELSPYLQNRKVVAWAKQHGIHITSYMTLAYGKALKDEVIARIAAKHNATPAQVILAWAMGEGYSVIPSSTKRENLESNLKAQNLQLDAEDKKAIAALDCNDRLVSPEGLAPEWD

SEQ ID NO: 10638 - protein, 191 aa, Escherichia coli O157:H7 EDL933
MQKVKLNNGIEMPLLGFGVFQMTDAAECERAVIDAINTGYRLIDTAASYQNEPQVGNALKQSGIARNELFVTTKLWLQDTSYEGAKAQFERSLNRLQLDYVDLYLIHQPYGDVHGAWRAMEELQQAGKIRAIGVSNFHPDRLADLIAFNNVVPAVNQVEVNPFNQQLHAVPWMQSRGIQPEAWAPFAVTGR

SEQ ID NO: 10639 - protein, 294 aa, Escherichia coli O157:H7 EDL933
MEGLTVEFSVLSNNLKMPMMGFGVFQVTDKNVCKQSVLNAIRTGYRLIDTAAVYGNEDAVGEAVREAISEGLCTREELFITSKLWVQDMLNQDTAAAGIEASLKKSGLEYFDLYLLHQAMRDYFSAWRALEDAYEEGKLKAIGVSNFYPHVLANFCETVRVKPMVNQVELHPYFAQPEALATMKYYNVQPEAWAPLGGGRHKPFENNLLQSIADAHQKSISQVILRWNIQRGVVVIPKSTHQQRIEENFAIWDFSLTEKEMAQISSLDLGYVGESVKHFNPEFVRGCLAVKIHD

SEQ ID NO: 10640 - protein, 490 aa, Escherichia coli O157:H7 EDL933
MSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPSLEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCNAAFEQKILARVERIRAGDVFDPQTNFGPLVSFPHRDNVLRYIAKGKEEGARVLCGGDVLKGDGLDNGAWVAPTVFTDCSDEMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 10641 - protein, 677 aa, Escherichia coli O157:H7 EDL933; identical to SEQ ID NO: 796

SEQ ID NO: 10642 - protein, 369 aa, Escherichia coli O157:H7 EDL933
MKSRAAVAFAPGKPLEIVEIDVAPPKKGEVLIKVTHTGVCHTDAFTLSGDDPEGVFPVVLGHEGAGVVVEVGEGVTSVKPGDHVIPLYTAECGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFDLARRFGATDCINPNDYDKPIKDVLLDINKWGIDHTFECIGNVNVMRAALESAHRGWGQSVIIGVAGSGQEISTRPFQLVTGRVWKGSAFGGVKGRSQLPGMVEDAMKGDIDLEPFVTHTMSLDEINDAFDLMHEGKSIRTVIRY

SEQ ID NO: 10643 - protein, 620 aa, Escherichia coli O157:H7 EDL933
MSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKNRRTVCVIGDGAITAGMAFEAMNHAGDIRPDMLVVLNDNEMSISENVGALNNHLAQLLSGKLYSSLREGGKKVFSGVPPIKELLKRTEEHIKGMVVPGTLFEELGFNYIGPVDGHDVLGLITTLKNMRDLKGPQFLHIMTKKGRGYEPAEKDPITFHAVPKFDPSSGCLPKSSGGLPSYSKIFGDWLCETAAKDNKLMAITPAMREGSGMVEFSRKFPDRYFDVAIAEQHAVTFAAGLAIGGYKPIVAIYSTFLQRAYDQVLHDVAIQKLPVLFAIDRAGIVGADGQTHQGAFDLSYLRCIPEMVIMTPSDENECRQMLYTGYHYNDGPSAVRYPRGNAVGVELTPLEKLPIGKGIVKRRGEKLAILNFGTLMPEAAKVAESLNATLVDMRFVKPLDETLILEMAASHEALVTVEENAIMGGAGSGVNEVLMAHRKPVPVLNIGLPDFFIPQGTQEEMRAELGLDAAGMEAKIKAWLA

SEQ ID NO: 10644 - protein, 112 aa, Escherichia coli O157:H7 EDL933
MKLVTVIIKPFKLEDVREALSSIGIQGLTVTEVKGFGRQKGHAELYRGAEYSVNFLPKVKIDVAIADDQLDEVIDIVSKAAYTGKIGDGKIFVAELQRVIRIRTGEADEAAL

SEQ ID NO: 10645 - protein, 493 aa, Escherichia coli O157:H7 EDL933
  unsure (1)..(493): unsure at all Xaa locations
MNKHASQPRAIYYVVALQIWEYFSFYGMRALLILYLTNQLKYNDTHAYELFSAYCSLVYVTPILGGFLADKVLGNRMAVMLGALLMAIGHVVLGASEIHPSFLYLSLAIIVCGYGLFKSNVSCLLGELYEPTDPRRDGGFSLMYAAGNVGSIIAPIACGYAQEEYSWAMGFGLAAVGMIAGLVIFLCGNRHFTHTRGVNKKVLRATNFLLPNWGWLLVLLVATPALITVLFWKEWSVYALIVATIIGLGVLAKIYRKAENQKQRKELRLIVTLTFFSMLFWAFAQQGGSSISLYIDRFVNRDMFGYTVPTAMFQSINAFAVMLCGVFLAWVVKESVAGNRTVRIWGKFALGLGLMSAGFCILTLSARWSAMYGHSSLPXMVLGLAVMGFAELFIDPVAMSQITRIEIPGVTGVLTGIYMLLSGAIANYLAGVIADQTSQASFDASGAINYSINAYIEVFDQITWGALACVGVVLMIWLYQALKFRNRALALES

SEQ ID NO: 10646 - protein, 210 aa, Escherichia coli O157:H7 EDL933
MSMITLWGRNNSTNVKKVLLTLEELELPYEQILAGREFGINHDADFLAMNPNGLVPLLRDDESDLILWESNAIVRYLAAQYGQKRLWIDSPARRAEAEKWMDWANQTLSNAHRGILMGLVRTPPEERDQAAIDASCKECDALFALLDAELAKVKWFSGDEFGVGDIAIAPFIYNLFNVGLTWTPRPNLQRWYQQLTERPAVRKVVMIPVS

SEQ ID NO: 10647 - protein, 904 aa, Escherichia coli O157:H7 EDL933
MGFALMALLTLTSTLVGWYNLRFISQVEKDNTQALIPTMNMARQLSEASAWELFAAQNLTSADNEKMWQAQGRMLTAQSLKINALLQALREQGFDTTAIEQQEQEISRSLRQQGELVGRRLQLRQQQQRLSQQIVAAADEIARLAQGQANNAATSAGATQAGIYDLIEQDQRQAAESALDRLIDIDLEYVNQMNELRLSALRVQQMVMNLGLEQIQKNAPTLEKQLNNAVKILQRRQIRIEDPGVRAQVATTLTTVSQYSDLLALFQQDSEISNHLQTLAQNNIAQFAQFSSEVSQLVDTIELRNQHGLAHLEKASARGQYSLLLLGMVSLCALILILWRVVYRSVTRPLAEQTQALQRLLDGDIDSPFPETAGVRELDTIGRLMDAFRSSVHALNRHREQLAAQVKARTAELQELVIEHRQARAEAEKASQAKSAFLAAMSHEIRTPLYGILGTAQLLADNPALNAQRDDLRAITDSGESLLTILNDILDYSAIEAGGKNVSVSDEPFEPRPLLESTLQLMSGRVKGRPIRLATAIADDVPTALMGDPRRIRQVITNLLSNALRFTDEGQIVLRSRTDGEQWLVEVEDSGCGIDPAKLAEIFQPFIQVSGKRGGTGLGLTISSRLAQAMGGELSATSTPEVGSCFCLRLPLRVATAPVPKTVNQAVRLDGLRLLLIEDNPLTQRITVEMLNTSGAQVVAIGNAAQALETLQNSEPFAAALVDFDLPDVNGITLARQLARQYPSLVLIGFSAHVIDETLRQRTSSLFRGIIPKPVPREVLGQLLAHYLQLQANNDLPLDVSQLNEDAQLMGTEKIHEWLALFTQHALPLLDEIDIARATQDSEKIKRAAHQLKSSCSSLGMRSASQLCAQLEQQPLSAPLPHEEITRSVAALEAWLNKKDLNAI

SEQ ID NO: 10648 - protein, 251 aa, Escherichia coli O157:H7 EDL933
MYKYNDLNEKTVLVTGASGDIGLGICEKYLEQNCDVYALYKSNDVQLTALKASHPAGDKLHIVQCDLACPQSVSALCEQIERQAGKIDVLVNNAGIVKDSLFASMSYEDFTQVIETNMFSIFRLTKDALMLLRAAENPAIINVASIAALIPSVGQANYSASKGAILGFTRTLAAEMAPWGVRVNAVAPGMIESKMVKKVSRAVVRAVTSTIPLRRLGKCEEVANTIVFLSSSASSYIVGQTIVIDGGLVMR

SEQ ID NO: 10649 - protein, 244 aa, Escherichia coli O157:H7 EDL933
MNFEGKIALVTGASRGIGRAIAETLAARGAKVIGTATSENGAQAISDYLGANGKGLMLNVTDPASIESVLEKIRAEFGEVDILVNNAGITRDNLLMRMKDEEWNDIIETNLSSVFRLSKAVMRAMMKKRHGRIITIGSVVGTMGNGGQANYAAAKAGLIGFSKSLAREVASRGITVNVVAPGFIETDMTRALSDDQRAGILVQVPAGRLGGAQEIANAVAFLASDEAAYITGETLHVNGGMYMV

SEQ ID NO: 10650 - protein, 266 aa, Escherichia coli O157:H7 EDL933
  unsure (1)..(266): unsure at all Xaa locations
MLAGLRFMLVAFPAIFFVARPKVPLNLLLGYGLTISFAQFAFLFCAINFGMPAGLASLVLQAQAFFTIVLGAFTFGERLHGKQLAGIALAISGVLVLIEDSFNGQHVAMLGFMLTLAAAFSWASGNIFNKKIMSHSSRPAVMSLVVWSALIPIIPFFVASLILDGSGKMIHSLVTIDMTTILALMYLAFVATIVGYGIWGTLLGRYETWRVAPLSLLVPVVGLASAALLLDERLTGLQFLGAVLIMAGLYINVFGLQWRKAVKVRX

SEQ ID NO: 10651 - protein, 470 aa, Escherichia coli O157:H7 EDL933
MTHKGDTPMTITPATHAISINPATGEQLSVLPWAGADDIENALQLAAAGFRDWRETNIDYRAEKLRDIGKALRARSEEMAQMITREMGKPINQARAEVAKSANLCDWYAEHGPAMLKAEPTLVENQQAVIEYRPLGTILAIMPWNFPLWQVMRGAVPIILAGNGYLLKHAPNVMGCAQLIAQVFKDAGIPQGVYGWLNADNDGVTQMIKDSRIAAITVTGSVRAGAAIGAQAGAALKKCVLELGGSDPFIVLNDADLELAVKAAVAGRYQNTGQVCAAAKRFIIEEGIASAFTERFVAAAAALKMDDPRDEENALGPMARFDLRDELHHQVEKTLAQGARLLLGGEKMAGAGNYYPPTVLANVTPEMTAFREEMFGPVAAITIAKDAEHALELANDSEFGLSATIFTTDETQARQMAARLECGGVFINGYCASDARVAFGGVKKSGFGRELSHFGLHEFCNIQTVWKDRI

SEQ ID NO: 10652 - protein, 466 aa, Escherichia coli O157:H7 EDL933
MDKKQVTDLRSELLDSRFGAKSISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 10653 - protein, 474 aa, Escherichia coli O157:H7 EDL933
MQHKLLINGELVSGEGEKQPVYNPATGDVLLEIAEASAEQVDAAVRAADAAFAEWGQTTPKVRAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINVLFGRGKTVGDPLTGHPKVRMVSLTGSIATGEHIISHTAPSIKRTHMELGGKAPVIVFDDADIEAVVEGVRTFGYYNAGQDCTVACRIYAQKGIYDTLVEKLGAAVATLKSGAPDDESTELGPLSSLAHLERVSKAVEEAKATGHIKVITGGEKRKGNGYYYAPTLLAGALQDDAIVQKEVFGPVVSVTLFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 10654 - protein, 479 aa, Escherichia coli O157:H7 EDL933
MSVPVQHPMYIDGQFVTWRGDAWIDVVNPATEAVISRIPDGQAEDARKAIDAAERAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVALGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 10655 - protein, 495 aa, Escherichia coli O157:H7 EDL933
MNFHHLAYWQDKALSLAIENRLFINGEYTAAAENETFETVDPVTQAPLANIARGKSVDIDRAVSAARGVFERGDWSLSSPAKRKAVLNKLADLIEANAEELALLETLDTGKPIRHSLRDDIPGAARAIRWYAEAIDKVYGEVATTSSHELAMIVREPVGVIAAIVPWNFPLLLTCWKLGPALAAGNSVVLKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEESIADEFLALLKQQAQNWQPGHPLDPATTMGTLIDCAHADSVHSFIQEGESKGQLLLDGRNAGLAVAIGPTIIVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 10656 - protein, 255 aa, Escherichia coli O157:H7 EDL933
MFNSDNLRLDGKCAIITGAGAGIGKEIAITFATAGASVVVSDINADAANHVVDEIQQLGGQAFACRCDITSEQELSALADFAISKLGKVDILVNNAGGGGPKPFDMPMADFRRAYELNVFSFFHLSQLVAPEMEKNGGGVILTITSMAAENKNINMTSYASSKAAASHLVRNMAFDLGEKNIRVNGIAPGAILTDALKSVITPEIEQKMLQHTPIRRLGQPQDIANAALFLCSPAASWVSGQILTVSGGGVQELN

SEQ ID NO: 10657 - protein, 457 aa, Escherichia coli O157:H7 EDL933
MQKYISEARLLLALAIPVILAQIAQTAMGFVDTVMAGGYSATDMAAVAIGTSIWLPAILFGHGLLLALTPVIAQLNGSGRRERIAHQVRQGFWLAGFVSVLIMLVLWNAGYIIRSMENIDPALADKAVGYLRALLWGAPGYLFFQVARNQCEGLAKTKPGMVMGFIGLLVNIPVNYIFIYGHFGMPELGGVGCGVATAAVYWVMFLAMVSYIKRARSMRDIRNEKGTAKPDPAVMKRLIQLGLPIALALFFEVTLFAVVALLVSPLGIVDVAGHQIALNFSSLMFVLPMSLAAAVTIRVGYRLGQGSTLDAQTAARTGLMVGVCMATLTAIFTVSLREQIALLYNDNPEVVTLAAHLMLLAAVYQISDSIQVIGSGILRGYKDTRSIFYITFTAYWVLGLPSGYILALTDLVVEPMGPAGFWIGFIIGLTSAAIMMMLRMRYLQRLPSAIILQRASR

SEQ ID NO: 10658 - protein, 310 aa, Escherichia coli O157:H7 EDL933
MDNLDVICIGAAIVDIPLQPVSKNIFDVDSYPLERIAMTTGGDAINEATIISRLGHCTALMSRIGKDAAGQFILDHCRKENIDIQSLKQDVNIDTSINVGLVTEDGERTFVTNRNGSLWKLNIDDVDFARFSQAKLLSLASIFNSPLLDGKALTEIFTQAKARQMNICADMIKPRLNETLDDICEALSYVNYAEAKLLTGKETLDEIADSFLACGVKTVVIKTGKDGCFIKRGDMTMKVPAVAGITAIDTIGAGDNFASGFIAALLEGKNLRECARFANATAAISVLSVGATTGVKNRKLVEQLLEEYEG

SEQ ID NO: 10659 - protein, 481 aa, Escherichia coli O157:H7 EDL933
MVLLAMGLVIYLATSKYGNIRLGEGKPEYSTLSWLFMFICAGLGSSTLYWGVAEWAYYYQTPGLNIAPRSQQALEFSVPYSFFHWGISAWATYTLASLIMAYHFHVRKNKGLSLSGIIAAITGVRPQGPWGKLVDLMFLIATVGALTISLVVTAATFTRGLSALTGLPDNFTVQAFVILLSGGIFCLSSWIGINNGLQRLSKMVGWGAFLLPLLVLIVGPTEFITNSIINAIGLTTQNFLQMSLFTDPLGDGSFTRNWTVFYWLWWISYTPGVAMFVTRVSRGRKIKEVIWGLILGSTVGCWFFFGVMESYAIHQFINGVINVPQVLETLGGETAVQQVLMSLPAGKLFLAAYLGVMIIFLASHMDAVAYTMAATSTRNLQEGDDPDRGLRLFWCVVITLIPLSILFTGASLETMKTTVVLTALPFLVILLVKVGGFIRWLKQDYADIPAHQVEHYLPQTPVEALEKTPVLPAGTVFKGDN

SEQ ID NO: 10660 - protein, 306 aa, Escherichia coli O157:H7 EDL933
  unsure (1)..(306): unsure at all Xaa locations
MRFRQLLPLFGALFALYIIWGSTYFVIRIGVESWPPLMMAGVRFLAAGILLLAFLLLRGHKLPPLRPLLNAALIGLLLLAVGNGMVTVAEHQNVPSGIAAVVVATVPLFTLCFSRLFGIKTRKLEWVGIAIGLAGIIMLNSGGNLSGNPWGAILILIGSISWAFGSVYGSRITLPVGMMAGAIEMLAAGVVLMIASMIAGEKLTALPSLSGFLAVGYLALFGSIIAINAYMYLIRNVSPALATSYAYVNPVVAVLLGTGLGGXTLSKIEWLALGVIVFAVVLVTLGKYLFPAKPVVAPVIQDASSE

SEQ ID NO: 10661 - protein, 162 aa, Escherichia coli O157:H7 EDL933
MLEDLRANSWSLRPCCMVLAYRVAHFCSVWRKKNVLNNLWAAPLLVLYRIITECFFGYEIQAAATIGRRFTIHHGYAVVINKNVVAGDDFTIRHGVTIGNRGADNMACPHIGNGVELGANVIILGDITLGNNVTVGAGSVVLDSVPDNALVVGEKARVKVIK

SEQ ID NO: 10662 - protein, 379 aa, Escherichia coli O157:H7 EDL933
  unsure (1)..(379): unsure at all Xaa locations
MVYLYKKGVGMNEQSQAKSPEALRAMVAGTLANFQHPTLKHNLTTLKALHHVAWMDDTLHVELVMPFVWHSAFEELKEQCSAELLRITGAKAIDWKLSHNIATLKRVKNQPGINGVKNIIAVSSGKGGVGKSSTAVNLALALAAEGAKVGILDADIYGPSIPTMLGAENQRPTSPDGTHMAPIMSHGLATNSIGYLVTDDNAMVWRGPMASKALMQMLQETLWPDLDYLVLDMPPGTGDIQLTLAQNIPVTGAVVVTTPQDIALIDAKKGIVMFEKVEVPVLGIVENMSVHICSNCGHHEPIFGTGGAEKLAEKYHTQLLGQMPLHISLREDXDKGTPTVISRPESEFTAIYRQLADRVAAQLYWQGEVIPGEISFRAV

SEQ ID NO: 10663 - protein, 253 aa, Escherichia coli O157:H7 EDL933
  unsure (1)..(253): unsure at all Xaa locations
MAQVAIITASDSGIGKECALLLAQQGFDIGITWXSDEEGAKDTAREVVSHGVRAEIVQLDLGNLPEGAQALEKLIQRLGRIDVLVNNAGAMTKVPFLDMAFDEWRKIFTVDVDGAFLCSQIAARQMVKQGQGGRIINITSVHEHTPLPDASAYTAAKHALGGLTKAMALELVRHKILVNAVAPGAIATPMNGMDDSDVKPDAEPSIPLRRFGATHEIASLVAWLCSEGANYTTGQSLIVDGGFMLANPQFNPE

SEQ ID NO: 10664 - protein, 933 aa, Escherichia coli O157:H7 EDL933
MFRALALVLWLLIAFSSVFYIVNALHQRESEIRQEFNLSSDQAQRFIQRTSDVMKELKYIAENRLSAENGVLSPRGRETQADVPAFEPLFADSDCSAMSNTWRGSLESLAWFMRYWRDNFSAAYDLNRVFLIGSDNLCMANFGLRDMPVERDTALKALHERINKYRNAPQDDSGSNLYWISEGPRPGVGYFYALTPVYLANRLQALLGVEQTIRMENFFLPGTLPMGVTILDENGHTLISLTGPESKIKADPRWMQERSWFGYTEGFRELVLKKNLPPSSLSIVYSVPVDKVLERIRMLILNAILLNVLAGAALFTLARMYERRIFIPAESDALRLEEHEQFNRKIVASAPVGICILRTADGVNILSNELAHTYLNMLTHEDRQRLTQIICGQQVNFVDVLTSNNTNLQISFVHSRYRNENVAICVLVDVSSRVKMEESLQEMAQAAEQASQSKSMFLATVSHELRTPLYGIIGNLDLLQTKELPKGVDRLVTAMNNSSSLLLKIISDILDFSKIESEQLMIEPREFSPREVMNHITANYLPLVVRKQLGLYCFIEPDVPVALNGDPMRLQQVISNLLSNAIKFTDTGCIVLHVRADGDYLSIRVRDTGVGIPAKEVVRLFDPFFQVGTGVQRNFQGTGLGLAICEKLISMMDGDISVDSEPGMGSQFTVRIPLYGAQYPQKKGVEGLSGKRCWLAVRNASLCQFLETSLQRSGIVVTTYEGQEPTPEDVLITDEVVSKKWQGRAVVTFCRRHIGIPLEKAPGEWVHSVAAPHELPALLARIYLIEMESDDPANALPSTDKAVSDNDDMMILVVDDHPINRRLLADQLGSLGYQCKTANDGVDALNVLSKNHIDIVLSDVNMPNMDGYRLTQRIRQLGLTLPVIGVTANALAEEKQRCLESGMDSCLSKPVTLDVIKQTLTVYAERVRKSRES

SEQ ID NO: 10665 - protein, 1197 aa, Escherichia coli O157:H7 EDL933
MKFLPYIFLLCCGLWSTISFADEDYIEYRGISSNNRVTLDPLRLSNKELRWLASKKNLVIAVHKSQTATLLHTDSQQRVRGINADYLNLLKRALNIKLTLREYADHQKAMDALEEGEVDIVLSHLVASPPLNDDIAATKPLIITFPALVTTLHDSMRPLTSSKPVNIARVANYPPDEVIHQSFPKATIISFTNLYQALASVSAGQNDYFIGSNIITSSMISRYFTHSLNVVKYYNSPRQYNFFLTRKESVILNEVLNRFVDALTNEVRYEVSQNWLDTGNLAFLNKPLELTEHEKQWIKQHPDLKVLENPYSPPYSMTDENGSVRGVMGDILNIITLQTGLNFSPITVSHNIHAGTQLNPGGWDILPGAIYSEDRENNVLFAEAFITTPYVFVMQKAPDSEQTLKKGMKVAIPYYYELHSQLKEMYPEVEWIKVDNASAAFHKVKEGELDALVATQLNSRYMIDHYYPNELYHFLIPGVPNASLSFAFPRGEPELKDIINKALNAIPPSEVLRLTEKWIKMPNVTIDTWDLYSEQFYIVTTLSVLLVGSSLLWGFYLLRSVRRRKVIQGDLENQISFRKALSDSLPNPTYVVNWQGNVISHNSAFEHYFTADYYKNAMLPLENSESPFKDVFSNTHEVTAETKENRTIYTQVFEIDNGIEKRCINHWHTLCNLPASEHAVYICGWQDITETRDLIHALEVERNKAINATVAKSQFLATMSHEIRTPISSIMGFLELLSGSGLSKEQRVEAISLAYATGQSLLGLIGEILDVDKIESGNYQLQPQWVDIPTLVQNTCHSFGAIAASKSIALSCSSTFPDHYLVKIDPQAFKQVLSNLLSNALKFTTEGAVKITTSLVHIDDNHAVIKMTIMDSGSGLSQEEQQQLFKRYSQTSAGRQQTGSGLGLMICKELIKNMQGDLSLESHPGIGTTFTITIPVEIIQQVAAVEAKAEQPITLPEKLSILIADDHPTNRLLLKRQLNLLGYDVDEATDGVQALHKVSMQHYDLLITDVNMPNVDGFELTRKLREQNSSLPIWGLTANAQANEREKGLNCGMNLCLFKPLTLDVLKTHLSQLHQVAHIVPQYRHLDIEALKNNTANDLQLMQEILMTFQHETHKDLPAAFHALEAGDNRTFHQCIHRIHGAANILNLQKLINISHQLEITPVSDDSKPEILQLLNSVKEHIAELDQEIAVFCQQNN

SEQ ID NO: 10666 - protein, 285 aa, Escherichia coli O157:H7 EDL933
MFILYFQREWSVTLCINKESIKMGKLTGKTALITGALQGIGEGIARTFARHGANLILLDISPEIEKLADELCGRGHRCTAVVADVRDPASVAAAIKRAKEKEGRIDILVNNAGVCRLGSFLDMSDDDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPEDPESVLTEMAKAIPLRRLADPLEVGELAAFLASDESSYLTGTQNVIDGGSTLPETVSVGI

SEQ ID NO: 10667 - protein, 488 aa, Escherichia coli O157:H7 EDL933; identical to SEQ ID NO: 1152

SEQ ID NO: 10668 - protein, 396 aa, Escherichia coli O157:H7 EDL933
MLDAQTIATVKATIPLLVETGPKLTAHFYDRMFTHNPELKEIFNMSNQRNGDQREALFNAIAAYASNIENLPALLPAVEKIAQKHTSFQIKPEQYNIVGEHLLATLDEMFSPGQEVLDAWGKAYGVLANVFINREAEIYNENASKAGGWEGTRDFRIVAKTPRSALITSFELEPVDGGAVAEYRPGQYLGVWLKPEGFPHQEIRQYSLTRKPDGKGYRIAVKREEGGQVSNWLHNHANVGDVVKLVAPAGDFFMAVADDTPVTLISAGVGQTPMLAMLDTLAKAGHTAQVNWFHAAENGDVHAFADEVKELGQSLPRFTAHTWYRQPSEADRAKGQFDSEGLMDLSKLEGAFSDPTMQFYLCGPVGFMQFAAKQLVDLGVKQENIHYECFGPHKVL

SEQ ID NO: 10669 - protein, 112 aa, Escherichia coli O157:H7 EDL933
  unsure (1)..(112): unsure at all Xaa locations
MKKIDAIIKPFKLDDVREALAEVGITGMTVTEVKGFGRQKGHTELXRGAEYMVDFLPKVKIEIVVPDDIVDTCVDTIIRTAQTGKIGDGKIFVFDVARVIRIRTGEEDDAAI

SEQ ID NO: 10670 - protein, 178 aa, Escherichia coli O157:H7 EDL933
MRRAFITGVFFLSEVEFSHEYWMRHAMTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 10671 - protein, 482 aa, Escherichia coli O157:H7 EDL933
MKLNDSNLFRQQALINGEWLDANNGEVIDVTNPANGDKLGSVPKMGADETRAAIDAANRALPVWRALTAKERANILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGIPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDKGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 10672 - protein, 188 aa, Escherichia coli O157:H7 EDL933
MYERYAGLIFDMDGTILDTEPTHRKAWREVLGHYGLQYDVQAMIALNGSPTWRIAQAIIELNQADLDPHALAREKTEAVRSMLLDSVEPLPLVEVVKSWHGRRPMAVGTGSESAIAEALLAHLGLRRYFDAVVAADHVKHHKPAPDTFLLCAQRMGVQPTQCVVFEDADFGIQAARAAGMDAVDVRLL

SEQ ID NO: 10673 - protein, 330 aa, Escherichia coli O157:H7 EDL933
MSQNTLKVHDLNEDAEFDDNRVEVFDEKALVEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 10674 - protein, 432 aa, Escherichia coli O157:H7 EDL933
  unsure (1)..(432): unsure at all Xaa locations
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKXSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 10675 - protein, 918 aa, Escherichia coli O157:H7 EDL933
  unsure (1)..(918): unsure at all Xaa locations
MTNYSLRARMMILILAPTVLIGLLLSIFFVVHRYNDLQRQLEDAGASIIEPLAVSTEYGMSLQNRESIGQLISVLHRRHSDIVRAISVYDENNRLFVTSNFHLDPSSMQLGSNVPFPRQLTVTRDGDIMILRTPIISESYSPDESPSSDAKNSQNMLGYIALELDLKSVRLQQYKEIFISSVMMLFCIGIALIFGWRLMRDVTGPIRNMVNTVDRIRRGQLDSRVEGFMLGELDMLKNGINSMAMSLAAYHEEMQHNIDQATSDLRETLEQMEIQNVELDLAKKRAQEAARIKSEFLANMSHELRTPLNGVIGFTRLTLKTELTPTQRDHLNTIERSANNLLAIINDVLDFSKLEAGKLILESIPFPLRSTLDEVVTLLAHSSHDKGLELTLNIKSDVPDNVIGDPLRLQQIITNLVGNAIKFTENGNIDILVEKRALSNTKVQIEVQIRDTGIGIPERDQSRLFQAFRQADASISRRHGGTGLGLVITQKLVNEMGGDISFHSQPNRGSTFWFHINLDLNPNIIIEGPSTQCLAGKRLAYVEPNSAAAQCTLDILSETPLEVVYSPTFSALPPAHYDMMLLGIAVTFREPLTMQHERLAKAVSMTDFLMLALPCHAQVNAEKLKQDGIGACLLKPLTXTRLLPALTEFCHHKQNTLLPVTDESKLAMTVMAVDDNPANLKLIGALLEDMVQHVELCDSGHQAVERAKQMPFDLILMDIQMPDMDGIRACELIHQLPHQQQTPVIAVTAHAMAGQKEKLLGAGMSDYLAKPIEEERLHNLLLRYKPGSGISSRVVTPEVNEIVVNPNATLDWQLALRQAAGKTDLARDMLQMLLDFLPEVRNKVEEQLVGENPEGLVDLIHKLHGSCGYSGVPRMKNLCQLIEQQLRSGTKEEDLEPELLELLDEMDNVAREASKILG

SEQ ID NO: 10676 - protein, 420 aa, Escherichia coli O157:H7 EDL933
MPHSLFSTDTDLTAENLLRLPAEFGCPVWVYDAQIIRRQIAALKQFDVVRFAQKACSNIHILRLMREQGVKVDSVSLGEIERALAAGYNPQTHPDDIVFTADVIDQATLERVSELQIPVNAGSVDMFDQLGQVSPGHRVWLRVNPGFGHGHSQKTNTGGENSKHGIWYTDLPAALDVIQRHHLQLVGIHMHIGSGVDYAHLEQVCGAMVRQVIEFGQDLQAISAGGGLSIPYQQGEEAVDTEHYYGLWNAAREQIARHLGHPVKLEIEPGRFLVAQSGVLITQVRSVKQMGSRHFVLVDAGFNDLMRPAMYGSYHHISALAADGRSLEHAPTVETVVAGPLCESGDVFTQQEGGNVEPRALPEVKAGDYLVLHDTGAYGASMSSNYNSRPLLPEVLFDNGQARLIRRRQTIEELLALELL

SEQ ID NO: 10677 - protein, 472 aa, Escherichia coli O157:H7 EDL933
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETKNVTLEHIERKLMAGEKLRNIGV

SEQ ID NO: 10678 - protein, 253 aa, Escherichia coli O157:H7 EDL933
MILSAFSLEGKVAVVTGCDTGLGQGMALGLAQAGCDIVGINIVEPTETIKQVTALGRRFLSLTADLRKIDGIPGLLDRAVAEFGHIDILVNNAGLIRREBALEFSEKDWDDVMNLNIKSVFFMSQAAAKHFIAQGNGGKIINIASMLSFQGGIRVPSYTASKSGVMGVTRLMANEWAKHNINVNAIAPGYMATNNTQQLRADEQRSAEILDRIPAGRWGLPSDLMGPVVFLASSASDYVNGYTIAVDGGWLAR

SEQ ID NO: 10679 - protein, 321 aa, Escherichia coli O157:H7 EDL933
MMSLAWPLFRVTEQAALAAWPQTGCGDKNKIDGLAVTAMRQALNDVAFRGRVVIGEGEIDHAPMLWIGEEVGKGDGPEVDIAVDPIEGTRMVAMGQSNALAVMAFAPRDSLLHAPDMYMKKLVVNRLAAGAIDLSLPLADNLRDVARALGKPLDKLRMVTLDKPRLSAAIEEATQLGVKVFALPDGDVAASVLTCWQDNPYDVMYTIGGAPEGVISACAVKALGGNMQAELIDFCQAKGDYTENRQIAEQERKRCKAMGVDVNRVYSLDVLVRGNDILFSATGVTGGELVNGIQQTANGVRTQTLLIGGADQTCNIIDSLY

SEQ ID NO: 10680 - protein, 464 aa, Escherichia coli O157:H7 EDL933
MPDAKKQGQSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAGLNVLFILLTLWLVPETKHVSLEHIERNLMKGRKLREIGAHD

SEQ ID NO: 10681 - protein, 236 aa, Escherichia coli O157:H7 EDL933
MGYRSFDTAAAYKNEEGVGKALKNASVNREELFITTKLWNDDHNRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 10682 - protein, 613 aa, Escherichia coli O157:H7 EDL933
MEQNPQSQLKLLVTRGKEQGYLTYAEVNDHLPEDIVDSDQIEDIIQMINDMGIQVMEEAPDADDLMLAENTADEDAAEAAAQVLSSVESEIGRTTDPVRMYMREMGTVELLTREGEIDIAKRIEDGINQVQCSVAEYPEAITYLLEQYDRVEAEEARLSDLITGFVDPNAEEDLAPTATHVGSELSQEDLDDDEDEDEEDGDDDSADDDNSIDPELAREKFAELRAQYVVTRDTIKAKGRSHAAAQEEILKLSEVFKQFRLVPKQFDYLVNSMRVMMDRVRTQERLIMKLCVEQCKMPKKNFITLFTGNETSDTWFNAAIAMNKPWSEKLHDVSEEVHRALQKLQQIEEETGLTIEQVKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELAERMLMPEDKIRKVLKIAKEPISMETPIGDDEDSHLGDFIEDTTLELPLDSATTESLRAATHDVLAGLTAREAKVLRMRFGIDMNTDHTLEEVGKQFDVTRERIRQIEAKALRKLRHPSRSEVLRSFLDD

SEQ ID NO: 10683 - protein, 778 aa, Escherichia coli O157:H7 EDL933
MKQIRLLAQYYVDLMMKLGLVRFSMLLALALVVLAIVVQMAVTMVLHGQVESIDVIRSIFFGLLITPWAVYFLSVVVEQLEESRQRLSRLVQKLEEMRERDLSLNVQLKDNIAQLNQEIAVREKAEAELQETFGQLKIEIKEREETQIQLEQQSSFLRSFLDASPDLVFYRNEDKEFSGCNRAMELLTGKSEKQLVHLKPADVYSPEAAAKVIETDEKVFRHNVSLTYEQWLDYPDGRKACFEIRKVPYYDRVGKRHGLMGFGRDITERKRYQDALERASRDKTTFISTISHELRTPLNGIVGLSRILLDTELTAEQEKYLKTIHVSAVTLGNIFNDIIDMDKMERRKVQLDNQPVDFTSFLADLENLSALQAQQKGLRFNLEPTLPLPHQVITDGTRLRQILWNLISNAVKFTQQGQVTVRVRYDEGDMLHFEVEDSGIGIPQDELDKIFAMYYQVKDSHGGKPATGTGIGLAVSRRLAKNMGGDITVTSEQGKGSTFTLTIHAPSVAEEVDDAFDEDDMPLPALNVLLVEDIELNVIVARSVLEKLGNSVDVAMTGKAALEMFKPGEYDLVLLDIQLPDMTGLDISRELTKRYPREDLPPLVALTANVLKDKQEYLNAGMDDVLSKPLSVPALTAMIKKFWDTQDDEESTVTTEENSKSEALLDIPMLEQYLELVGPKLITDGLAVFEKMMPGYVNVLESNLTAQDKKGIVEEGHKIKGAAGSVGLRHLQQLGQQIQSPDLPAWEDNVGEWIEEMKEEWRHDVEVLKAWVAKATKK

SEQ ID NO: 10684 - protein, 284 aa, Escherichia coli O157:H7 EDL933
MTDKMQSLALAPVGNLDSYIRAANAWPMLSADEERALAEKLHYHGDLEAAKTLILSHLRFVVHIARNYAGYGLPQADLIQEGNIGLMKAVRRFNPEVGVRLVSFAVHWIKAEIHEYVLRNWRIVKVATTKAQRKLFFNLRKTKQRLGWFNQDEVEMVARELGVTSKDVREMESRMAAQDMTFDLSSDDDSDSQPMAPVLYLQDKSSNFADGIEDDNWEEQAANRLTDAMQGLDERSQDIIRARWLDEDNKSTLQELADRYGVSAERVRQLEKNAMKKLRAAIEA

SEQ ID NO: 10685 - protein, 243 aa, Escherichia coli O157:H7 EDL933
MSRSVLVTGASKGIGRAIACQLAADGFNIGVHYHRDATGAQETLNAIVANGGNGRLLSFDVANREQCREVLEHEIAQHGAWYGVVSNAGIARDAAFPALSDDDWDAVIHTNLDSFYNVIQPCIMPMIGARQGGRIITLSSVSGVMGNRGQVNYSAAKAGIIGATKALAIELAKRKITVNCIAPGLIDTGMIEMEESALKEAMSMIPMKRMGQAEEVAGLASYLMSDIAGYVTRQVISINGGML

SEQ ID NO: 10686 - protein, 466 aa, Escherichia coli O157:H7 EDL933
MDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKEGEDPGYTLYDLSERLRLRGWQVPAFTLGGEATDIVVMRIMCRRGFEMDFAELLLEDYKASLKYLSDHPKLQGIAQQNSFKHT

SEQ ID NO: 10687 - protein, 542 aa, Escherichia coli O157:H7 EDL933
MIAVEKLLPTGEDFASHVYPCYTSHRKETIMTNNPPSAQIKPGEYGFPLKLKNRYDNFIGGEWVAPADGEYYQNLTPVTGQLLCEVASSGKRDIDLALDAAHKVKDKWAHTSVQDRAAILFKIADRMEQNLELLATAEAWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 10688 - protein, 273 aa, Escherichia coli O157:H7 EDL933
MSCEELEIVWNNIKAEARTLADCEPMLASFYHATLLKHENLGSALSYMLANKLSSPIMPAIAIREVVEEAYAADPEMIASAACDIQAVRTRDPAVDKYSTPLLYLKGFHALQAYRIGHWLWNQGRRALAIFLQNQVSVTFQVDIHPAAKIGRGIMLDHATGIVVGETAVIENDVSILQSVTLGGTGKSGGDRHPKIREGVMIGAGAKILGNIEVGRGAKIGAGSVVLQPVPPHTTAAGVPARIVGKPDSDKPSMDMDQHFNGINHTFEYGDGI

SEQ ID NO: 10689 - protein, 380 aa, Escherichia coli O157:H7 EDL933
MVDKIIFTVTPIFSIPPRGAAAVETWMYQVAQRTNFPNRIVCIKNPGYSNYTFVNDNCSIHRVGFSRIYKRLFQKWTRLDPLPYSQRILNIAHDFPITKESVIVVHNSMKLYTQIRKRAPQARVVIHMHNAFEPKLLEQNVKMIVPSLYLKKYYQSYLANADIEIVPNGIDLETYQSNFQPITRSELNISPEEKIIFYAGRIVPDKGILLLMQSFEKLAAAHKNLKLVVIGDYTEMSKSDKGAYQRNVREIAKRLKDRCIMLGSIPPEKMHCYYPLADLVVIPSQFQEPFCMVAIEAMGAGKPVLVSTRGGMTEFVKENTTGFHLKEPMTADSISSDILKTLANPELTAVAKQGQDFVFDHYSWDGVTQRFEEVIHNWFE

SEQ ID NO: 10690 - protein, 430 aa, Escherichia coli O157:H7 EDL933
MKARQQKYCDKIANFWCHPTGKIIMSLAGKKIVLGVSGGIAAYKTPELVRRLRDRGADVRVAMTEAAKAFITPLSLQAVSGYPVSDSLLDPAAEAAMGHIELGKWADLVILAPATADLIARVAAGMANDLVSTICLATPAPVAVLPAMNQQMYRAAATQHNLEVLASRGLLIWGPDSGSQACGDIGPGRMLDPLTIVDMAVAHFSPVNDLKHLNIMITAGPTREPLDPVRYISNHSSGKMGFAIAAAAARRGANVTLVSGPVSLPTPPFVKRVDVMTALEMEAAVNASVQQQNIFIGCAAVADYRAATVAPEKIKKQATQGDELTIKMVKNPDIVAGVAALKDHRPYVVGFAAETNNVEEYARQKRIRKNLDLICANDVSQPTQGFNSDNNALHLFWQDGDKVLPLERKELLGQLLLDEIVTRYDEKNRR

SEQ ID NO: 10691 - protein, 336 aa, Escherichia coli O157:H7 EDL933
MRRELAIEFSRVTESAALAGYKWLGRGDKNTADGAAVNAMRIMLNQVNIDGTIVIGEGEIDEAPMLYIGEKVGTGRGDAVDIAVDPIEGTRMTAMGQANSLAVLAVGDKGCFLNAPDMYMEKLIVGPGAKGTIDLNLPLADNLRNVAAALGKPLSELTVTILAKPRHDAVIAEMQQLGVRVFAIPDGDVAASILTCMPDSEVDVLYGIGGAPEGVVSAAVIRALDGDMNGRLLARHDVKGDNEENRRIGEQELARCKAMGIESGKVLRLGDMARSDNVIFSATGITKGDLLEGISRKGNIATTETLLIRGKSRTIRRIQSIHYLDRKDPEMQVHIL

SEQ ID NO: 10692 - protein, 1227 aa, Escherichia coli O157:H7 EDL933
MSSKVEQLRAQLNERILVLDGGMGTMIQSYRLNEADFRGERFADWPCDLKGNNDLLVLSKPEVIAAIHNAYFEAGADIIETNTFNSTTIAMADYQMESLSAEINFAAAKLARACADEWTARTPEKPRYVAGVLGPTNRTASISPDVNDPAFRNITFDQLVAAYRESTKALVEGGADLILIETVFDTLNAKAAVFAVKTEFEALGVELPIMISGTITDASGRTLSGQTTEAFYNSLRHAEALTFGLNCALGPDELRQYVQELSRIAECYVTAHPNAGLPNAFGEYDLDADTMAKQIREWAQAGFLNIVGGCCGTTPQHIAAMSRAVEGLAPRKLPEIPVACRLSGLEPLNIGDDSLFVNVGERTNVTGSAKFKRLIKEEKYSEALDVARQQVENGAQIIDINMDEGMLDAEAAMVRFLNLIAGEPDIARVPIMIDSSKWEVIEKGLKCIQGKGIVNSISMKEGVDAFIHHAKLLRRYGAAVVVMAFDEQGQADTRARKIEICRRAYKILTEEVGFPPEDIIFDPNIFAVATGIEEHNNYAQDFIGACEDIKRELPHALISGGVSNVSFSFRGNDPVREAIHAVFLYYAIRNGMDMGIVNAGQLAIYDDLPAELRDAVEDVILNRRDDGTERLLELAEKYRGSKTDDTANAQQAEWRSWEVNKRLEYSLVKGITEFIEQDTEEARQQATRPIEVIEGPLMDGMNVVGDLFGEGKMFLPQVVKSARVMKQAVAYLEPFIEASKEQGKTNGKMVIATVKGDVHDIGKNIVGVVLQCNNYEIVDLGVMVPAEKILRTAKEVNADLIGLSGLITPSLDEMVNVAKEMERQGFTIPLLIGGATTSKAHTAVKIEQNYSGPTVYVQNASRTVGVVAALLSDTQRDDFVARTRKEYETVRIQHGRKKPRTPPVTLEAARDNDFAFDWQAYTPPVAHRLGVQEVEASIETLRNYIDWTPFFMTWSLAGKYPRILEDEVVGVEAQRLFKDANDMLDKLSAEKTLNPRGVVGLFPANRVGDDIEIYRDETRTHVINVSHHLRQQTEKTGFANYCLADFVAPKLSGKADYIGAFAVTGGLEEDALADAFEAQHDDYNKIMVKALADRLAEAFAEYLHERVRKVYWGYAPNENLSNEELIRENYQGIRPAPGYPACPEHTEKATIWELLEVEKHTGMKLTESFAMWPGASVSGWYFSHPDSKYYAVAQIQRDQVEDYARRKGMSVSDVERWLAPNLGYDAD

SEQ ID NO: 10693 - protein, 491 aa, Escherichia coli O157:H7 EDL933
MNTQYNSSYIFSITLVATLGGLLFGYDTAVISGTVESLNTVFVAPQNLSESAANSLLGFCVASALIGCIIGGALGGYCSNRFGRRDSLKIAAVLFFISGVGSAWPELGFTSINPDNTVPVYLAGYVPEFVIYRIIGGIGVGLASMLSPMYIAELAPAHIRGKLVSFNQFAIIFGQLLVYCVNYFIARSGDASWLNTDGWRYMFASECIPALLFLMLLYTVPESPRWLMSRGKQEQAEGILRKIMGNTLATQAVQEIKHSLDHGRKTGGRLLMFGVGVIVIGVMLSIFQQFVGINVVLYYAPEVFKTLGASTDIALLQTIIVGVINLTFTVLAIMTVDKFGRKPLQIIGALGMAIGMFSLGTAFYTQAPGIVALLSMLFYVAAFAMSWGPVCWVLLSEIFPNAIRGKALAIAVAAQWLANYFVSWTFPMMDKNSWLVAHFHNGFSYWIYGCMGVLAALFMWKFVPETKGKTLEELEALWEPETKKTQQTATL

SEQ ID NO: 10694 - protein, 549 aa, Escherichia coli O157:H7 EDL933
  unsure (1)..(549): unsure at all Xaa locations
MEIFFTILIMTXVVSLSGVVTRVMPFQIPLPLMQIAIGALLAWPTFGLHVEFDPELFLVLFIPPLLFADGWKTPTREFLEHGREIFGLALALVVVTVVGIGFLIYWVVPGIPLIPAFALAAVLSPTDAVALSGIVGEGRIPKKIMGILQGEALMNDASGLVSLKFAVAVAMGTMIFTVGGATVEFMKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILETSLMAAEIDPNVEIWMLFTDIILIYAALMLVRFGWLWTMKKFSNRFLKKKPMEFGSWTTREILIASFAGVRGAITLAGVLSIPLLLPDGNVFPARYELVFLAAGVILFSLFVGVVMLPILLQHIEVADHSQQLKEERIARAATAEVAIVAIQKMEERLAADTEENIDNQLLTEVSSRVIGNLRRRADGRNDVESSVQEENLERRFRLAALRSERAELYHLRATREISNETLQKLLHDLDLLEALLIEENQ

SEQ ID NO: 10695 - protein, 332 aa, Escherichia coli O157:H7 EDL933
MKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYSTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFICEFPDA

SEQ ID NO: 10696 - protein, 262 aa, Escherichia coli O157:H7 EDL933
  unsure (1)..(262): unsure at all Xaa locations
MMKTLATIGDNCVDIYPQLNKAFSGGNAVNVAVYCTRYGIKPGCITWVGDDDYGTKLKQDLASMGVDISHVHTKHGVTAQTQVELHDNDRVFGDYTEGVMADFALSEEDYAXLAQYDIVHAAIWGHAEDAFPQLHAAGKLTAFDVSDKWDSPLWQTLVPHLDFAFASAPQEDEALRLKMKAIVARGAGVVIVTLGENGSIAWDGVQFWRQAPEQVTVIDTMGAGDSFIAGFLCGWSAGMTLPQAMAQGTACAAQTIQYHGAW

SEQ ID NO: 10697 - protein, 269 aa, Deinococcus radiodurans
MTTDQQRRAANARQFDRIAADYDALGFLTQAALALAAALDVPPTGRVLDVATGTGTVALTLAPKVAEVMGTDIAPAMIEQARQRAAGRSNVQFVLAEATALTFADQSFDVVVCGAGLFFVPDMVAALREWRRVLRPGGEVVFSAFGRGLLGPLPGLWRERLAGEGVKPGAPPLGRIGTVEAAKDLLIQAGFAEVTAELTPLPYTLATPADRWADIRAGLEGLPLAQFTPEVQARLEDEHLAELQPLFAAGPLTVPILLIVARGRKAVSD

SEQ ID NO: 10698 - protein, 344 aa, Deinococcus radiodurans
MTATQEKQAQGKQAGTEQPAVRTLNLIQAITEALADELERDPNVVLFGEDVGARGGVFMATAGLQERFGKKRVFDTPLAEGSIVGAAVGMAVRGMRPIAEIQFADYIGPGFDQILSQAAKIRYRSGGQFSAPLVIRTPSGGGVKGGHHHSQSPEAYYCHMAGIKVVMPSTPYDAKGLLKAAVRSDDPVMFFEPKRLYRAAKGEVPEHDYVVELGKAAIRREGDDLSLIGYGGVMPDLERAADALAAEGISVEVIDLRSLVPWDRPLVLQSVEKTGRAVLVSEAPRMANFMGEVAYTIQNEAFDSLSAPVQQVAGFDTPYPYIQDKIYLPGANRIVAACVKALNY

SEQ ID NO: 10699 - protein, 451 aa, Deinococcus radiodurans
MTTLPAPTISTTAELRALLRLAGPVVVSQFAANALALIATAVIGRLGERELAAAAYANAAYYLVFIMVVGVMLSVAPRVAQAHGAGDARGVARALGGGLRLALLLSAVMLPLMWALSFVLPNFAPAGVSRDLVAAYLRVYSLGMLPNLAFIALRGTLEGTGKPGAVTGVALTGVVWALLVAPALAFGWGPLPRLGLAGAAGASASAAWIMAALLWPLARRRVAYAGPLGPLGDEVRALFRLGWPIGLTLGAEGGMFSVTTLLMARFGPEVLAAHNVTMQTITAFFMVPLGIASATGVRVGTEAGAGRLAQARRAGLVGLGLSSAVMLTFAVIELAAPRTVFSVFVNVNDPANAGLIAAATGFLSIAALFQLMDGLQVTANGALRGLQDTRVPLLVSLVAYWVVGLGLGSVLSSVAGLGARGLWFGLTAGLTLAGLSLVGRFLYRTRAGRAA

SEQ ID NO: 10700 - protein, 325 aa, Deinococcus radiodurans
MSASAPASPLNARSLGLALLITLIWGVNFVVIKWSVAGASPLLVAALRFLLAAFPAVLFVPRPTIAPRLLWGYGLAVGVMQFGLLYLAIQLGMSAGMGSLLMQTQAFFTALLAARFFGEKVMPWQAAGITLAFGGMALIGLTAGHDVPFFPLLLTLTAALGWAISNLVVKASPQANGFGLVVWSALIPPIPLALLAGLTAGWGPVMQTLTHSDWKFWAAVLFMGLGNTVLGFGIWSGLIQRHGASRVAPLSLLVPVFGTLASALAFHEGFPPGKVLGAALIAAGLVLHVFGGRWWRGAASQGLGRAQAEGRETYPPDNADGLEDR

SEQ ID NO: 10701 - protein, 271 aa, Deinococcus radiodurans
MDTLKIHGFSTGQIQVKSKFLRPEPQNLLGSLRSFLDRQYSAPLPVWCWLIEHPSGLIVVDTGLTCTARSNWFSRTQTRLHYTEHDRLSRQMQRAGFDPAQVRVLILTHLHIDHDRGMGDFPEAHLLVSARELRDYRSPLARLMGYSAPTWKSVPHAAPFLPLAHGPFRESADVMGDGRVLLLPTPGHTPGHLSVLVRQPGHDILLAGDLTYSEQDLRTGRLGGIVPSPHIHRKSMRQVRQLAQLRPLIYLPSHDPDSLRRLQRNQPFSLT

SEQ ID NO: 10702 - protein, 301 aa, Deinococcus radiodurans
MLTPMTSAAPVQGRLDPLSLGAIVVTLVFWASAFTGIRIGLEHFSPGHLALYRFLVASVTLLLVMAVTRLPVPAPRDLWQIGVLSVAGISLYHVLLNMGERSVPAGTASLIIAAGPVITALLAARFLGESLNPLGWLGTAVSLGGVALIVLGQGQGLGFSAGALLVLGAAFFTSLYFVFQKGVLARVGSLRFTVWSLILGTVPLLVFLPGFGTELRAAPLPAHLAVLYLGVFPSALAYLTWTFAISRVGAGVTSSFLYVSPVFALLMAWALLGEVPGAVTLLGGVIALAGVLLVNTRGRPQ

SEQ ID NO: 10703 - protein, 446 aa, Deinococcus radiodurans
MAFPTILAALFTLTALLSYLNARFLRLPPTIGVLLGGLFLAAGVAVLGRLGVQGAQDLPRHIAALPFDQVVIAGLLSFLLFASAIQTDVRALLRERGVVLALAVVTTLLTMLLLGAGLYVVMQLFGSPLTWTQALLFGAIVAPTDPVAVTPLLERARVPERLRALIAGESLFNDGVGVAAFTVLSSAALQGSAVRLGELGGLLLREMLGGMALGAALGWLTARLTTSARSQDTAVLLSLALVTGGYALGEALHVSAPVTVAAAGVTLMLLGQLARRRRAASGFPTLSAEARRASLQIRSFWEVTDQVLNAVLFVLLALEVLVLRPRPGLLLAGIVVAMLAIVARGIAVGVPLTLYQWRARRRPELQPFTPYTRRLMTWAGLRGTVALALAFSLPPGELRDTLLFLTYVVVIFSLLVQGLTVPILGRKAAAAAKAAEAQGSVPGASV

SEQ ID NO: 10704 - protein, 137 aa, Deinococcus radiodurans
MRRARQREDRMKLITAVVRPERVQQVKEALFQAGISGLTLSRVSGHGGEQELVEHYRGNRVMIEFRDKVEFRMAVSEPFVQPAIDAICRGARTGEVGDGKIFVQPLERVIRIRTGEEDSLALTPVTETRLAPLGGHS

SEQ ID NO: 10705 - protein, 464 aa, Deinococcus radiodurans
MSAPAAAPAASFQSPGREIAAIAVPVSLEMVIQLVLTFINQVIVGTLGAVAVAAVGLAGSLSFLFFVTLGALGAGTSILIARRFGAGDRAGVNHTLSATLLLGTLLGAALTVPTTLGAPSLLRLAGGAPDVTGAAAPYLQIVMLSLVPGLIGGVLSGALRSLGRARTPLVATLLSVALEALLAAGLVFGQLGLPRLGLVGAAWAVAAANTFKALYLAFQVYGPRQLAAFTLPGRSSWREIVGPLLALSAPLAFTEFVWGLGGFMYNAVFARVGTVALAAAGIVTTLEGIFIVGSFGLMSATTVLLGRSLGAGDGAGAQRWLALISRTGLVTGLAFGLLFALSGLLVPLVFPKVGAEVQHIALLGILINAAAQVIKVRNMILGGGALPSVGDGKGVITGDVVGAFLVGLPLAIGLGLYTPLGVWGVLLARVADELAKVLIFERRRRRIDWARLAEEQRQVGAVTS

SEQ ID NO: 10706 - protein, 523 aa, Deinococcus radiodurans
MIKVQDYRPQPFTDFTKEENVQAYQAALAKVRKELLGKHYPLIIDGQEVDTEGKIQSINPCDTSEVVGTTAKATIGDAENALQGAWKAFESWKKWDMDARARILLKAAAILKRRRLEACALMSIEVGKNYAEADVEVAEAIDFLEYYARSAMKYAGFGSSETTWFEGEENGLMSIPLGVGVSISPWNFPCAIFVGMAAAPIVAGNCVVVKPAEDAGLIAGFMVDILREAGLPAGVLQFLPGVGKEVGEYLTTHAKTRFITFTGSRAVGLHINEVAAKVQPGQKWIKRVIMELGGKDGLIVDETADIENAITAATQGAFGFNGQKCSAMSRLIVVDSVYDEVVNGFVERAKALKMGTGEENANVTAVVNQMSFNKIKGYLELAPSEGKVLLGGEATGEANGKQGYYIQPTIVGDVDRNSRLAQEEIFGPVVAVLRAKDWQDALDIANSTEYGLTGGVCSNSRERLEQARAEFEVGNLYFNRKITGAIVGVQPFGGYNMSGTDSKAGGPDYLSNFMQLKTVTERW

SEQ ID NO: 10707 - protein, 266 aa, Deinococcus radiodurans
MSRRVGGRPRGSTPDRYTCRMTSHSALFRLDGKRALVTGGSKGIGLAAARQLRELGAEVTLAARGEETLRRAAEDIGAAWVVADVSTPEGVKVAADAAGQVDILVSNAGGPPPSLPSEVTEAAWEQGFQTTFLSTARLVDAVLPGMRERRWGRIIAITSLTVGRPSLTLPVSNALRAAVTNHLRTLALEVAADGVTCNTVAPGYTATERLQKLHADPAEADKLRAKIPARRFGEPDEVASAIAFLATNEAAYITGQELLVDGGWSI

SEQ ID NO: 10708 - protein, 298 aa, Deinococcus radiodurans
MFERDEHHFPVKRLLLLGALVGAGAYYLSREQNRKALDAKLAELGLKDAAQDVGSSVTKGWEKTKDAAQNAGSVIADKAQDVAGEVKSAVAGATAEIKDAGKEVADTAKDAGQNVGQNVKREAADLADQAKDKAQDVKADVSKAADQAKDKAQDVAQNVQAGAQQAAANVKDKVQDVKADASKAADQAKDKAQDVAQNVKQGAQQAASDAKDKVQDVKADASRAADQAKDKAQDVAQNVKQSAQDAKTDVDAKAKSWAFDLRTDAEAGKQGGQTGSTTNNAGTAGNTGMTGNTNTRKN

SEQ ID NO: 10709 - protein, 600 aa, Deinococcus radiodurans
MCLTTLWHSVEKMRSLSVSLFHLLRRSVTVAVMSESAPNHTSARRLTQPLEPFVGRQVLVGVSGGADSVGLLRALLAVGALPAVAHLDHALRPESVDDAAWVSDLCARLGVPCEVTRIDVGAVAARRNWNLEBAARRLRYDVLSRAAKHSGAEVILTAHTRRDQAETVLMELLRGEGRIRGIPPQRGRVRRPWLNVGRAEIETYLRGLGQDWREDASNADPRFTRAWLRREVMPVLLTRFPAAETALAQVAELGAEDDAALQALAARLTPHTPLDRQPPAVLRRWLAAELRSGGLDFTAEQLRDLAGALNAGQTRHLTLPTGRDVTVTGGHLYTAPCDWPEPDFPLPPDWTRRTRQAGDRIRLAGGTRKLSDVLTDAHLPRAERDRVPLLTDEHGAVQWVGVQPPLWAVGARESLGLPADPLHAAMGEALALAQQAAERQEVPVGAVVLNADGEIVGRGRNTSREDGDMTCHAELAALREAAAGLGTPYLSDCTLVVTLEPCPMCLGAALEARIGHIVYGAANPKAGALGGVSDLLADHWGWRPTVQGGVRAGEAARLLREVFGEVRRRSADTPQTPNAETPAPRSSRSTSASGKPTMLE

SEQ ID NO: 10710 - protein, 629 aa, Deinococcus radiodurans
MNELPGTSDTPLLDQIHGPKDLKRLSREQLPALTEELRGEIVRVCSRGGLHLASSLGAVDIITALHYVLDSPRDRILFDVGHQAYAHKILTGRRDQMADIKKEGGISGFTKVSESEHDAITVGHASTSLANALGMALARDAQGKDFHVAAVIGDGSLTGGMALAALNTIGDMGRKMLIVLNDNEMSISENVGAMNKFMRGLQVQKWFQEGEGAGKKAVEAVSKPLADFMSRAKNSTRHFFDPASVNPFAAMGVRYVGPVDGHNVQELVWLLERLVDLDGPTILHIVTTKGKGLSYAEADPIYWHGPAKFDPATGEYVPSSAYSWSAAFGEAVTEWAKTDPRTFVVTPAMREGSGLVEFSRVHPHRYLDVGIAEEVAVTTAAGMALQGMRPVVAIYSTFLQRAYDQVLHDVAIEHLNVTFCIDRAGIVGADGATHNGVFDLSFLRSIPGVRIGLPKDAAELRGMLKYAQTHDGPFAIRYPRGNTAQVPAGTWPDLKWGEWERLKGGDDVVILAGGKALDYALKAAEDLPGVGVVNARFVKPLDEEMLREVGGRARALITVEDNTVVGGFGGAVLEALNSMNLHPTVRVLGIPDEFQEHATAESVHARAGIDAPAIRTVLAELGVDVPIEV

SEQ ID NO: 10711 - protein, 396 aa, Deinococcus radiodurans
MSGVRLTVLGSTGSIGTQTLDVARQRGYTVGTLAAGRNLDLLAEQVREFRPALVSVDGSILAEARERLSGVRVIADPSEAAVAQADVVVNAMSGLIGLPPTRAALEAGQAVALATKEAMVTSAHLMWEAAAAGGGRVVPVDSEHTGVYQCLTGEDMGDVAELILTASGGPFRDGPADLSAVTPEQALKHPSWSMGPKVTIDSATLMNKGLEVMECASLYGLPLSQVGVVVHPQSIVHAAVRLRDGSLKAQFGPADMRLPIAYAIDAAPSGMQHPGDVRGARRGEEVGEHLGWPLLGQWEFRAPDLTRFPCLALAYRAGEAGGLLPVALNAADEVAVDAFLHGRIGFLDIPQLIERVLDETPGGALTWDSLTETDAWARARAQELCAYGVGGAGVGA

SEQ ID NO: 10712 - protein, 311 aa, Deinococcus radiodurans
MKFYVIGDVTVDHLYHLDRLPAPGKEVTPKRSTMQPGGSGGTISVTLARLGHTVTLAARVGDDPFAEFALAEIKASGVSLSAIQKDPEHLTSTITVMQTSGGQRAMISDGAANRQLDPAKLKKKDVESADALIISAYSLTEGPQREYAQKAIEIARGAKKPVPVFIDLGTGAVEKVGTGLVAEVRGADYLTLNQHELLALTGTRSLSAGLARLAEAGVERVAVKVGKMGSVVWTPEDTELVDAVLPEGTVVDTTGAGDTFTAAFAHAVLSGLPLTQAARVANAAGALAATAVGAQSKPILVGDLERVAQSK

SEQ ID NO: 10713 - protein, 379 aa, Deinococcus radiodurans
MSLSRHALQDAAQRFGTPLYLYDAEELDAALWRVQRAFGDARIFYAMKANPNLNLLRRYAAAGVGFECVSLGELLRAEAAGAGGERMILNGPAKSDAEYAAAARLGATIVVDREEEVVLLPPGSRVLVRVNPAMTVSTHEHLATGTARSKFGLTPEQVPGTLAELRDAGHEVLGLHMHIGSAIEQAEDFTAAFARVTELRAHIGGLSVLNVGGGWSLNADLEGIAYEAHEAARVFGAELWVEPGRYLVASAGWLLTRVVGTKRTGRNFCLVDAGMTEFLRPMLYGASHPLYPMWDALATEVWDVAGPACESGDLIARGVPLPTPQRGHLLLIGEAGAYGASMSSTYLSRPRPAEVLWTGHDWQLLRRRETPQDIWAAEV

SEQ ID NO: 10714 - protein, 500 aa, Deinococcus radiodurans
MSVPAAPQTPSQSQEDRYRYKFAQEGITFDDVLLQPRHSQVLPHEVDVSAQLTRRVRLNIPFVSAAMDTVTETNMAIAMAREGGIGVVHKNMSIDAQAEMIRKVKRSESGMIVDPITLPPSATVRDADRLMGEYRISGVPVTAPDGKLLGIITNRDMRFIDDLDVPLGDVMTREHLVTVPVGTDLEQARELFKLNRIEKLLVTEGEYLRGLITIKDIEKSVKYPNAAKDDLGRLRVAAAIGVSADLMDRAGALVQAGADVLVLDSAHGHSQGILNALSRVKEQFDVDVIAGNVATRSGARDLILAGADAVKVGIGPGSICTTRVVTGVGVPQVTAIFEASAAAMEAGIPVIADGGIKQTGDVPKAIAAGASVVMMGSMLAGTDEAPGETILRDGRRYKSYRGMGSLGAMDQGSADRYFQGGSRKFVPEGIEGIIAYRGTAGEVIYQFVGGLKSSMGYCGAPDLTTLRDTAQFVRITGASLVESHPHGVTITKEAPNYGGR

SEQ ID NO: 10715 - protein, 254 aa, Deinococcus radiodurans
MTHNEISPAPARVALVTGSSRGLGRAMALRLAQDGFTVAVHYGRGEAEAQQVAADIRAAGGAAQVFGADLSQPANAGTLVEDVIAALGRLDVLVNNAGITRDGLAIRMKDEDWDAVLQTNLSSAFAACRAALKHMMKNRSGRIVNVSSVVALAGNPGQANYVASKAGLIGLTRALAKEYGGRGITVNAIAPGFIESDMTAKLPEDTKKQYQANIPLARFGQPEEVAALVAFLASEGAGYITGQTIGVDGGMNPN

SEQ ID NO: 10716 - protein, 304 aa, Deinococcus radiodurans
MTSHLRGILLLLLVTAIWGSTFAVVKELGALLAPPVLLAWRFSIGALVLLPLAALRRTPAPTVTVTQADGTSLWSDGMVLGLWLIAGYGTQTIALQTTTANRAAFFTALSVVLVPVWLTLVQRRRMPAVLWAALPLAVAGLALLSWEGGAWVSGDAWALACAVTYAGFILALEKLASRHAALPFTLAQVLSVALVAWGWALLSGAPLWPPQAAWAPLFYLGVVATAGTTLLQTLGQRHVSAAEASLIYALEPVSAALFSFALIGERVGARGALGGALVVLATVLSSRAGETEPVARVLDSSQDD

SEQ ID NO: 10717 - protein, 458 aa, Deinococcus radiodurans
MWTWVCFRLEAPRVTDMLTAFALLLSVTAVLAFLNERFFRLPTTVGVTLAGALSSMLLIALDALGLTGPRGWAAGLLETLDFTDFVLNGILSILLFAGALGLDARQLLRQRFSILTLAVFSTLLSTFLIGFAAYGIFGLVGLNVPLLWSLLFGALISPTDPVAVLDLLKRAAVPKRIETLIAGESLFNDGVGVVIFLVIAGMAGIGHSHGTGSVVGALELFGREALGGMAFGALLGAIGFLMLREIEQHAVEVLITLALVVGGYVAASALGVSGPLAMVVAGLVISAGRDVAFGEETREHIESFWETTDQVLNILLFAFIGLDVLLTETTGPQIVAGLLLVVASLLARWISVALPFPLIRRHEDYGPYTVRLLTWGGLRGGIAISLVLGLPQTPYRTHLVTATYIIVLFSIAVQGLTIMPLVHKAVAASPDSAGPDSAGPGGGQEDGENAGRQLSSET

SEQ ID NO: 10718 - protein, 343 aa, Deinococcus radiodurans
MTDASFPALPPPLVSLGDLAWDVLAKPDTLLLPGGDTTGRLELSGGGSAANLAVWAARLGAPTTFVGKIGQDRFGELATAELRAEGVRAEVLASAAHPTGVILALIDRRGQRAMLTGQGADWELLPEELPRDVLSSAGHLHLTAWSLFRDPPRAAALEAARIAKAGGATLSLDPGSFQMIQQLGREAFLNIVDALPFDVMFPNDDEARAMSGERDNEAALTWLRARYPRALIALKMDEDGALIEGPQTARVQVPATRDPLVDATGAGDAFGGAFLSQWLRHHDAERAARVAVQVGGWVVSRFGARPPADPDLTRRLASVGADLLTPDPAAAPDPSQDSPEVNA

SEQ ID NO: 10719 - protein, 422 aa, Deinococcus radiodurans [sequence omitted]

SEQ ID NO: 10720 - protein, 512 aa, Deinococcus radiodurans
MTLPLTSNSSPALPARAATRIALYTEGTYPQAHGGVSVWVDQLVRGLSDHQFAVQAIAGLPFTRMALEVPGNVQVEQVPLWGPPPGGAGGRLWQQAHRRAFAGEVLTAYETLLTGLCRLDVPTFSVALRRLSDLGQRGSLTPALDSARAAQLTLNLWDREAQTLAAQRDRLSPRLPRPTVAEALDVQIWLEHALRPLTAVPPEADVGHAVSNGFAAMLALHGLWQRGTPFVLTEHGIYLRERYIEFRRGRHAPGYKTMLLRFYRLLCSVAYQNAALVLPGSHYNRRWEERLGADPDRIQCVYNGIDPNIFPPAESEPEGPVVSWVGRVDPLKDLETLIRAFDLVRRRRPDARLRLFGGTPVGNEGYEQHCRQVAAGLNLDEHVKFEGRVDDITDAYRAGQVVALTSVSEGFPYTVIEAMAMGRPPVATRVGGVPEAVGDAGLIVRPRDALGVANALTKLLDDPALRQQLGQAARARVMDLFTLDGCLDAYRRAYPVARAARLSPSQGPGELW

SEQ ID NO: 10721 - protein, 360 aa, Deinococcus radiodurans
MQVYLAGQNIEVQDLDEDEDELEGDDADTEDAVPGTAQAQQDDDEEKYFDDMPRAVSNDPVRQYLHEIGRVSLLTLEEEIALARRIEEGEEARKQLEEDESLDDRSRRRLMRQMEDGAAARQGLIEANLRLVVSIAKKYTGRGLGFLDLIQEGNQGLIRAVEKFEYRRRYKFSTYATWWIRQAINRAIADQARTIRIPVHMVETINKLTRTARQLQQELSREATHEEIAEAMGPGWDAAKVEEVQKVSQEPVSLETPIGDEKDSFYGDFIPDENLDSPVDNAAKTLLSEELEKALGKLTEREAMVLKFRKGLVDGREHTLEEVGQRFSVTRERIRQIENKALRKLKYHESRTRKLRDFLD

SEQ ID NO: 10722 - protein, 268 aa, Deinococcus radiodurans
MTKRTPDSADISFEHALVLETARVTEGAALAASRFMGLGDKNAVDGAGTEAMRSLLNSLDIRGTVVIGEGEMDEAPMLYIGEKVGNGQYEVDIAVDPVEGTNVTAKGLPNGLAVIALSERGGLMHAPDCYMEKLIVPPPAAGRVNLDWPVEANLSVIAQSLERDVEDLMITILDRERHADLIQRVRATGARVKLIGDGDVVAGLAVGVRGTGVHALMGSGGAPEGVLSAAACKCLGAEIRGRGHRRGRRHARALRRNGRERTPHLQYR

SEQ ID NO: 10723 - protein, 487 aa, Deinococcus radiodurans
MTTTDLRTTYSSVTRSQAYFDGEWRNAPRNFEVRHPGNGEVIGEVADCTPTDARQAIDAAEVALREWRQVNPYERGKILRRWHDLMFEHKEELAQLMTLEMGKPISETRGEVHYAASFIEWCAEEAGRIAGERINLRFPHKRGLTISEPVGIVYAVTPWNFPAGMITRKAAPALAAGCVMILKPAELSPMTALYLTELWLKAGGPANTFQVLPTNDASALTQPFMNDSRVRKLTFTGSTEVGRLLYQQAAGTIKRVSLELGGHAPFLVFDDADLERAASEVVASKFRNSGQTCVCTNRVYVQRGVAEEFIRLLTEKTAALQLGDPFDEATQVGPVVEQAGLDKVQRQVQDALTKGAQATTGGQVSSGLFFQPTVLVDVAPDSLILREETFGPVAPVTIFDTEEEGLRLANDSEYGLAAYAYTRDLGRAFRIAEGLEYGIVGINDGLPSSAAPHVPFGGMKNSGVGREGGHWGLEEYLETKFVSLGLS

SEQ ID NO: 10724 - protein, 526 aa, Deinococcus radiodurans
MSTLLDGLLPFQHEPYFDFADPAVAEAQTAAYAQARQKYAGQTFPLLVGGQQVKGDGTLTVTNPATGEQLWHFQNATAAQLDEAVRAANEAFQSWRFSDPLQRASIFLRAAQLLRSRRMELNAVMSLENGKNWAEADGEIAECVDHCEVFARETLKWAQGKPVYPMPDEHVTTVYEPLGAVAVISPWNYPSAIPLGMALGALAAGNTVIWKPASETPLSSWLLIRLLFEAGLPRDCVQFLTGSDDVLGDPLVDHKDVRMVAFTGSREIGCRIYERAAKVQPGQKFLKRVIAEMGGKDPTVVCADADLDAAAAGIVASTFGYSGQKCSACSRVIAEASVYDTLLEKVKTLTEALKVGLPEHNAAVGPVIHQGSANRIRQYIENGKGTARLVCGGGEMEVADSGEASANYIQPTIFADVDAKDPLFQEEIFGPVLAFAKADDWRHAIDLANDSDYGLTAAFYSRDPHKLTEARRLMHVGNLYLNRKCTGALSGSHSFGGYGMSGTNAKVGGPDYLFWFLQTKTVAQKY

SEQ ID NO: 10725 - protein, 495 aa, Deinococcus radiodurans
MTAEPQVSPAPTPPPAAPLLVRDRLFIGGEWVTPCGQGTLEVVNSATEEVMGTVPEGTPEDAERAILAARAAFDSWSQTPAEERAALLERISRGLNERQSEIAALVAQEVGMPFVLSNVIQVGLPAVTFMSMAEEIRQLPAEETLASSLLLREPVGVVAAITPWNYPLHQIAAKVAPALAAGCTVVLKPSEVAPLNAFVLAEIIEAAGAPAGVFNLVTGTGPVVGEVLAAHPEVDMVSFTGSTAAGKRVSELAARTVKRVALELGGKSPYLILDDADLSGEALVQAVMNGIQGCYLNSGQTCSALTRMLVPRSRLPEVEAVAQAVVSQVKVGSPFDAATTLGPLVSDVQRERVRGHIRQGVAEGARLIAGGAESPEGLERGYYVQPTIFSDVTPEMTIAREEIFGPVLVIQPYEDEEDAVRIANATHYGLAGGVWSSDRERAVRVARRLRTGQVSINGGAFNPVAPFGGYKQSGNGREFGRLGLEEFMEVKALQF

SEQ ID NO: 10726 - protein, 258 aa, Deinococcus radiodurans
MALKELFDLSGKVALITGGSRGLGLQMAEALGEYGATVVLTARKQNELDEAKAHLEGLGVKAHVYANDLGNFESIDPLIAQIHQEVGPIDILINNAGATWGAPTAEHPFDAWMKVMNVNVNGTFLLTQSVLNRCMLPAGKGRIINVASVAGLKGNSPQMMPTMAYNTSKGAVVNFTRALASELAPKGITVNSICPGYFPTKMTRGTLAAAEQAIMSHTPMGRLGTDQDLKGLAVLLSSDASAYMTGQNIAVDGGITAI

SEQ ID NO: 10727 - protein, 524 aa, Deinococcus radiodurans
MTQPNPTQPSPTQQNHDLARQLRESRLSRGLQHFIGGEWVDAHSGKTFDAHSPVDNDFLVKVAEGDASDIDRAAKAAHDAFQTWREVSGAERRKILHKVADLIEKRAQEIAVLESVDTGQAIRFMKSAAARGAENFRFYADRAPGAQDGQSLPAPGFINYSIRQPIGPVGVITPWNTPFMLSTWKIAPALAAGCTVVHKPAEWSPVSATLLTEIMDEAGLPGGVHNLVHGFGESAGKSLTEHPLVKAVAFVGETTTGSHIMRQGADTLKRVHFELGGKNPVVVFDDADLDKALDAVVFMIYSLNGERCTSSSRVLIQEGIYDEFTRRIAERAANIRVGDPLDPDTEVGPLVHPRHFEKVMSYFECARQEGATIAAGGERVGEAGNFVRPTLFTAARNDMKIAQEEIFGPVLTAIPFKDEADALELANDVNYGLAGYLWTNDLTRAHRFAHGLEAGMIWVNSENVRHLPTPFGGVKNSGIGRDGGDYSFEFYMETKNIAISLGTHKTAKLGVGQAPAVGKKEAGE

SEQ ID NO: 10728 - protein, 403 aa, Deinococcus radiodurans
MLTPEQKAIVKATVPALEAHGETITRTFYASMFAAHPELLNIFNPANQQTGKQARSLAASVLAYAAHIDHPEALGGMVGRIAHKHVSLEVLPEHYPIVGQYLLGAIAGVLGDAAKPEILDAWAAAYGELADLMIGIEKGMYDAGAGQPGGWRDFRPFRVARKVAESRVITSFVLEPVGGGALPAYQPGQYLSLKVKVPGQERWQIRQYSLSDAPSPDHYRISVKREGGGLVSEYLHGAVQEGDELLVHVPAGDFVLQQSERPVVLISAGVGITPMLAMVQTLAQAGSQRPVTFIHAAQNGSVHAFRDDVARLTHEYPHFRKVVFYDEAGPDDQLGTHHDVAGRLSLDAVRGALPAGEAEFYYCGPAGFAGAVEAILDDLQVPAERRFTETFGPSQSFAPVILG

SEQ ID NO: 10729 - protein, 477 aa, Deinococcus radiodurans
MTATPQASARPERPFATVNPYTGETVKTFPFLESAEIPALIERADQAYREWGQRPVTERAAIMRRAAELMLERTDELASLITLEMGKLLREAKGEVALAASILNYYGEQGPSFLEPKTIPVPQGEAAVLHAPLGVLLGIEPWNYPLYQVVRFAAPNLVVGNTVLLKHSELCPQSALALEQLFHDAGVPQGAYTNLFLRIADIEQVIAHPAVQGVSLTGSERAGASVAELAGRHLKKCVLELGGSDPFIVLDAEDLDTTVKAAATGRLSNTGQACIAAKRLMVVDDLYDEFVSRLGQTFSAFVPGDPADPSTRLGPLSSEQAARDLQAQVQDAIDKGATVVAGGQRPEHPGAFVQPTVLTDVTPDMRAYHEELFGPVAVVYRVRDEDEAVALANASTYGLGGAVFSSDLDRAQRVAERLDTGMVWINHPTSSAADLPFGGVKRSGFGRELSSMGMLEFTNQKLVRAFPTKQKPAQVAG

SEQ ID NO: 10730 - protein, 515 aa, Deinococcus radiodurans
MTVAEQQPQHQGYANPGTPGSVVTFKKRYDNFIGGQWVPPVKGQYFDNASPVDGKVFTQAARSTAEDVELALDAAHRAAPAWGRTSVTERSNILLKIADRMEQNLEMLAVAETWDNGKPVRETLAADLPLAIDHFRYFAGCIRAQEGGLSQIDDSTVAYHFHEPLGVVGQIIPWNFPLLMGVWKLAPALAAGNAVVLKPAEQTPASIMVLMELIADLLPEGVVNVVNGFGLEAGKPLASSPRIAKIAFTGETNTGRLIMGYAADNLIPVTLELGGKSPNIFFDDVMMEDDAFLDKAVEGMVMFALNQGEVCTCPSRALIQESIYDRFMERAVQRVEAITMGHPLDPGTMIGAQASTEQLDKILSYLDIGRAEGAEVLTGGERGQREGLEEGFYVKPTIFKGHNKMRIFQEEIFGPVLAAATFKDEAEALELANDTLYGLGAGLWTRDISRAYRMGRGIQAGRVWTNCYHVYPAHAAFGGYKQSGIGRENHRMMLDHYQQTKNLLVSYSPNKMGFF

SEQ ID NO: 10731 - protein, 645 aa, Deinococcus radiodurans
MRSAHSGEQTPVPPMSAAAPVVAPVPAPAPAAATSIRVPAARLEGLMDQLGELVTARARMTQLLSRLDELQGSMTASQERFQRTVRDFEERYLNPDMVREEGAAPTTRMGGLDLSQQFAELEFDTYNDLNILSRSITELSADFAEVRRRLSDTAAELSEENEQLGKLVRRLRLDVNQTSRVAFSQTTARLRRWAREQQADLTLQVEGEDVLIESGILQRISDPLLHLLTNAAYHGLASESAESRRAAGKNPQGTVWIRAAEQGNFLEVTVADDGQGLDYARIRERALERGLRSAQELEQLSSDELGRLILLPGFSTAREVGNVAGRGVGLDVVATAVRQLGGELLISSERGVGTAFTLRVPTTQRIMDVLHLDLGAGHHAALPVGSVRSLRDVPLGDLRRDDGQLWLDFGGQPVPVVDARPIWGHAPQDTDTEAHLAVVSSISGLLALRVHDFGDIEEVAVTAPSGLLAPLDYLAGMAVSGTGQVLAILDPAGVLRLSRRPATWLGQAQRQVQATGNQRLLLVDDSLSVRRLVGRMLERGGYQVVTASDGQEALDLLQQDADFGAVVTDLEMPRVNGYELLSAVRARPATAGLPMLVMTTRAGEKHQRLAFQLGADDYFTKPVNEALLLRRLGTLQQAQQAGVSA

SEQ ID NO: 10732 - protein, 688 aa, Ancylostoma caninum
MSYPALEGLYSIHDELGSGGFGKVKLATHLLTGLKVAIKIIDKKAIGDDLPRVTTELDALRTLSHQNICRLYQFIDTEDKFFIIMEYCSGGEMFDYIVKKERLEESEARHFFRQLVQAMAYVHSMGYAHRDLKPENLLLTEDLHLKVIDFGLCAKPTSLTRPLDTCCGSPAYAAPELIAGKAYLGNEADIWSMGVLLYALLCGSLPFEDESMQLLYRKIARGQYHEPEWLSPSSRSLLRSMLQVNPQYRITVRQLLDHPWINHKYSQKLKWTSIYDRNVVDEEVATELAFHHRKSLAEMTALIKEWKFDYLTATYYLLLQQKGRRRKIALPPPRPKPGETHVTASPTIHASLENNLDLSGLEDSPDIDLSPQSFRSGSSISEQFDAMWRHNDRDRGDTRERDRIPHKGSDKTSYINAIFNSPTVCTGRSPQQRLAYRSPATTNSTPYRPVQKSSARAQGSIGYECGHDKENYRAGAASVRVRGPVKILDDRDRGTRPRSIYTTPQRPALKGLFSPSGARQRARSTERSGAESPAFSGGKTPCDSSRQPRSTAKTPRLKQRVFASLERKADRVINLLTPRKLKNDSPQVLKTVEGKINVSVTNSTDPERIRQELIKVFEQQCIKYEVNGWKISGRQKDKAGHALTVELEVVVVENMGKIGIRRKRLCGDAFLYKKVCEQILRMAGLDAD

SEQ ID NO: 10733 - protein, 183 aa, Citrus unshiu
MRDGSLKGLFCTAPKSIRSVRRNSGSFNVTAFTEEQEALVVKSWNAMKKNSGELALKFFLRIFEIAPSAKKLFTFLKDSDIPVEQNPKLKPHATTVFVMTCESAVQLRKAGKVTVRESNLKDLGATHFKYGVADEHFEVTKYALLEPIKEPVPEMWSPELKNAWAEAYDQLAAAIKIEMKPPS

SEQ ID NO: 10734 - protein, 161 aa, Marchantia polymorpha
DSATHSVTFFAKIFEIAPGAKALFSFLKDSDIPFDKNPKLKAHALTVFRLTGDSACMLGEKGAIDALHPKLKELGKKHVGYGVIAAHFDVVKAALLSTIESLLPEDWPAEKKVATCGAWSQAYDELAGVMINEMQAIRDAEKAPAAEEAPEAPAAESKALP

SEQ ID NO: 10735 - protein, 483 aa, Pseudomonas fluorescens
MKTKLFINNAWIDSSDQQTFEGKDPVNSEVMTERANATVTDAIKAAQVAEEAFKTWKDVGPSECRRLLLKVADVMESKTPKFIEVMAMEVGASALWAGFNVHASANVFREAASLATQIQGETIPTDKAETLSMTLRQPVGPILSIVPWNGTAVLAARAIAYPLVCGNTVVFKGSEFIPATHALITQCVQEAGMPAGVLNYLNSSPDRSPEIADALISAKEIRRINFTGSTRVGSIIAQKAAQHLKRCLLELGGKSPLIVLDDANIDAAVKAAVFGSFLFQGQICMYTERLVVDEKIADEFVSKFVEKTKRLSAGDLCVTGDCIIGPMVSLNSGYRINGLFKDAIDKGSKVVCGGMVQGAVMPSTILDHVKSDMRIYDEETFGPITVVIRCKGEAEAIRIANDSVYGLSSGVFGRDINRALRVGMSIEYGCVHINGSTVQNEVQAPYGGTKNTGYGRFDGRAVVDEFTELKWLTIEPFEQQYPF

SEQ ID NO: 10736 - protein, 159 aa, Arabidopsis thaliana
MGSGKERDTFVYLAKLSEQAERYEEMVESMKSVAKLNVDLTVEERNLLSVGYKNVIGSRRASWRIFSSIEQKEAVKGNDVNVKRIKEYMEKVELELSNICIDIMSVLDEHLIPSASEGESTVFFNKMKGDYYRYLAEFKSGNERKEAADQSLKAYEVFL

SEQ ID NO: 10737 - protein, 444 aa, Arabidopsis thaliana
MATITVVKARQIFDSRGNPTVEVDIHTSNGIKVTAAVPSGASTGIYEALELRDGGSDYLGKGVSKAVGNVNNVIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETKDTFIADLAVGLSTGQIKTGAPCRSERLAKYNQLLRIEEELGSEAIYAGVNFRKPVEPY

SEQ ID NO: 10738 - protein, 442 aa, Arabidopsis thaliana
MLKIKRVPTVVSNYQKDDGAEDPVGCGRNCLGACCLNGARLPLYACKNLVKSGEKLVISHEAIEPPVAFLESLVLGEWEDRFQRGLFRYDVTACETKVIPGKYGFVAQLNEGRHLKKRPTEFRVDKVLQSFDGSKFNFTKVGQEELLFQFEAGEDAQVQFFPCMPIDPENSPSVVAINVSPIEYGHVLLIPRVLDCLPQRIDHKSLLLAVHMAAEAANPYFRLGYNSLGAFATINHLHFQAYYLAMPFPLEKAPTKKITTTVSGVKISELLSYPVRSLLFEGGSSMQELSDTVSDCCVCLQNNNIPFNILISDCGRQIFLMPQCYAEKQALGEVSPEVLETQVNPAVWEISGHMVLKRKEDYEGASEDNAWRLLAEASLSEERFKEVTALAFEAISCSNQEEDLEGTIVHQQNSSGNVNQKSNRTHGGPITNGTAAECLVLQ

SEQ ID NO: 10739 - protein, 568 aa, Arabidopsis thaliana
MEAKIVKVSDSSYKDGLGKKRKHPGNYTPYDSGRSYAKLQWVLSPNSSTQKLEKRRNLDGENKVIVSENHVEKSLVRYFSYYKKTGVPKRVMFHENGEWIDLPDHILCDIRNDLEAKRATIEFNWCGRHFLLDFLHMYRLDLETGVKTQLAWIDIAGKCFFPETFDTLERDGCHHIRGEDPEQHDQREIKLHIEIDVNSGELPRLNLNVVTDESGDNMDDFQAVQRSSNGPNDEASEDSCSRELDDAVEKWDKTETDRFSGVKPAEEELDKDAVKQMFALGAATLGHVESLDVYQFSSEIAKARLSLFQKQADITKKHRGDANIRYAWVPAKKEVLSAVMMHGLGVGGAFIKKSMYGVGVHAANCPYFSARYCDIDDNGVRHMVLCRVIMGNMEPLRGDNTQYFTGGEKYDNGVDDVESPKHYLIWNMNMNTHIYPEFVVSFKLSIPNAEGNILPTTQSRHESSGLTLEGPKGSPSNEPGRVSNGGSGSEKNSSSSRRPRSPIMPFPLLFKAISSKIARKDMDLIIAGYQELREKKVSRKEFYKTLSMIVGDDDLLISTITGLQRSLG

SEQ ID NO: 10740 - protein, 772 aa, Arabidopsis thaliana
MATLKDIGVSAGINILTAFIFFIIFAFLRLQPFNDRVYFSKWYLRGLRSSPASGGGFAGRFVNLELRSYLKFLHWMPEALKMPERELIDHAGLDSVVYLRIYWLGLKIFAPIAMLAWAVLVPVNWTNNELELAKHFKNVTSSDIDKLTISNIPEGSNRFWAHIIMAYAFTIWTCYMLMKEYETVANMRLQFLASEGRRPDQFTVLVRNVPPDPDETVSELVEHFFLVNHPDNYLTHQVVCNANKLADLVSKKTKLQNWLDYYQLKYTRNNSQIRPITKLGCLGLCGQKVDAIEHYIAEVDKTSKEIAEERENVVNDQKSVMPASFVSFKTRWAAAVCAQTTQTRNPTEWLTEWAAEPRDIYWPNLAIPYVSLTVRRLVMNVAFFFLTFFFIIPIAFVQSLATIEGIEKVAPFLKVIIEKDFIKSLIQGLLAGIALKLFLIFLPAILMTMSKFEGFTSVSFLERRSASRYYIFNLVNVFLGSVIAGAAFEQLNSFLNQSPNQIPKTIGMAIPMKATFFITYIMVDGWAGVAGEILMLKPLIIYHLKNAFLVKTEKDREEAMNPGSIGFNTGEPQIQLYFLLGLVYAPVTPMLLPFILVFFALAYVVYRHQIINVYNQEYESAAAFWPDVHGRVITALIISQLLLMGLLGTKHAASAAPFLIALPVITTGFHRFCKGRFEPAFVRYPLQEAMMKDTLERAREPNLNLKGYLQDAYIHPVFKGGDNDDDGDMIGKLENEVIIVPTKRQSRRNTPAPSRISGESSPSLAVINGKEV

SEQ ID NO: 10741 - protein, 542 aa, Citrus x paradisi
MDQAISSVVRKLQMVNTSDHNSVVSINIFVALPCASIVIGHLLEESRWMNESITALLIGVCAGVIILLTTGGKSSHLFVFSEDLFFIYVLPPIIFNAGFQVKKKQFFRNFITIMLFGAIGTLVSCTIISLGVIQFFKKLDIGTLDIGDYLAIGAIFAATDSVCTLQVLNQDDTPLLYSLVFGEGVVNDATSVVLFNAIQSFDLTHINTRSAFQFIGNFLYLFFTSTLLGVIGGLLSAYVIKKLYFGRHSTDREVAIMVLMAYLSYMLAELFYLSGILTVFFCGIVMSHYTWHNVTESSRVTTKHTFATLSFVAEIFTFLYVGMDALDIEKWRFVKGSPGTSVAASAMLMGLIMAGRAAFVFPLSFLTNLAKKSPTEKISIKQQVIIWWAGLMRGAVSMALAYNQFTRSGHTQLRENAIMITSTITVVLFSTVVFGLMTEPLIRLLLPHPKHTTNHILSDPSTPKSLSQPLLEEGQQDSYADLVGPTVPRPGSLRALLTTPTHTVHYYWRKFDDAFMRPVFGGRGFAPFVPGSPTERSVRGGQ

SEQ ID NO: 10742 - protein, 277 aa, Nicotiana tabacum
MAFFNRVGSILKQSVSKHSNLELSASNASLFQAIRSMSSSKLFVGGLSYGTDESSLKEAFSQYGDVIEARVIMDRDTGRSRGFGFISFPSSEEAASALQAMDGQDLHGRRIRVNYATEKRRAGFGGGYGGGGGGFNYGGEGGNSAGAGGYPTNNYGGGFSGGNTSAGGYGSYGGGSNYGNDNSSPAEGGVGYGSANYGNTPNSNYSGPGNSFSGGYDGGNNGNGFGESPGASFNGGQEQVSVDQGTQSINEDIGQETSEGNYRDDDDEPKDFANSRG

SEQ ID NO: 10743 - protein, 339 aa, Solanum tuberosum
MAFLNKIGNILKHGVGKNTNLELSASNGSLFQTIRSMSSSKLFVGGLSYGTDESSLKETFSQYGEVIEARVILDRETGRSRGFGFISFPSSEEATSAMQAMDGQDLHGRRIKVNYATEKRRDGFGGGYGGGNYGGEGGNFAGGGGYAASNYGGGGGGFSGGYNSSGGGGYNSAGGSGYGSSSGYTYGGEGGNVAGSGGYPTNNYGGGGTEFSSGNSSAGGYSSYGGGSSNYGNNSSPVEGGNYGSSTPNINHSGQGSSFSGGYGGGNSGNDFVGAPSNNNSFANTGFGGSSEASYNGSQEQVSADQGTQSINEHLGQETPEGNYRDNDDKPKDYANTRG

SEQ ID NO: 10744 - protein, 469 aa, Oryza sativa (japonica cultivar-group); identical to SEQ ID NO: 3153

SEQ ID NO: 10745 - protein, 431 aa, Petunia x hybrida
MAGLMACRTEFGPSQPFKGAKITGSLHMTIQTAVLIETLTALGAEVRWCSCNIFSTQDHAAAAIARDSRAVFAPKGETLQEYWWCTERALDWGPGGGPDLIVDDGGDAYTFDSSRCKSSRGICSIWARGSLEILISERRQQPFNFRGSVTSHFSRTNISQGTKCKSNYILVRVIKILFYRIVTKSKFDNLYCNQHENFLSFIKQQHSTKVAVVAGYGEFGEGCASALKQAGARVIVTEIDPICALQALMEGLQVLTLQDVVSAAAIFVTTTGTKDIIMVHHIRKIKNNGALCNIGHFHHEIDMLGLQTFPGVKRITIKPQTHRWVFPDTNSGIIVLAEGRLINLGCATGHPRFVMSCSFTHQVIAQSSLWKEKSTGKYQKKVYVLPKHLHEKVAALHLGKLGARLTKLRKDQSDYIRVPVQGPYKPAHYRY

SEQ ID NO: 10746 - protein, 267 aa, Oryza sativa; identical to SEQ ID NO: 3631

SEQ ID NO: 10747 - protein, 446 aa, Oryza sativa (japonica cultivar-group); identical to SEQ ID NO: 3317

SEQ ID NO: 10748 - protein, 272 aa, Hydra vulgaris
MTSTSFSNLSVRLLHADGTNSSLETDLFLEIKGEQQLFVLKLSKIGDSHNVLHQTVLNKSSKGFQFGEKSFVLKLDEQPITLSFESKAEMERFSSVFNQITHGMQNKLSIFDERTEESSAVQYFQFYGYLSQQQNMMQDYIRTSTYQSAILQNANEFKGKVVLDVGAGTGILSYFAAQAGARKVYAVEASNMGQFAKELAKNNNINDIVQVVIGKIEEVVLPENVDIIISEPMGYMLFNERMLETYLHAKKWLKPGGNMYPTKGDLYVAPFT

SEQ ID NO: 10749 - protein, 447 aa, Mycobacterium leprae
MSPPTGRPRLSHDYKENLVPVIEQVGAREILDSRGNPTVEVEVVLIDGTFARAAVPSGASTGEYEAVELRDGDGRYGGKGVKRAVDAVLDEIGPVVIGLNANDQRLIDQELLDLDGTPDKSRLGGNAILGVSLAVAKAAADSAELPLFRYIGGSNAHILPVPMMNILNGGAHADTAVDVQEFMVAPIGAPSFVEALRWGAEVYHALKSVLKKKGLSTGLGDEGGFAPEVAGTTAALDLVTLAIEAAGFKPGADVALALDAAATEFYTDGIGYHFEGMTHTADQMTEFYADLLGSYPLVSIEDPLSEDDWDGWAALTASIGEQVQIVGDDIFATNPERLEEGIGRGVANALLVKVNQIGTLTETLEAVALAHHSGYRTMISHRSGETEDTMIADLVVALGSGQIKTGAPARSERVAKYNQLLRIEEELGDAARYAGDLAFLRYVVETR

SEQ ID NO: 10750 - protein, 529 aa, Mycobacterium leprae
MIRGMSNLKESSDFVASSYVRLGGLMDDPAATGGDNPHKVAMLGLTFDDVLLLPAASDVVPATADISSQLTKKIRLKVPLVSSAMDTVTEARMAIAMARAGGMGVLHRNLPVGEQAGQVETVKRSEAGMVTDPVTCRPDNTLAQVGALCARFRISGLPVVDDSGALAGIITNRDMRFEVDQSKQVAEVMTKTPLITAAEGVSADAALGLLRRNKIEKLPVVDGHGRLTGLITVKDFVKTEQHPLATKDNDGRLLVGAAVGVGGDAWVRAMMLVDAGVDVLIVDTAHAHNRLVLDMVGKLKVEIGDRVQVIGGNVATRSAAAALVEAGADAVKVGVGPGSTCTTRVVAGVGAPQITAILEAVAACGPAGVPVIADGGLQYSGDIAKALAAGASTTMLGSLLAGTAEAPGELIFVNGKQFKSYRGMGSLGAMQGRGGDKSYSKDRYFADDALSEDKLVPEGIEGRVPFRGPLSSVIHQLVGGLRAAMGYTGSPTIEVLQQAQFVRITPAGLKESHPHDVAMTVEAPNYYPR

SEQ ID NO: 10751 - protein, 370 aa, Mycobacterium leprae
MGRVARRTYELREISIVPSRRTRSSKDVSTAWQLDAYRFEIPVVAHPTDALVSPEFAIELGRLGGLGVLNGEGLIGRHADVGAKVAQLIEAAEKEPEPATAVCLLQELHAAPLNPDLLGSAVARIREAGVTTAVRVSPQNAQVLTPVLLAAGIDLLVVQGSIVSAECVASGGEPLNLKTFISELDVPVVAGGVLDHRTALHLMRTGAAGVIVGYGSTRGATTSDEVLGISVPMATAIADAAAARREYLDETGGRYVHVLADGDIYTSGELAKAIACGADAVVLGTPLAQSAEALGGGWFWPAAAAHPSLPRGALLQTAVGERPSLQQVLNGPSDNPFGTLNLVGGLRRSMAKAGYCDLKEFQKVGLIVSI

SEQ ID NO: 10752 - protein, 419 aa, Mycobacterium leprae
MDCKRVVVGVSGGIAAYKACTVVRQLIDAGHEVRVIPTESALRFVGTATFEALSGQPVYTDVFDDIPAVSHVYLGKQADLVVVAPATADLLARAVHGRADDLLTATLLTARCPIMFAPAMHTEMWLHPATVDNVATLRRRGAIVLEPASGRLTGTDSGAGRLPEAEEITTLAQLLLERHDALPYDLTGRKLLVTSGGTRESIDPVRFIGNRSSGKQGYAVARVAVQRGAEVTLIAGHTAGLTNPAGVDVVHVGSAQQLGDAVSKHAPDFDVLVMAAAVADFRPAQVATAKIKKGPDDQDEPLIELVYNEDVLAAAVRARTHGQLPNMRAIVGFAAETGDASGDVLFHARAKLRRKGCDLLVVNAVGDGRAFEVDNNDGWLLASDGTELALQHGSKMLMASRIVDGIVTFLHGLPDLRGG

SEQ ID NO: 10753 - protein, 492 aa, Mycobacterium leprae
MTTTENSLMPDVRNGIDFKVADLSLANFGRKELDLAEYEMPGLMSLRHEYAEVQPLKGARISGSLHMTVQTAVLIETLTALGAEVRWASCNIFSTQDHAAAAVVVGPYGTPEEPKGVPVFAWKGETLEEYWWAAEQMLTWPDPDKPVNMILDDGGDATMLVLRGVQYEKAGVVPPAEVDDSAEWKVFLNLLRKRFETDKGKWTKIAKSVKGVTEETTTGVLRLYQFAAAGDLAFPAINVNDSVTKSKFDNKYGTRHSLIDGINRGTDSLIGGKNVLICGYGDVGKGCAEAAKGQGARVTITEIDPINALQALMEGFDVKRVEDVIADSDIVVTATGNKDIILLEHMKAMKDHAILGNIGHFDNEIDMAALERSGATRLNIKPQVDLWTFGDSGKSIIVLSEGRLLNLGNATGHPSFVMSNSFANQTIAQIELWTKNDDYDNEVYRLPKHLDEKVARVHVEALGGQLTKLTKDQAEYLGVDVDGPFKPDHYRY

SEQ ID NO: 10754 - protein, 227 aa, Mycobacterium leprae
MFAAIRRDIQAARQRDPAQPTVLEVICCYPGVHAVWGHRISHWLWNRRARLAARAFAELTRILTGVDIHPGAVLGAGLFIDHATGVVIGETAEVGDDVTIFHGVTLGGTGRETGKRHPTIGDRVTIGAGAKVLGAIKIGEDSRIGANAVVVKEVPASAVAVGVPGQIISSDSPANGDDSVLPDFVGVSLQSLLTRVAKLEAEDGGSQTYRVIRLPEAGVWHGEDFSI

SEQ ID NO: 10755 - protein, 601 aa, Mycobacterium leprae
MPGQSHKEPHRRATSTPRSLKQATSELRWALSLAAPESPAFMRHLLGNAHDKVDITTSSEHVAAFTEHAIVLLNGNAHQTRELLGGKGYNINAMRRHQLAVPPAFCITTEVGVRYLAAPTPTMEAIWNDVLDQMRWLEAETSRTFGWGPRPLLVSIRSGAVQSMPGMMDTILNLGINDPVEQALAAASPSPIPQTFARDTRLRFIRTYRRIVDPLNPPPANTYDQLRAAIESIFSSWNSPRAVAYRTHYGLDDQSGTAVIVQAMVFGNQGAYSGAGTLFSRNPITRESKLFGEWLPGGQGDDVVSGLVEVQPITSLRDEQPTVYDELVDTAGRLERLGSDVQEIEFTTEDSKLWLLQTRVAERSAQVAVRLALQLWQEGLIDDAEALRRVTPVHVETVLLPVLQPENHLSATLLAKGTPTCPGVISGKAYTEVDEALDAAESAEQVILVRDHTRPDDVLGMLASQGVVTEVGGAASHAAVVSRELSRVAVVGCGQGTAVSLAGKQITVDGDKGEVRQGNLTLSAWSENETPELRELADIARRISPLRVHMTEDHTRLDDSSDTAVRLAINTGHADVVSATPLIVMMTTLRLQDSKDSSAKS

SEQ ID NO: 10756 - protein, 319 aa, Mycobacterium leprae
MAEATTNRVDSDLDAQSPAADLVRVYLNGIGKTALLNAADEVELAKRIEAGLYAEHLLQTRKRFGEGRKRALAAVARDGAAARRHLLEANLRLVVSLAKRYTGRGMPLLDLIQEGNLGLIRAMEKFDYTKGFKFSTYATWWIRQAITRGMADQSRTIRLPVHLVEQVNKLARIKREMHQNLGREATDEELAAESGIPIEKINDLLEHSRDPVSLDMPVGSEEEAPLGDFIEDAEAMSAENAVIAELLHTDIRSVLATLDEREHQVIRLRFGLDDGQPRTLDQIGKLFGLSRERVRQIERDVMCKLRNGERADRLRSYAS

SEQ ID NO: 10757 - protein, 574 aa, Mycobacterium leprae
MEQSRRVPPLQWLSAVARPIARVLTLISTPTFDIADTFGYACPNPPEVSPTEGVYVVATKTSPATGQPVKRTATKTPATPAKRSTTKAANGSAPTKRATSTASRATKSTTPPKASGASDAAKKARTSVKSVDTKAPSAQDHTTKASAAKDTLNDPEATLNTLDSDATADDLDAEPDLDVEPSEDIDIDIEAADLGLDDLEDDDVVTDIEPGETEDGEATAATKTDEASTDDDEEIVEPTEKDKASGDFVWDEDESEALRQARKDAELTASADSVRAYLKQIGKVALLNAEEEVELAKRIEAGLYATQLMTELSERGTKLPTAQRRDMMWICRDGDRAKNHLLEANLRLVVSLAKRYTGRGMAFLDLIQEGNLGLIRAVEKFDYTKGYKFSTYATWWIRQAITRAMADQARTIRIPVHMVEVINKLGRIQRELLQDLGREPTPEELAKEMDITPEKVLEIQQYAREPISLDQTIGDEGDSQLGDFIEDSEAVVAVDAVSFTLLQDQLQSVLETLSEREAGVVRLRFGLTDGQPRTLDEIGQVYGVTRERIRQIESKTMSKLRHPSRSQVLRDYLD

SEQ ID NO: 10758 - protein, 643 aa, Mycobacterium leprae
MLEQIRRPADLQHLSQQQLRDLAAEIRELLVHKVAATGGHLGPNLGVVELTLALHRVFDSPHDPIIFDTGHQAYVHKMLTGRCQDFDSLRKKAGLSGYPSRAESEHDWVESSHASTALSYADGLAKAFELAGNRNRHVVAVVGDGALTGGMCWEALNNIAATPRPVVIVVNDNGRSYAPTIGGVADHLATLRLQPAYERLLEKGRDALHSLPLIGQIAYRFMHSVKAGIKDSLSPQLLFTDLGLKYVGPVDGHDEHAVEVALRKARGFGGPVIVHVVTRKGMGYPPAEADQAEQMHTCGVMDPTTGQPTKIAAPDWTAIFSDALIGYAMKRRDIVAITAAMPGPTGLTAFGQCFPDRLFDVGIAEQHAMTSAAGLAMGRMHPVVAIYSTFLNRAFDQIMMDVALHKLPVTMVIDRAGITGSDGPSHNGMWDLSMLGIVPGMRVAAPRDAIRLREELGEALDVDDGPTAIRFPKGDVCEDIPALKRRSGVDVLAVPATGLAQDVLLVGVGVFASMALAVAKRLHNQGIGVTVIDPRWVLPVCDGVLELAHTHKLIVTLEDNGVNGGVGAAVSTALRQVEIDTPCRDVGLPQEFYDHASRSEVLADLGLTDQDVARRITGWVVAFGHCGSGDDAGQYGPRSSQTM

SEQ ID NO: 10759 - protein, 383 aa, Mycobacterium leprae
MSRTDRNAADLKSAVSTALAKVIDPELQRPITELGMVKNIDIEPGGNVQVGIYLTIASCPKKSEISKRVTKAIADVPGTAAVEVSLDVMSDEQRTKLRKKLRGDAREPMIPFAQPNSLTRVYTVASGKGGVGKSTVTVNLATAIAARGLAVGVLDADIHGHSIPRMMGSNQRPIQLESMILPPIVHEVKVISIGQFTEGNTPVIWRGPMLHRALQQFLSDVYWGDLDVLMLDLPPGTGDIAISVAQLIPNAEILVVTTPQLAAAEVAERAGSIALQTRQRIVGVVENMSGLMMPDGSRLQVFGEGGGQQVAERLSRAVGTDVPLLGQIPLDPALVAAGDSGIPIVLNASDSPVGKELLRIADGLSSRQRRLAGVSLGLDPSRR

SEQ ID NO: 10760 - protein, 472 aa, Mycobacterium leprae
MNVHTAGPRHAEKTRHTATPQRVQPSDDLLRLASNVWPRNITRDETGVACIAGNKLTDLAGEYGTPLFVIDEDDFRFRCREIAAAFGGGENVHYAAKAFLCTEIARWIDEEGLSLDVCSGGELAVALHASFPPERISLHGNNKSVAELKDAVKAGVGYIVLDSTTEIERLDAIAGEAGIVQDVLVRLTVGVEAHTHEFIATAHEDQKFGLSVASGAAMAAVRRVFATDNLRLVGLHSHIGSQIFDVAGFELAAHRVIGLLCDIVGEFDPEKTAQLSIVDLGGGLGISYLPDDDPPPIFELAAKLGAIVSNESAAVGLPVPKLMVEPGRAIAGPGTITLYEVGTIKDVDVSATAHRRYVSIDGGMSDNIRTALYDAQYDVRLVSRTSDAPAAPASIVGKHCESGDIVVRDTWVPDDLKPGDLVGVAATGAYCYSLSSRYNMLGRPAVVAVCAGQARLILRRETVDDLLSLEVR

SEQ ID NO: 10761 - protein, 293 aa, Mycobacterium leprae
MGLAVHSESVLINDGGLATELEARGNDLSDPLWSARLLTDAPQEIVAVHVAYFRAGATIATTVSYQASFEGFAARGIGRDQAIRLMRRSVALASAARDEISAGGLCVAASVGPYGAALADGSEYRGRYGLSVAALARWHRPRLEVLADAGADVLALETIPDIDEAEALVDLVRSVGVPAWLSYTINGTRTRAGQPLAEAFAVAAGVPKIVAVGVNCCAPDDVLAAIQIANIGKPIIVYPNSGERWDYRTWTGPRRFSAQLALQWTAAGARIVGGCCRVRPADIAELTKALASR

SEQ ID NO: 10762 - protein, 406 aa, Mycobacterium leprae
MNNPIEGHAGGRLRVLVLGSTGSIGTQALEVIAANPDRFEVVGLAAGGAQLDTLLRQRAATGVTNIAIADDRAAQLAGDIPYHGTDAVTRLVEETEADVVLNALVGALGLRPTLAALHTGARLALANKESLVAGGSLVLAAAQPGQIVPVDSEHSALAQCLRGGTPDEVAKLVLTASGGPFRGWNAGDLERVTPEQAGVHPTWSMGTMNTLNSASLVNKGLELIEANLLFGIPYDRIEVVVHPQSIVHSMVTFIDGSTIAQASPPDMKLPISLALGWPQRVGGAARACAFTTASTWEFEPLDIDVFPAVELARHAGQIGGCMTAIYDAANEEAAEAFLQGRIGFPAIVATIADVLQRADQWAPQWGEGPATVDDVLDAQRWARERALCAVATASSGKVSDMVLERS

SEQ ID NO: 10763 - protein, 282 aa, Mycobacterium leprae
MMPSTPRTSIPSITLNDENTMPLLGLGVAELSEDETERAVLAALEIGCRLIDTAAAYGNEAAVSRAIAASGIPRAQLFVTTKLATPDQGFTKSQDACNASLDRLGMDYVDLYLIHWPAPPVGQYVDAWGGMIQSRGEGHARSIGVCNFTEEHLSAIIDLTFVTPAVNQIELHPLLNQDEMRKSNAQHNVITQSYTPLVLGRLMDNSTLTAIAAEYGKTPAQVLLRWNLQLGNAVVFRSAKAEHIASNFDVFDFELAVNHMDAMNELHDGTRLRPDPETYAGS

SEQ ID NO: 10764 - protein, 445 aa, Streptomyces griseus
MVSAAESPKRARKSVAAKSPVKRTATKTVAAKTTVTRTVAATAAPAVESADAADDAVAAAPAKKTAAKKATAKKAAAKKTTAKKTAAKKSGKQDDEILDGDEAAEEVKAGKGEEEEGEGENKGFVLSDDDEDDAPAQQVAVAGATADPVKDYLKQIGKVPLLNAEQEVELAKRIEAGLFAEDKLANADKLAPKLKRELEIIAEDGRRAKNHLLEANLRLVVSLAKRYTGRGMLFLDLIQEGNLGLIRAVEKFDYTKGYKFSTYATWWIRQAITRAMADQARTIRIPVHMVEVINKLARVQRQMLQDLGREPTPEELAKELDMTPEKVIEVQKYGREPISLHTPLGEDGDSEFGDLIEDSEAVVPADAVSFTLLQEQLHSVLDTLSEREAGVVSMRFGLTDGQPKTLDEIGKVYGVTRERIRQIESKTMSKLRHPSRSQVLRDYLD

SEQ ID NO: 10765 - protein, 361 aa, Mycobacterium leprae
MSQTVRGVISRKKDEPVELVDIVIPDPGPGEAVVDVTACGVCHTDLTYREGGINDRYPFLLGHEAAGTVEVVGPGVTAVEPGDFVILNWRAVCGQCRACKRGRPSYCFDTFNAQQKMTLIDGTELTPALGIGAFADKTLVHSGQCTKVDPAADPAVAGLLGCGVMAGLGAAINTAAVSRDDTVAVIGCGGVGDAAISGAALVGANRIIAVDIDDTKLEWARTFGATHTVNALELEVVKTIQDLTSGFGVDVVIDTVGRPETWKQAFYARDLAGTVVLVGVPTPDMRLDMPLLDFFSHGGSLKSSWYGDCLPERDFPTLVDLYLQGRLPLGKFVSERIGLGDVEEAFHKIHGGKVLRSVVML

SEQ ID NO: 10766 - protein, 253 aa, Mycobacterium leprae
MTDAAAKVSAAPGRGKPAFVSRSILVTGGNRGIGLAVARRLVADGHRVAVTHRASVVPDWFFGVECDVTDNDAIGAAFKAVEEHQGPVEVLVANAGITSDMLIMRMSEEQFQKVIDVNLTGVFRVAKLASRNMIKQRFGRYIFMGSVVGLSGVPGQANYAASKSGLIGMARSLARELGSRSITANVVAPGFIDTEMTRAMDSKYQEAALQAIPLGRIGAVEEIAGAVSFLASEDAGYISGAVIPVDGGLGMGH

SEQ ID NO: 10767 - protein, 328 aa, Mycobacterium leprae
MELVRVTEAGAMAAGRWVGRGNKEGGDGAAVDTIRELVNTVSMRGVVVIGEGEKDHAPMLYNGEEVGNGDGPDCDFAVDPIDGTTLMSKGMPNAISVLAVADRGAMFDPSAVFYMNKITVGPDAAHVLDITAPIGENIRAVAKVKDLSVRDMTVCILDRPRHAQLIDDVRATGARIRLITDGDVAGAISACRPQSGTDMLAGIGGTPEGIIAAAAIRCMGGAIQAQLAPRDDVERRKALDAGYNLDRILTTEDLVSGENVFFCATGVTDGDLLKGVRYYAGGCTTQSIVMRSKSGTVRMIEAYHRLSKLNEYSAIDFTGDNNAAYPLP

SEQ ID NO: 10768 - protein, 478 aa, Mycobacterium leprae
MRFLDGHQPRFDLTYKDVFIVPHRSDVASRFDVDLSTYDGSGTTIPVVVANMTTVAGQRMAETVARRGGLVILPQDLPIATVQQAVEFVKSRDLVIDTPVLLTPNDSVSDATTLIHKRAHGVAVVAFEGRPIGLVRESSCLGVDRFTRVRDVATTDFVTAPVGTDPRKIFDLLEHAPIDVAVLTNADGTLAGVLTRTGAIRAGIYTPATDARGRLRIGAAVGINGDVAGKAQSLAEAGVDVLVVDTAHGYQVKTLEAIKCVASLNLGVPLVAGNVVSAEGTRELLNAGATIVKVGVGPGAMCTTRMMTGVGRPQFSAVLECASAARKLNRHVWADGGVRHPRDVALALAAGASNVMIGSWFAGTYESPGDLMRDRHDQPYKESYGMASKRAVVARTVADSSFDRARKALFDEGISTSRMGLDPDHGGVEDLIDHITSGVRSTCTYVGASTLAELHEKAVVGVQSAAGFAEGHPLPSGW

SEQ ID NO: 10769 - protein, 459 aa, Mycobacterium leprae
MVSVQESALVVYTSGVKRLVASYRSIPATSPVRLAKPTSNLFRTRAKRDAPGLDASGLTGVIGIDTEARTADVAGMCTYEDLVAATLPYGLLPLVVPQLKTITLGGAVTGLGIESASFRNGLPHESVLEMDILTGAGELLTVSANQHGDLYRAFPNSYGTLGYSTRFRISLEPVTPFVALRHIRFHLLTEMVTAMENIIDTGGHDGVPVDYLDGVVFSANESYLCIGKRTTTPGPVSDYTGQHIYYRSIQHDNEVKEDRLTIHDYVWRWDTDWFWCSRAFGAQNQQLRRWWPRRYRRSSVYWKLMAADRRFGIVDRIEARNGRPLRERVVQDVELPIERTCEFLEWFLGSVPIAPIWLCPLRLRDHNSWPLYPIQPDHSYVNVGFWSSVPAGATEGETNRTIEAKVSALDGHKSLYSDSFYTREEFNELYGGESYNAVKKIYDPDSRLLDLYAKVVQRR

SEQ ID NO: 10770 - protein, 441 aa, Mycobacterium leprae
MFSALLLAGVLSGLAFVVGIVAGIRLSPRLIERRQRLANEWAGITVLQMLQRIIALMPLGAAVVDTYRDVVYLNEQAKELGLVRDRQLDDQAWRAAQQALGGDDVEFDLLPGKRPAAGRSGLSVHGHARLLSEKDRRFAVVFVHDQSDYVRMEAARRDFVANVSHELKTPVGAMALLAEALLASADDAETVSRFAEKVLIEANRLGYMVAELIELSRLQGAERLPNVTDIDVDIIVSEAIARHKVAADTAAIEVRTDPPSGLRVLGDQTLLVTALANLVSNAIAYSPGGSLVSISRRRRGDNIEIAVTDRGIGIALEDQERVFERFFRGDKARSRATGGSGLGLAIVKHVAANHNGSIGVWSKPGTGSTFTLSIPAAMPLYQDNDEQSGQPRGCDMWLNRPQREEEEFKSMTPAQAMMQSEVTRGNVNDKCPDCGGRGIAG

SEQ ID NO: 10771 - protein, 428 aa, Mycobacterium leprae
MLAVHTSPLAQPGIGDAGGMNVYVLQSALHLARRGIEVEIFTRATASADPPIVWVAPGVLVRNVVAGPFEGLDKYDLPTQLCAFAAGVLRAEAAHEPGYYDIVHSHYWLSGQVGWLARDRWAVPLVHTAHTLAAVKNAALADGDAAEPPLRSVGEQQVVDEADRMIVNTDDEARQLISIHRADPAKIDVAHPGVDLDMFRPGDRRAARAALGLPLDGNVVAFVGRIQPLKAPDIVLRAAAKLPQVRIVVAGGPSGSGLASPDGLVRLADELGITARVTFLPPQSRTNLATVFQAADLVAVPSYSESFGLVAVEAQACGTPVVAAAVGGLPVAVRDGVTGTLVFGHNVGHWADAVDQLLRLSAGPQARAISRAAVVHAAQFSWDNTTDALLASYRRAIGDFTATRQHRVRDLVATRKPRRWISRRGMGA

SEQ ID NO: 10772 - protein, 171 aa, Mycobacterium leprae
MPSAAGRRHQTRSVTTDEDLIRAALTVATTAGSRDVPIGAVVLGADGNELARAVNAREAIGDPTAHAEILAMRAAAGTLGNGWRLEGTTLAVTVEPCTMCAGALVLARIERLVFGAWQPKTGAVGSLWDVVRDHRLNHRPAVRGGVLAQECTAPLEAFFAHQRLSKGPPVR

SEQ ID NO: 10773 - protein, 457 aa, Mycobacterium leprae
MSIATINPATGETVKTFTPTTQDEVEDAIARAYARFDNYRHTTFTQRAKWANATADLLEAEANQSAALMTLEMGKTLQSAKDEAMKCAKGFRYYAEKAETLLADEPAEAAAVGASKALARYQPLGVVLAVMPWNFPLWQTVRFAAPALMAGNVGLLKHASNVPQCALYLADVIARGGFPEDCFQTLLISANGVEAILRDPRVAAATLTGSEPAGQAVGAIAGNEIKPTVLELGGSDPFIVMPSADLDAAVATAVTGRVQNNGQSCIAAKRFIAHADIYDEFVEKFVARMETLRVGDPTDPDTDVGPLATESGRAQVEQQVDAAAAAGAVIRCGGKRPDRPGWFYPPTVITDITKDMALYTDEVFGPVASVYCATNIDDAIEIANATPFGLGSNAWTQNESEQRHFIDNIVAGQVFINGMTVSYPELPFGGIKRSGYGRELSTHGIREFCNIKTVWIA

SEQ ID NO: 10774 - protein, 461 aa, Mycoplasma pulmonis
MKKNKKSWKEWFCKEGVKMTKNSSSSYNQIINDISKIMKKRKVKTLSQSEIFELLDSEGLFIDEDSSDEFLDVLKEKKILLDEVDPDDLVEVSGDTIENELDDEVDIKKLKSIKKEMLNDDLFNDDDLNDDGDEDFESNIFDDDEIKEYSSKSLQDKNISKLSGEKLKSKLIETNDIVKWYMRWIGKYGTLLTAAEEKQLAIDMKKGGLKGKIAKDKLINRNLRLVINNAKKYKNRGLSFIDLISEGNAGIIKAVQKFDESKGFKFSTYATWWIRQSITRAVADQARTIRIPVHMVETINKIIKIERELQQELGVNPTDEQIAERYGNDYDAKKVRYIRKMNIDPISLDKTVGKENDSFFSDFVKDESVISPIDHAAKEDLNEHLLELLNEQLTEEERVLIMKRYGIGEDENGVPYQVHTFDQLATEKNTSKEKIRQWENKILRRLKATKKRKILKEYLVK

SEQ ID NO: 10775 - protein, 456 aa, Mycoplasma pulmonis [sequence omitted]

SEQ ID NO: 10776 - protein, 569 aa, Mycoplasma pulmonis
MELKGIGASRGIAIAKVFRILEDEIEIPKNSLGVEKETENFKKTCEKILNELKEIEKKLLISKPEEAAIFQAHQDIASDPVMQEEIIDLIKNNKSAMQAVDEVYQRYSELFESMDDEYMRERASDIKDIKKKMLYSLAGKEILDLSKINQEVIIVAHDLTPSQTVQLNKKYVKGFATNIGGATSHSAIMARSLNIPSVVGLKNILEMTKDGDILAIDGMGESVVINPDQKTLKIYEEKLLKHQEFLKILQNFKNKPSLTKDGHKVEIAANIGSPKDMEDVIENDAEAVGLFRSEFLYMDNSNWPSEEEQFQEYAKTIKAFKDKNKKTIIRTLDIGGDKTLNYFAFPKELNPFLGYRAIRFTLEHEQIFKDQIRAIIRASFFGKVGVMFPMITNVDEFLKAKEMFEKEYQLLKDEKQEIGKREDIELGLMIETPAAAVLSDKFSKYADFLSIGTNDLIQYSMAADRMNEKISYLYQPLNPSILKLIKLTIDGGHKHGKWVGMCGEMAGNPEAIPVLLGLGLDEFSMSASNVLQSRELISRLSYQQMKELAQKALECEREQEVKELYKNIK

SEQ ID NO: 10777 - protein, 504 aa, Escherichia coli O157:H7
MKNEKRKTGIEPKVFFPPLIIVGILCWLTVRDLDAANVVINAVFSYVTNVWGWAFEWYMVVMLFGWFWLVFGPYAKKRLGNEPPEFSTASWIFMMFASCTSAAVLFWGSIEIYYYISTPPFGLEPNSTGAKELGLAYSLFLWGPLPWATYSFLSVAFAYFFFVRKMEVIRPSSTLVPLVGEKHAKGLFGTIVDNFYLVALIFAMGTSLGLATPLVTECMQWLFGIPHTLQLDAIIITCWIILNAICVACGLQKGVRIASDVRSYLSFLMLGWVFIVSGASFIMNYFTDSVGMLLMYLPRMLFYTDPIAKGGFPQGWTVFYWAWWVIYAIQMSIFLARISRGRTVRELCFGMVMGLTASTWILWTVLGSNTLLLIDKNIINIPNLIEQYGVARAIIETWAALPLSTATMWGFFILCFIATVTLVNACSYTLAMSTCREVRDGEEPPLLVRIGWSILVGIIGIVLLALGGLKPIQTAIIAGGCPLFFVNIMVTLSFIKDAKQNWKD

SEQ ID NO: 10778 - protein, 289 aa, Escherichia coli O157:H7
MEFSVLSNNLKMPMMGFGVFQVTDKNVCKQSVLNAIRTGYRLIDTAAVYGNEDAVGEAVREAISEGLCTREELFITSKLWVQDMLNQDTAAAGIEASLKKSGLEYFDLYLLHQAMRDYFSAWRALEDAYEEGKLKAIGVSNFYPHVLANFCETVRVKPMVNQVELHPYFAQPEALATMKYYNVQPEAWAPLGGGRHKPFENNLLQSIADAHQKSISQVILRWNIQRGVVVIPKSTHQQRIEENFAIWDFSLTEKEMAQISSLDLGYVGESVKHFNPEFVRGCLAVKIHD

SEQ ID NO: 10779 - protein, 490 aa, Escherichia coli O157:H7
MSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPSLEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCNAAFEQKILARVERIRAGDVFDPQTNFGPLVSFPHRDNVLRYIAKGKEEGARVLCGGDVLKGYGLDNGAWVAPTVFTDCSDEMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 10780 - protein, 493 aa, Escherichia coli O157:H7
MNKHASQPRAIYYVVALQIWEYFSFYGMRALLILYLTNQLKYNDTHAYELFSAYCSLVYVTPILGGFLADKVLGNRMAVMLGALLMAIGHVVLGASEIHPSFLYLSLAIIVCGYGLFKSNVSCLLGELYEPTDPRRDGGFSLMYAAGNVGSIIAPIACGYAQEEYSWAMGFGLAAVGMIAGLVIFLCGNRHFTHTRGVNKKVLRATNFLLPNWGWLLVLLVATPALITVLFWKEWSVYALIVATIIGLGVLAKIYRKAENQKQRKELRLIVTLTFFSMLFWAFAQQGGSSISLYIDRFVNRDMFGYTVPTAMFQSINAFAVMLCGVFLAWVVKESVAGNRTVRIWGKFALGLGLMSAGFCILTLSARWSAMYGHSSLPLMVLGLAVMGFAELFIDPVAMSQITRIEIPGVTGVLTGIYMLLSGAIANYLAGVIADQTSQASFDASGAINYSINAYIEVFDQITWGALACVGVVLMIWLYQALKFRNRALALES

SEQ ID NO: 10781 - protein, 189 aa, Escherichia coli O157:H7
MQCDLACPQSVSALCEQIERQAGKIDVLVNNAGIVKDSLFASMSYEDFTQVIETNMFSIFRLTKDALMLLRAAENPAIINVASIAALIPSVGQANYSASKGAILGFTRTLAAEMAPWGVRVNAVAPGMIESKMVKKVSRAVVRAVTSTIPLRRLGKCEEVANTIVFLSSSASSYIVGQTIVIDGGLVMR

SEQ ID NO: 10782 - protein, 299 aa, Escherichia coli O157:H7
MSRKDGVLALLVVVVWGLNFVVIKVGLHNMPPLMLAGLRFMLVAFPAIFFVARPKVPLNLLLGYGLTISFAQFAFLFCAINFGMPAGLASLVLQAQAFFTIVLGAFTFGERLHGKQLAGIALAISGVLVLIEDSFNGQHVAMLGFMLTLAAAFSWASGNIFNKKIMSHSSRPAVMSLVVWSALIPIIPFFVASLILDGSGKMIHSLVTIDMTTILALMYLAFVATIVGYGIWGTLLGRYETWRVAPLSLLVPVVGLASAALLLDERLTGLQFLGAVLIMAGLYINVFGLQWRKAVKVRG

SEQ ID NO: 10783 - protein, 792 aa, Escherichia coli O157:H7
MSNNGSSPLVLWYNQLGMKDVDRVGGKNASLGEMITNLSGMGVSVPNGFATTADAFNQFLDQSGVNQRIYELLDKTDIDDVTQLAKAGAQIRQWIIDTPFQPELENAIREAYAQLSADDENASFAVRSSATAEDMPDASFAGQQETFLNVQGFDAVLVAVKHVFASLFNDRAISYRVHQGYDHRGVALSAGVQRMVRSDLASSGVMFSIDTESGFDQVVFITSAWGLGEMVVQGAVNPDEFYVHKPTLAANRPAIVRRTMGSKKIRMVYAPTQEHGKQVKIEDVPQEQRDIFSLTNEEVQELAKQAVQIEKHYGRPMDIEWAKDGHTGKLFIVQARPETVRSRGQVMERYTLHSQGKIIAEGRAIGHRIGAGPVKVIHDISEMNRIEPGDVLVTDMTDPDWEPIMKKASAIVTNRGGRTCHAAIIARELGIPAVVGCGDATERMKDGENVTVSCAEGDTGYVYAELLEFSVKSSSVETMPDLPLKVMMNVGNPDRAFDFACLPNEGVGLARLEFIINRMIGVHPRALLEFDDQEPQLQNEIREMMKGFDSPREFYVGRLTEGIATLGAAFYPKRVIVRLSDFKSNEYANLVGGERYEPDEENPMLGFRGAGRYVSDSFRDCFALECEAVKRVRNDMGLTNVEIMIPFVRTVDQAKAVVEELARQGLKRGENGLKIIMMCEIPSNALLAEQFLEYFDGFSIGSNDMTQLALGLDRDSGVVSELFDERNDAVKALLSMAIRAAKKQGKYVGICGQGPSDHEDFAAWLMEEGIDSLSLNPDTVVQTWLSLAELKK

SEQ ID NO: 10784 - protein, 306 aa, Escherichia coli O157:H7
MRFRQLLPLFGALFALYIIWGSTYFVIRIGVESWPPLMMAGVRFLAAGILLLAFLLLRGHKLPPLRPLLNAALIGLLLLAVGNGMVTVAEHQNVPSGIAAVVVATVPLFTLCFSRLFGIKTRKLEWVGIAIGLAGIIMLNSGGNLSGNPWGAILILIGSISWAFGSVYGSRITLPVGMMAGAIEMLAAGVVLMIASMIAGEKLTALPSLSGFLAVGYLALFGSIIAINAYMYLIRNVSPALATSYAYVNPVVAVLLGTGLGGETLSKIEWLALGVIVFAVVLVTLGKYLFPAKPVVAPVIQDASSE

SEQ ID NO: 10785 - protein, 379 aa, Escherichia coli O157:H7
MVYLYKKGVGMNEQSQAKSPEALRAMVAGTLANFQHPTLKHNLTTLKALHHVAWMDDTLHVELVMPFVWHSAFEELKEQCSAELLRITGAKAIDWKLSHNIATLKRVKNQPGINGVKNIIAVSSGKGGVGKSSTAVNLALALAAEGAKVGILDADIYGPSIPTMLGAENQRPTSPDGTHMAPIMSHGLATNSIGYLVTDDNAMVWRGPMASKALMQMLQETLWPDLDYLVLDMPPGTGDIQLTLAQNIPVTGAVVVTTPQDIALIDAKKGIVMFEKVEVPVLGIVENMSVHICSNCGHHEPIFGTGGAEKLAEKYHTQLLGQMPLHISLREDLDKGTPTVISRPESEFTAIYRQLADRVAAQLYWQGEVIPGEISFRAV

SEQ ID NO: 10786 - protein, 163 aa, Mus musculus
MPTIKLQSSDGEIFEVDVEIAKQSVTIKTMLEDLGMDDDGDDDPVPLPNVNAAVLKKVIQWCTHHKDDPPPPEDDENKEKRTDDIPVWDQEFLKVDQGTLFELILAANYLDIKGLLDVTCKTVANMIKGKTPEEIRKTFNIKNDFTEEEEAQVRKENQWCEEK

SEQ ID NO: 10787 - protein, 253 aa, Escherichia coli O157:H7
MAQVAIITASDSGIGKECALLLAQQGFDIGITWHSDEEGAKDTAREVVSHGVRAEIVQLDLGNLPEGAQALEKLIQRLGRIDVLVNNAGAMTKVPFLDMAFDEWRKIFTVDVDGAFLCSQIAARQMVKQGQGGRIINITSVHEHTPLPDASAYTAAKHALGGLTKAMALELVRHKILVNAVAPGAIATPMNGMDDSDVKPDAEPSIPLRRFGATHEIASLVAWLCSEGANYTTGQSLIVDGGFMLANPQFNPE

SEQ ID NO: 10788 - protein, 112 aa, Escherichia coli O157:H7; identical to SEQ ID NO: 622

SEQ ID NO: 10789 - protein, 330 aa, Escherichia coli O157:H7
MSQNTLKVHDLNEDAEFDENGVEVFDEKALVEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 10790 - protein, 432 aa, Escherichia coli O157:H7
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 10791 - protein, 918 aa, Escherichia coli O157:H7
MTNYSLRARMMILILAPTVLIGLLLSIFFVVHRYNDLQRQLEDAGASIIEPLAVSTEYGMSLQNRESIGQLISVLHRRHSDIVRAISVYDENNRLFVTSNFHLDPSSMQLGSNVPFPRQLTVTRDGDIMILRTPIISESYSPDESPSSDAKNSQNMLGYIALELDLKSVRLQQYKEIFISSVMMLFCIGIALIFGWRLMRDVTGPIRNMVNTVDRIRRGQLDSRVEGFMLGELDMLKNGINSMAMSLAAYHEEMQHNIDQATSDLRETLEQMEIQNVELDLAKKRAQEAARIKSEFLANMSHELRTPLNGVIGFTRLTLKTELTPTQRDHLNTIERSANNLLAIINDVLDFSKLEAGKLILESIPFPLRSTLDEVVTLLAHSSHDKGLELTLNIKSDVPDNVIGDPLRLQQIITNLVGNAIKFTENGNIDILVEKRALSNTKVQIEVQIRDTGIGIPERDQSRLFQAFRQADASISRRHGGTGLGLVITQKLVNEMGGDISFHSQPNRGSTFWFHINLDLNPNIIIEGPSTQCLAGKRLAYVEPNSAAAQCTLDILSETPLEVVYSPTFSALPPAHYDMMLLGIAVTFREPLTMQHERLAKAVSMTDFLMLALPCHAQVNAEKLKQDGIGACLLKPLTPTRLLPALTEFCHHKQNTLLPVTDESKLAMTVMAVDDNPANLKLIGALLEDMVQHVELCDSGHQAVERAKQMPFDLILMDIQMPDMDGIRACELIHQLPHQQQTPVIAVTAHAMAGQKEKLLGAGMSDYLAKPIEEERLHNLLLRYKPGSGISSRVVTPEVNEIVVNPNATLDWQLALRQAAGKTDLARDMLQMLLDFLPEVRNKVEEQLVGENPEGLVDLIHKLHGSCGYSGVPRMKNLCQLIEQQLRSGTKEEDLEPELLELLDEMDNVAREASKILG

SEQ ID NO: 10792 - protein, 253 aa, Escherichia coli O157:H7
MILSAFSLEGKVAVVTGCDTGLGQGMALGLAQAGCDIVGINIVEPTETIKQVTALGRRFLSLTADLRKIDGIPGLLDRAVAEFGHIDILVNNAGLIRREDALEFSEKDWDDVMNLNIKSVFFMSQAAAKHFIAQGNGGKIINIASMLSFQGGIRVPSYTASKSGVMGVTRLMANEWAKHNINVNAIAPGYMATNNTQQLRADEQRSAEILDRIPAGRWGLPSDLMGPVVFLASSASDYVNGYTIAVDGGWLAR

SEQ ID NO: 10793 - protein, 711 aa, Escherichia coli O157:H7
MCSGSAGGILTPISSLDLNALGNLPAAKDVDAEQSALENGLTLVLKNIEFRLLDSDGATSAILEAHRSLAGDTSLHEHLLAGVSAGLSCAEAIVASANHFCEEFSRSSSSYLQERALDVRDVCFQLLQQIYGEQRFPAPGKLTQPAICMADELTPSQFLELDKNHLKGLLLKSGGTTSHTVILARSFNIPTLVGVDIDALTPWQHQTIYIDGNAGAIVVEPGEAVARYYQQEARVQDALREQQRVWLTQQARTADGIRIEIAANIAHSVEAQAAFGNGAEGVGLFRTEMLYMDRTSAPGESELYNIFCQALESANGRSIIVRTMDIGGDKPVDYLNIPAEANPFLGYRAVRIYEEYASLFTTQLRSILRASAHGSLKIMIPMISSMEEILWVKEKLAEAKQQLRNEHIPFDEKIQLGIMLEVPSVMFIIDQCCEEIDFFSIGSNDLTQYLLAVDRDNAKVTRHYNSLNPAFLRALDYAVQAVHRQGKWIGLCGELGAKGSVLPLLVGLGLDELSMSAPSIPAAKARMAQLDSRECRKLLNQAMACRTSLEVEHLLAQFRMTQQDAPLVTAECITLESDWRSKEEVLKGMTDNLLLAGRCRYPRKLEADLWAREAVFSTGLGFSFAIPHSKSEHIEQSTISVARLQAPVRWGDDEAQFIIMLTLNKHAAGDQHMRIFSRLARRIMHEEFRNALVNAASADAIASLLQHELEL

SEQ ID NO: 10794 - protein, 549 aa, Escherichia coli O157:H7
MEIFFTILIMTLVVSLSGVVTRVMPFQIPLPLMQIAIGALLAWPTFGLHVEFDPELFLVLFIPPLLFADGWKTPTREFLEHGREIFGLALALVVVTVVGIGFLIYWVVPGIPLIPAFALAAVLSPTDAVALSGIVGEGRIPKKIMGILQGEALMNDASGLVSLKFAVAVAMGTMIFTVGGATVEFMKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILETSLMAAEIDPNVEIWMLFTDIILIYAALMLVRFGWLWTMKKFSNRFLKKKPMEFGSWTTREILIASFAGVRGAITLAGVLSIPLLLPDGNVFPARYELVFLAAGVILFSLFVGVVMLPILLQHIEVADHSQQLKEERIARAATAEVAIVAIQKMEERLAADTEENIDNQLLTEVSSRVIGNLRRRADGRNDVESSVQEENLERRFRLAALRSERAELYHLRATREISNETLQKLLHDLDLLEALLIEENQ

SEQ ID NO: 10795 - protein, 157 aa, Chlamydia muridarum
MCIEKDLFFMKKALDEARKAYELDEVPVGCIIVQGDAIIARGHNSVERLKDPTAHAEMICISAAAEYLQNWRLKDTTLYCTLEPCLMCAGAIQLARIPRIVWGAPDLRLGAGGSWLNVFLEKHPFHQVECCPGICHQESEWLMKNFFWEKRKEKNEK

SEQ ID NO: 10796 - protein, 529 aa, Chlamydia muridarum
MTQTAEKPFGKLRSFLWPIHMHELKKVLPMFLMFFCISFNYTILRDTKDTLIVTAPGSGAEAIPFIKLWLVVPSAVVFMLIYAKLSNILSKQALFYAVLSPFVVFFALFPLVIYPYRHILHPTDFADTLQAILPSGFLGFIAMLRNWTFAAFYVLSELWGSVMLSLMFWGFANEITKISEAKRFYALFGVGANVALLISGPAIVWSSKLRASLGEGVDPWGVTLYFLMAMFLCSCAIIAACYWWMNRYVLTDPRFYNPAELKAKKSKPKMSMGESFSYLLRSPYMLLLALLVICYGVCINLVEVTWKSQLKMQFPNPNEYSAFMGTFSFWTGVVSVFVMLFIGGNVIRRFGWLTGALVTPVMVLVTGAIFFALVIFRDHATGLVAALGTTPLMLAVVVGAVQNILSKSTKYALFDATKEMAYIPLDQEQKVKGKAAIDVVAARFGKSGGSLIQQGLLVVCGSISAMTPFLAVALFAIIMVWLTSATKLNKLFLAASAAKEQELAEATAAAEKEASPAAKEVSPAIEGVS

SEQ ID NO: 10797 - protein, 379 aa, Chlamydia muridarum
MKRLALIGSTGSIGKQVLQVIREIPDAFVIETLAAYGRNRESLISQIREFSPRVVAVRDETTYKELRKLFPHIEILSGEEGLIAVATAASVDMTIVASSGIDALPAVMASIQERKTIALANKESLVAAGELVTTLAKKNHVQILPIDSEHNALFQCLEGRDPSTIKKLILTASGGPLRNKSKEELQKVTLQEVLKHPIWDMGPKITVDSSTLVNKGLEIIEAFWLFGLQAVEIEAVIHPQSLIHGMVEFCDGTILSVMNPPSMLFPIQHVLTFPDRYPSIISGLNFLTNQTLEFLPIDDERFPSIRLAKDVLREGGSMGCFFNGANEALVQRFLSGEIAWYQIVSKLQTLMDKYVVRSCLSLEDILQVDSEARALASEC

SEQ ID NO: 10798 - protein, 357 aa, Chlamydia muridarum
MREALTFDDVLLVPQYSEVLPQDACLTSSVSESLSLTIPILSAAMDSVTELSMATAMSVAGGLGIVHKNMDVNAQVAIVKQIKSQSTSSVIGGAVGIGQQGLERAEALVEAGIDTLVVDTAHGHSKLVLDTAFTIKKNYPVTLIVGNIVSKAAALCLAEIGVDAVKVGIGPGSICTTRIVSGVGLPQLTAIMDVAEALHDSSVRIIADGGMRYSGDIVKALAAGAHCVMLGSMLAGTDEAPGEIVQINEHSYKMYRGMGSLGAMKKGSAERYFQKNNAKKFVPEGVEGLVPYKGSLHDVLYQILGGIRSGMGYLGAHNLEELRQNAVFSRITHSGRSESHIHNLQYIQHAPNYQISK

SEQ ID NO: 10799 - protein, 248 aa, Chlamydia muridarum
MNSLLVNKAAIVTGGSRGIGFGIAKLFAEHGANVQIWGINEEAGKSAAQDLSDKTGSKVSFALVDVSKNDMVSAQVQKFLAEYGTIDVVVNNAGITRDSLLMRMSEEEWSSVIDTNLGSIYNVCSAVIRPMIKARSGAIVNISSIVGLRGSPGQTNYAAAKAGIIGFSKALSKEVGSKNIRVNCIAPGFIDTDMTKGLSDNLKNEWLKGVPLGRVGTPEEIAMAALFLASNQSSYITGQVLSVDGGMA

SEQ ID NO: 10800 - protein, 632 aa, Chlamydia muridarum
MISPLLQHISSPQKLRSLSLDQLPLLCDEIRNRIIATLSLTGGHLASNLGIVELTVALHYVFASPEDQFIFDVGHQAYVHKLLTGRNTEAFSNIRHDNGLSGFTSPQESNHDIFFSGHAGNALSLALGLAKGASHGSSHILPILGDAAFSCGLTLEALNNVPSDLSKFIIVLNDNQMSISENVGNIPQGISQWIQPPKFDKIFQKIHSWMRKIPGFSRQKSELLHKVDIALKSLSHPLFEQFGIHYVGPFDGHNIKKLIPALEAVKGLPYPVLFHVCTAKGNGLAEAEKDPALYHGVKAYFKNHSPKKKPLSSEVKTPSSFPQHVGHILCQLGEKHPRLQVVTPAMSLGSCLEDFRKQFPDRFTDVGIAEGHAVTFSAGIARSGTPVVCSIYSTFLNRAMDNVFHDVCMQELPVIFAIDRAGLAFHDGRSHHGIYDLGFLCSMPNMVVCQPRNASVLERLLFSSLLWKSPCAIRYPNLSTRKEVSNPSFSPIFPGEAEVLCQGDDLLLIALGHMCDTALAVKEQLLDHGISTTVVDPIFIKPLDTELLQTLLSHHSKVVVLEEHSIHGGLSAEFLLFLNNHNLKTDVLSLGIPDIFIPHGNPETILNMIGLTSDQITLKILAHFNFSAPIPI

SEQ ID NO: 10801 - protein, 678 aa, Chlamydia muridarum
MRHSIYQLDSAVENVFRLAWTLRFSERKMLLLSRQSGSGGSFQLSCAGHELAGVVAAKSLIPGKDWAFPYYRDQGFPLGLGCDLSEIFASFLARTTQNHSDGRMMPYHYSHKKLRICCQSSVVGTQFLQAAGRAWAVKNSGKNEVVYVSGGDGSTSQGEFHEMLNFASLHQLPLVIVIQNNQWAISVPFADQCGADLVALGKSYSGLATYKVDGGDLSALTQTFDCAVSDARHHHIPALVIVDVVRLESHSNSDNQTKYRSEEELLYCQEQDPLVRLEKSLIDDFGVAQETIEQIKEELQETISKACELAESTPFHCKGATKHEVFAPYNVSLIDYENSLESASLQGSEPRVMRDAITEALVEEMHRDPGVVVFGEDVAGNKGGVFGVTRTLTERFGRNRCFNTPLAEATIIGTAIGMAFDGFHKPVAEIQFADYIWPGINQLFSEAASIYYRSAGEWEMPIVIRTPCGGYIQGGPYHSQNIEAFLAHCPGLKVAYPSNAADAKALLKAAIRDPNPVVFLEHKALYQRRAFSTTPVFSSDYVLPFGKARIVHSGTDLTIVSWGMSLVMSVEVAKDLLGLGVSVEVIDLRTIVPCDFATVCESVKKTGKLLVVHEASEFCGFGSELVALVAERAYRYLDAPIKRIGGRHSPIPYSKVLENEVLPQKEMIFQEAKSLAEF

SEQ ID NO: 10802 - protein, 543 aa, Chlamydia muridarum
MSSEVKTFSKFRRYFFPIHKSEFPKFIPLLLLAFFVGFNYSLLKTTKDSLVLAGSRAGAEVIPFLKVWGIVPGAVIITMIYGWMSCRYSRGFVFCALVGGFLSFFALFACVIYPMGDALHLNGLAAKLQTILPRGARGFVVMVQYWSYSLYYVMSELWSSVVLSTLFWGIANHITSVREAGRFYALINVGLNVSSIVAGEISLWLGKHTLIPSSMAVDAWHGVLLNITLLIVAAGGLILYLYRKLDHLTEEAPVLGDGLVSEMSVAQLKQEKKRPKAKAKSLLSVLFRSRYLMGIAVVVLAYNLAIHLLEVVWKEQVCQIYSSRVEFNSYMSRITAFTGIVSALAGVFAAGQSIRRWGWTVGALITPLTMLITGGLFFGAIYAVKGDAMILGGFLGFSPLVLTAWLGGVQNVFSRAIKFTYFDQTKEMAFIPLEDDEKDYGKAAIDGVISRVGKSGGSLVYQALLIIFSSVADCMNAITIVLLLALGGWIWVVAWLGKEYSVRTAALGKARAAEEPSLQDEDESRVSSPISEPEAREEVVTTL

SEQ ID NO: 10803 - protein, 318 aa, Chlamydia muridarum
MMLVLRFANLYVEPMAIFLIFLNAFIWSSSFALSKSAMDAASPLFVTGSRMVLAGIVLFGLLLFKRESFRLPRQAVMPIVLLSVIGFYLTNVLEFIGLQGLSSSKACFIYGFSPFTAAFCSYVQLREVVTWKKLGGLSLGLVSYLVYLLFGGGEDVSEWGWQLGMPELLLIVATCLSSYGWTLLRKLERQCESLSITAINAYAMVIAGILSLAHSAITEVWNPLPVENPVLFLQSIGALVIFSNLICYNLFAKLLRSFSSTFLSFCNLVMPLFASFFGWLLLGESFPPGLLFAVGFMVLGCRLIYHEEFRQGYVLSSE

SEQ ID NO: 10804 - protein, 424 aa, Chlamydia muridarum
MFDVVISDIEAREILDSRGYPTLYVKVITNTGIFGEACVPSGASTGIKEALELRDQDPKRYQGKGVLQAVANVEKVLLPALQGFSVFDQITADAIMIDADGTSNKEKLGANAILGVSLALAKAAAATLERPLYRYLGGAFSHVLPCPMMNLINGGMHATNGLQFQEFMIRPISAPSLTEAVRMGAEVFHTLKKILQNRQLSTGVGDEGGFAPQLASNSEALDLLLAAIEKAGFIPGEDISLALDCAASSFYNTQDKTYDGKSAADQVAVLTELCDRYPIDSIEDGLAEEDFEGWKLLSETLGDRIQLVGDDLFVTNSALIAEGIAQGLANAVLIKPNQIGTLTETAEAIRLATTQGYATILSHRSGETEDTTIADLAVAFNTGQIKTGSLSRSERIAKYNRLIAIEEEIGPEAVFQDSNPFSKA

SEQ ID NO: 10805 - protein, 571 aa, Chlamydia muridarum
MRMDTLDSQAADAAQEEEIQRKLEELVTLAKDQGFITYEEINEILPPSFDSPEQIDQVLIFLAGMDVQVLNQADVERQKERKKEAKELEGLAKRSEGTPDDPVRMYLKEMGTVPLLTREEEVEISKRIEKAQVQIERIILRFRYSTKEAVSIAQYLINGKERFDKIVSEKEVEDKTHFLNLLPKLISLLKEEDSYLEERLLALKDPALSKQDQAKLNDELEKCRIRTQAYLRCFHCRHNVTEDFGEVVFKAYDSFLQLEQQINDLKVRAERNKFAAAKLAAARRKLYKREVAAGRTLEEFKKDVRMLQRWMDKSQEAKKEMVESNLRLVISIAKKYTNRGLSFLDLIQEGNMGLMKAVEKFEYRRGYKFSTYATWWIRQAVTRAIADQARTIRIPVHMIETINKVLRGAKKLMMETGKEPTPEELGEELGFTPDRVREIYKIAQHPISLQAEVGDSGESSFGDFLEDTAVESPAEATGYSMLKDKMKEVLKTLTDRERFVLIHRFGLLDGRPKTLEEVGSAFNVTRERIRQIEAKALRKMRHPIRSKQLRAFLDLLEEEKTGSGKIKSYKN

SEQ ID NO: 10806 - protein, 379 aa, Chlamydophila pneumoniae J138
MKHLAVLGSTGSIGRQTLEIVRRYPSEFKIISMASYGNNLRLFFQHLEEFAPLAAAVYNEEVYNEACQRFPHMQFFLGQEGLTQLCIMDTVTTVVAASSGIEALPAILESMKKGKALALANKEILVCAGELVSKTAKENGIKVLPIDSEHNALYQCLEGRTIEGIKKLILTASGGPLLNKSLEELSCVTKQDVLNHPIWNMGSKVTVDSSTLVNKGLEIIEAYWLFGLENVEILAVIHPQSLIHGMVEFLDGSVISIMNPPDMLFPIQYALTAPERFASPRDGMDFSKKQTLEFFPVDEERFPSIRLAQQVLEKQGSSGSFFNAANEVLVRRFLCEEISWCDILRKLTTLMECHKVYACHSLEDILEVDGEARALAQEI

SEQ ID NO: 10807 - protein, 515 aa, Chlamydophila pneumoniae J138
MTKTEEKPFGKLRSFLWPIHTHELKKVLPMFLMFFCITFNYTVLRDTKDTLIVGAPGSGAEAIPFIKFWLVVPCAIIFMLIYAKLSNILSKQALFYAVGTPFLIFFALFPTVIYPLRDVLHPTEFADRLQAILPPGLLGLDAILRNWTFAAFYVLAELWGSVMLSLMFWGFANEITKIHEAKRFYALFGIGANISLLASGRAIVWASKLRASVSEGVDPWGISLRLLMAMTIVSGLVLMASYWWINKNVLTDPRFYNPEEMQKGKKGAKPKMNMKDSFLYLARSPYILLLALLVIAYGICINLIEVTWKSQLKLQYPNMNDYSEFMGNFSFWTGVVSVLIMLFVGGNVIRKFGWLTGALVTPVMVLLTGIVFFALVIFRNQASGLVAMFGTTPLMLAVVVGAIQNILSKSTKYALFDSTKEMAYIPLDQEQKVKGKAAIDVVAARFGKSGGALIQQGLLVICGSIGAMTPYLAVILLFIIAIWLVSATKLNKLFLAQSALKEQEVAQEDSAPASS

SEQ ID NO: 10808 - protein, 428 aa, Chlamydophila pneumoniae J138 [sequence omitted]

SEQ ID NO: 10809 - protein, 148 aa, Chlamydophila pneumoniae J138
MQQAFKEARKAYDQDEVPVGCVIVKDDKIIARAHNSVEKLKDATAHAEILCIGSAAQDLDNWRLLDTVLYCTLEPCLMCAGAIQLARIPRIVWAAPDVRLGAGGSWVNIFTEEHPFHTVSCTGGVCSEEAEHLMKKFFVEKRREKSEK

SEQ ID NO: 10810 - protein, 397 aa, Xylella fastidiosa 9a5c
MSASFSPHTITLIKSTVPLLAEHGTTIIEAMYHRLFEDPQIEALFNQANQKNGTQIHALAGAILAYARNIDNPGVLASAIERIAQKHVGYAIHPEHYPHVATALLGAIKKVLGDVATSEVLEAWGEAYWFIANLLKDREAVIREGIMTKNGGWIHWRRFVISKRIPESETITSFMLHPEDGGPVVPHQAGQYLTFRFDAAGMPGMKRNYSISCGPNSDHYRITVKREHGTGASAFLHDQAKVGTIIECTPPVGDFFLPSVIERPIVLLSGGVGLTPMVSMMEQIAEAHPDAQVWYVHGTQNRETHAMDAHIRALVSRHKHMKATTFYTQRREADDAEAGFITIDWLRANTPFQKADFYLCGPRPFLRTFVRDLIGAGVPAVQVHYEFFGPMDEEMAA

SEQ ID NO: 10811 - protein, 611 aa, Xylella fastidiosa 9a5c
MGVSMNTVPFPSQGGIDRRRFLQGLALGGVAAGTGLWRLPVHAANPELPPLQRRTTPLELRIGQSSVNFTGRMRPAITVNNSLPGPVLRWRQGDTVQIHVTNTLPDVMTSIHWHGIVLPSNMDGVPGMSFDGIAPGEHYLYRFQLHQSGTYWYHSHAMFQEQAGLYGALIIDPLEPPPYRADREHILLFSDWTDLDPAALFRRLKKMSSYDNTYQRTVRDFFHDIRRDGLRTTLADRRMWGRMRMTPTDLSDVNAHTYTYLLNGTTPAGAWTGLFRPGEKVLLRLINGSAMTYFDVRIPGLKLTVVAVDGQYVHPVTVDELRIALAETYDVLIQPHGQDAFAIFAQDMGRTGYACGTLAVRPGLHAPLPALDPRPRLTMQDMGHGMAHGQHGSRASEMADMPGMTHPGRLGDHASHASQPPAQTIPHGSHSLPADRTAPRHPASEQNNPLVEMHVDAPQPLLNDPGIGLRDNGRHVLTYADLHSLFDDPDGREPGREIELHLTGHMEKFAWSFDGIPFASAQPLRLNYGERVRIVLVNDTMMAHPIHLHGLWSDLEDANAAFQVRKHTIDMPPGTRRSYRVRADALGRWAYHCHMLYHMESGMMREVQVRP

SEQ ID NO: 10812 - protein, 409 aa, Xylella fastidiosa 9a5c
MTGSHQPRSLNGQRLLLCVSGGIAAYKSLELVRRLCGAGVQVQVAMTASAQQFVTPLSFQALSGQSTRTTLWDGNAEQAMGHIELARWAECVLIAPASADVIARLAHGLADDLVTTLCLATTALLIICPAMNHNMWLHPATQANVAMLVGRGVQVIGPEDGPLAEGVSGLGRMSEPEAIVAALVQGVSPAPVHGGLFHGQRIVISAGPTFEDLDPVRYLGNRSSGKMGFALASAAVSHGAEVVLVAGPVYQPTPPGVTRVDVRSAAQMRDAVLSAFPADVYIGAAAVADYAPKSVLPQKIKKSGQTLTLELVRTQDILSEVAAQTANLKFVVGFAAETHDVERYARGKLAAKHLDLIIANQVGIVGNGFESDDNAVTVYWQGGERVFASCSKVELAERLLALIAERMQT

SEQ ID NO: 10813 - protein, 251 aa, Xylella fastidiosa 9a5c
MEHVSMITDNSPRFRALVTGGSGHLGTAICRQLIADGAHVIVHANHHRSRADTLVECLCAEGGSAEVIVFDVTAAQASKTALENLLQTGPIQIIINNAGIHDDAPMAGMSSTQWHRVIDVSLHGFFNVTQPLLLPMARTRWGRIVCISSVTAVLGNRGQSNYAAAKAGLHGAARSLAREMANRGITVNVVAPGVIESEMVGKTFTPEMIKQLVPTGRPGRPEEVAALIGFLCSEKAGYINGQVIGINGGMG

SEQ ID NO: 10814 - protein, 247 aa, Xylella fastidiosa 9a5c
MNKPLQGEVALVTGASRGIGAAVADLLADHGATVIGTATSVSGAQLIGDRLALLAGHGRALDVNDTAAVGALVGEIAEQFGSVSILVNNAGITRDNLLMRMKDEDWESIVDTNLSSIFRTSRAVVRDMMKARKGRIINIASVVGVTGNAGQANYAAAKAGVIGFTKSLAKEVGPRGITVNVVAPGFIDTDMTRVLSEGVRNDILNRVPLGHLGDPVDIAHAVAFLAAPAARYITGETLHVNGGMYMP

SEQ ID NO: 10815 - protein, 499 aa, Xylella fastidiosa 9a5c
MQIVLEDCQAVDGIFRLTNASFGRHLRLGSVVGESLCDIMPDDGPQWIKRYGGVALSGQRVHFEARALCRWYSVEVMRVGAPEGRLLGVLFMDVTERKRMERRLAESEVRFNILADGLPMPVWVFDAQGGMRFVNTAYGEFFGVDLSSGTVPEWSMVLHPEDVLIFEFKLSAALKTQSAFRALVRARRYDGQWRWIEMSATPRYSPDGHFIGLTGSSPDVTERLEIELAREQLLKSERAARNEAENMARLKDEFLSTLSHELRTPLTTILGWSELLLQRIDEQHPCYKGLSVIASSAKVQKRLISDMLDLSSMLLGKMQLKMEVLDLVEQIREVIGLYEPVVDSKGQRLLLRASEMPCLVLGDATRLRQIFENLLSNAIKFTPTDGCIDVEIDADGDSFRVSVTDSGDGIAAEFLPHLFSRFRQADGTTTRCHGGLGLGLAIVQSLVEMHGGYVGATSPGIGKGAMFTVSLLRYVCAIDVADTVICDRRIGSAGDQGEY

SEQ ID NO: 10816 - protein, 261 aa, Xylella fastidiosa 9a5c
MRTMTQSRWRLDGRTALITGASTGIGLAVARELLGLGADVLLVARNADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDVYYYEQVIERTPMRRIGEPEEVAAAVAFLCLPASSYVTGECIAVDGGFMRYGF

SEQ ID NO: 10817 - protein, 167 aa, Xylella fastidiosa 9a5c
MTATPPPPALPEHIHWMRHALTLAHRAATEFDEIPVGAVLISPEGTLLGEGWNYNITSHDPSAHAEIMALRAAGHQLRNHRMPGCTLYVTLEPCLMCAMAIIHARIAHLIYAAADPKTGACGSTFDILNDPRHNHHVHVYGGLLAEEASRRLTNYFRTKRGQPPLPQ

SEQ ID NO: 10818 - protein, 446 aa, Xylella fastidiosa 9a5c
MPGLMSIRRKYASKQPLKGVRVTGSLHMTIQTAVLIETLKDIGADVRWASCNIFSTQDHAAAAIATSGTPVFAWKGETLEEYWDCTLQALTFTLSDGTLTGPELIVDDGGDATLLIHKGYELENGSTWVDEPSDSLEEQVIKRLLKRIAIERPGYWTRVVNDWKGVSEETTTGVHRLYQIAATGRLLVPAINVNDSVTKSKFDNLYGCRESLADGLKRAMDVMLAGKLAVVCGYGDVGKGSAHSLRAYGARVIVTEIDPICALQAAMEGFEVTTVEDTLGQADIYVTTTGNKDVIRIEHMTAMKDQVIVCNIGHFDNEIQVDALNALAGVQKINIKPQVDKFILPNGNTLFLLAEGRLVNLGCATGHPSFVMSNSFANQTLAQIDLWQNKDVYEKNVYRLPKKLDEEVARLHLEKIGVKLTTLTANQAAYLGISVEGPFKPEHYRY

SEQ ID NO: 10819 - protein, 396 aa, Xylella fastidiosa 9a5c
MTKPIRNVAVLGATGSIGAAALDVLARHPRQFHVSLLAAGQRVDALLALCHTYRPDHAVIGDATLYTTLRDGLNAAGLATKAYAGEAALAELVASTTCDTVVAAIVGAAGLHSTLAAARAGKRLLLANKESLVLAGMLLMREASISGAEIIPIDSEHNAIFQCLRSRTTDGVHRITLTASGGPFRGHNRTMLAKITPTQAMAHPTWSMGPKISVDSATLMNKGLEVIEAHHLFGLPSEQIDVLVHPQSLVHSLVEFIDGSTLAQLSLPDMRTTLAVGLSWPERIGSGVPGLDLMKHNRLDFERPDTETFSCLRLARDAMQTGGTAPAVLNAANEIAVSAFLQGRIGFLTIPALIEHALTTLPRYEADTLETLLTVDTETRRITHAALTHFPLPLPL

SEQ ID NO: 10820 - protein, 662 aa, Xylella fastidiosa 9a5c
MLLSDLGVSLALMLAIVMHPQISHVRRCIGIIADYTSLTVLMLLMGEAGSPLYVLCLWVTIGNGLRYGCAYLLVTTTLSALSFLMVILVSAYWKSNPFLAWGLLIGLIAIPWYFQSLLKALIQALKDARHANEAKSRFLANMSHEFRTPLNGLSGITEVLATTRLDAEQRECLKAIQASVHSVLSLIEEVLDISRIEAGKIRILHDTFSLQEVIGSVGLILQPQIRNKVLEYRVDVGLDVPEWLFGDAGYVRQVLLNIVGNAVKFTERGGITLCVSVLNRSRERSVVLRFEVADTGIGVPLGMRARLFDMFEQADVGLDRRYQGSGLGTAIAKGLIELMGGSIGFEENVPCGSLFWFELPFELGKEPVVAQELPEASQCTEASNVIAFSNPFLRHRARVKSLRVLVADDHETNRMVLSRILDKAGHKLLCVDGAEAVLDCLISMEFDVVIIDLHMPGMSGLEMLKQLRVMQSAGLPYTPVLVLSADAASDSIRCCKEAGARAFLSKPVLATKLLDVLAEIAEGDGGALPYAALSQSSVQQHQVFDPTGLDDLAELDMDDGFEERFIVQSLRDAEHCQQTMLSAAETNQWQEVREQAHALRGVLGHLGLMRASSLAAELMRIPDWQLQSEWCARVQVLYEELRSGRDALEARRQERRRSGILQ

SEQ ID NO: 10821 - protein, 868 aa, Xylella fastidiosa 9a5c
MSASPTAERWIVLKFGGTSVSRRHRWDTIAMVVRKRLEEHGTRVLIVVSALSGVTNELTAIAQGVVDSAQRVAALEQRHRDFLAELGLDAQAVLGTRFTVLWDLLQDARAVTRSLDWQAELLGQGELLSSTLGAAYLGASGVDIGWMDARDWLTALPPQPNQSEWSQRLSVSCQWKSDVEWRTRFDAQRAQVLITQGFISRHQDGGTAILGRGGSDTSAAYFGALLGAACVEIWTDVPGMFSANPKEVPDARLLTRLDYYEAQEIATTGAKVLHPRSIKPCRDTGVPMLILDTERPDVLGTRIDAEVEPVLGVKAISRRDGIVLVSMEGIGMWQQVGFLADVFTLFKKHGLSVDLIGSAETNVTVSLDPSENLVNTDVLTALSTDLSQVCKVKIIVPCAAITLVGRGMRSLLHKLSEVWATFGKERVHMISQSSNDLNLTFVIDETDADGLLAVLHFKLIESGAMPVQERAVFGSPWREIIGHVRTRVMPWWHSARMRLLAMRDEEGIGPCYVYHLPTVRERARQLNAVAAVDQRYYAIKANPHPAILRTLIEEGFGLECVSLGELRHVFAVVPHLVPSRVLFTPSFASRVEYEQAFLLGVNVTLDNVEALRLWPEVFRDRTLWLRIDLGYGDGHHEKVTTGGKTSKFGLSVTRIDEFIDVAKTLNIIVTGLHAHLGSGVERGDHWSRMYDELAGFASRIGSVSTLDIGGGLPIPYRPDDEPFDVEAWGVSLAEVKALHPKLQLVIEPGRFLVAEAGVLLTRVTQVIEKDGIRRVGLEAGMHTLIRPALYDAWHDVENLSRLDEIPHVLCDVVGPICESSDVFGRCRHLPAATASGDLMLIADAGAYGFSMASTYNLRGLPAEVVLDA

SEQ ID NO: 10822 - protein, 799 aa, Xylella fastidiosa 9a5c
MALNGASYLNENILWLHELRLTDLARVGGKNSSLGEMIGNLTALGVSVPGGYATTAAAFKAFIAYNNLSKRIYDKLATLDVEDVKALTAAGKEIRDWIIDAPLQPELEKDIRDAYDTLSKDNSGNDVAVAVRSSATAEDLPDASFAGQQETFLNVIGADQVVHKIKEVFASLYNDRAIAYRVHHGFKHEDVFLSAGIQLMVRSDISASGVLFTLDTESGFRDVVFVTASFGLGEMVVQGAVNPDEFYVYKKTLKAGKPAILRRTLGSKLVRMVYSDSPGERVKIEDTPTELRHCFAISDADVQELAKQALIIEEHYGRPMDIEWAKDGVSGKLFIVQARPETVKSRSHTTQIERFALQQRGEILTEGRAIGQKIGSGISRVVHSLEDMHHMQPGDVLVADMTDPDWEPVMKRASAIVTNRGGRTCHAAIIARELGVPAVVGTGNALSIIQDGQPITVSCAEGDTGYIYAGKLPFERTTTDLGHMPPAPLKIMMNVANPERAFDFGQLPNAGIGLARLEMIIAAHIGVHPKALLEYHKQDADTKQKIDAKIAGYPDPVSFYVNRLAEGIATLTASVAPHTVIVRLSDFKSNEYAHLIGGQHYEPQEENPMLGFRGASRYVDPSFSDAFALECKAVLKVRNEMGLDNLWVMIPFVRTLEEGRKVIDVLRQNGLKQGENGLKVIMMCEVPSNALLADEFLDIFDGFSIGSNDLTQLSLGLDRDSSIVAPLFDERNPAVKKLLSMAIKAARSKGKYIGICGQGPSDHPDLAEWLMQEGIESLSLNPDTVVDTWLRLAKLKTVH

SEQ ID NO: 10823 - protein, 461 aa, Xylella fastidiosa 9a5c
MGPELFCESRYRDDNPMVLWYCSLLWLLTGPMTAIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKVSLPVPMMNIINGGAHADNNVDFQEFMVLPVGFASFSEALRAGTEIFHALKSVLKGQGLSTAVGDEGGFAPDLRSNVEALDAILEAIGRAGYIAGEDVLLGLDVASSEFRDNGKYNLVGENKRLTSEQFVDFLDDWVTQYPIISIEDGLAEDDWAGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 10824 - protein, 1197 aa, Xylella fastidiosa 9a5c
MRGALLTALLVLVSLLTATAAVPEMPRFRVLDATSGLPSNVVRAMLQDAAGYLWLATSDGLARYDGTAFKVWRHDPNDSGSLPGDSVLALYIDVQDRIWVLSENAGLAVLDAQRRRFIQVPVGSVAKTDALHTLTGHGDAIWLSDLHASVIRIDSAGALTRYALADVSPTLKDTPVVALTFDANGRLWVGTPDGLLYFEAGRLHLAPPPLDKASIHSIAAVGSRLWVGSTDGVYLQDAEGRWRAPNWGPMFASGNLLLSVADAGDGEFWLGSERGLWRTRQERPPVQIPLSDMHHGVSTVSSLWRDTSGGLWVPVYGRGLGYLRQDWKRMAVVRPSDGGESAYCNVAPAAYSGGLWQLNRIGELMHLNTSTGELVHTGWQRHELRGMNITTTLEDSRGRLWLANMQNGLSRLDLKNGQWREWAAHEDDAVPLYGPISWIVEMPDSSLWLEALGVLQQRDLESGRVLNQIVPGSHGLDGSRVEQIGLGPDGRLWLAAGSGVYAWESQRRMFVPISDLTGTRAYSFVPVGGNEVWVHRLRGLEQWRHSSHGWKRVALVGPQHGLPAMESLGMQHDAQGRIWLSTRRGLWRIDNTDELQVRNFGLRDGLGTQEFAEACLWMAPDGVLVGGTTDGYLMLFDTAMPDPAPFVPQLRMETVSVIRAGRRIDLPVDQPFELLPNDRQLIVGARLLSFGDPLSNRYSYWLKGFDTGWIDQGSSGTREFSSLPPADYTLLIQGTDPMGNLSRIHLVTFRVLPPWWRSAWGMSVLTGSGLLLLWGVAWNYHRRLRRRACLQLEQHQREVAERASLAKTQFLATLGHEVRTPMTGVLGMSELLLETPLDTRQHGYATSIQAAGKHLLRLVNDALDLAKIEAGKLSLERRDFDFHALLEQVVAMIRPMVERKGLRFVYRLDPEVPQYVHGDTDRLQQILLNLLINATKFTEHGEVVLQVAPGQEQACLGVRIDVADTGPGLSEEQCQRLFRRFEQVNGASTAARYGGSGLGLAICRELATVMEGEIHVDSELGKGTCFRVLLPLPWVLAVQHAVAVMDAEPSPCSNPLHLLLIEDDPTVAEVIVELLRVRGHRVTHALHGLEALVEVTLTRFDACLCDLDLPGLDGAGLIVQLRAQGQFFPIVVVTARTDADAQRQALQVGCDAFLRKPVTGEMLEQVLTQVLSAPRQEADVDTPKKGMEWEGPGSVTR

SEQ ID NO: 10825 - protein, 618 aa, Xylella fastidiosa 9a5c
MSNERTAQQSDIKQLISKGLEQGYLTYAEVNDHLPEDLVDPDQIEDIIGMINGMGIEVHEVAPDAETLLLNEGNTGNREVDDTAAEEAAAALSALDTEAGRTTDPVRMYMREMGTVELLTREGEIAIAKRIEEGLSEVQAALGVFPLSTELLLSEYELHKEGKRRLTEVVVGFNDLIEEDNSVTSSVDVTDESIVEVDEEDDDSVGNDEDAPTIGPDPAEVASRIESLSTEYAKFKKLYAKHGPEHKAVIKVREDVAAIFVTFKLSLPLTDLLVQQLQNMVNSVKDHERKVLHLATNVAKMPRKDFIRSWENNQTNLEWVEDAIKRKQKWSSALRDIKDQITAEQQASIDLEKANSLTLADIKEINRMMVYGEAKASKAKKEMVEANLRLVISIAKKYTNRGLQFLDLIQEGNIGLMKAVCKFEHRRGFKFSTYATWWIRQAITRSIADQARTIRIPVHMIETINKLNRISRQMLQQFGREATPEELAKEMDMPEDKIRKVMKIAKEPISMETPIGDDEDSHLGDFIEDPNVESPVDTTTNVNLSETVREVLAGLTPREAKVLRMRFGIDMNTDHTLEEVGKQFDVTRERIRQIEAKALRKLRHPSRSEQLRSFLDID

SEQ ID NO: 10826 - protein, 279 aa, Xylella fastidiosa 9a5c; identical to SEQ ID NO: 681

SEQ ID NO: 10827 - protein, 590 aa, Xylella fastidiosa 9a5c
MPHSAHRPTPTLHTQMNVRLQGHGAARGAALGRAWVRQMNVMEIQDKYITDTNAELHSLYQAMSAARQEIQVLRERMHGTLSHEVGEFLDLHTLLIDDPELLRSPNELILTHNYSAEYALKIQRDRLTTEFEAMEDHYLKSRMDDLNHVLGRIHAFLKKHSPEPKDAAGEILICNNIAPSELAQVQAQGIIGIVIAAGNTLSHSAILAHSLHLPLIVGAGDLQLQKITNGDMLIIDGNSGEIIVNPSPQDLRHYHSRLRERAKEQRELEQLRSKHSRTRDNVDIVVQANAESPDDVSQAYALGAAGVGLYRTEFLFLQRNKLPDEEEQFQTYRDTVLRMNGRPVTIRTLDLGADKTDCTGLTLSNEENPAMGLRGIRLSMAHPAVANTQLRAILRTSTYGHVRILVPMISCREEIILLRKQIKALSIQLRTEGHDIAEQVPLGAMIEVPAAAIALNSFIKEIDFLSIGTNDLVQYLLAADRNNAAISEIYSPLHPGVLAVLAQIIVTAHTHATPVAICGEIAGDPHYVPMLLALGLTEFSLHPATLLEVRRAIRNSDLGALKTSATTLLHARDRKSIEEWMAAHANTTPT

SEQ ID NO: 10828 - protein, 255 aa, Xylella fastidiosa 9a5c
MNPTYDFKGQVALVTGAAAGMGLATARGFAQGGASVVLADRDGERAAQEAAAIVAEGGTAIGLACDVSDEAQVAALVEKTVAEYGRLDFAFNNAGVMAKIAPFAEATSEEFDRVIGINLRGVWLCMKYELQQMQRQGSGVIVNNASVGALTGNVGIGAYIASKHGVLGLTRAAALEYCKKGIRVNAVNPGTIDTQIARDVVGGSDEAFAKLGASAPIGRAGRPEEIASAVLWLCSPGGSYVIGEGLTVDGGYVVP

SEQ ID NO: 10829 - protein, 441 aa, Xylella fastidiosa 9a5c; identical to SEQ ID NO: 738

SEQ ID NO: 10830 - protein, 112 aa, Xylella fastidiosa 9a5c
MKLITAIIRPFKLDEVREALSQVGVSGITVTEVKGFGQQKGHTELYRGTEYVIDFLPKIKIETVVTDERLDSVIEAIRIAAVTGKIGDGKIFVTKIEQVVRIRTGEIDIDAL

SEQ ID NO: 10831 - protein, 565 aa, Xylella fastidiosa 9a5c
MAAAMRGMAVTFFSQFMVSCMHSIQIVLAMLLVVAASGYLVRIIPFSMPLPLLQIALGAVISGVFDGGYELQPEVFFLLFLPPLLFLDGWRIPKQGLFRDKNVILELALGLVVFTVLGIGFLIHWMIPTMPLALAFALAAILSPTDPVALSSITSRVRIPKRMMHILEGESLLNDATGLVCFQFAIAAVLTGHFSLATASLTFVWVLVVGLSLGMTTTYVLSRVQRWVWRHFGGEPAAAILVNLLTPFAAYLLAESMQASGILAAVAAGITMSYVELSGNAPATIRVQRWAVWETVQFTFNGIIFVLLGEQLPGILDDLVHSAQQAGHMNVGWLLVDVAVISAGLMLLRFLWVWLSLQWNLFKAVCCGKQRISPPWQIVVAMSLSGVRGAVTLAGVLTLPLLMPDGTPLPARQLVIFLAASVILVSLLLASVALPYLLRGLELPEKSSYDKEEDFARRVSAQAALEAVERLRQRLVEDSANAERYNEAAHQVSQLYQRKLGAVDLANVDPQETKVFEQVVRRFRQVGLAAERDELFRLAREHNISDELLQRMVRNLDLIEARRRS

SEQ ID NO: 10832 - protein, 670 aa, Xylella fastidiosa 9a5c; identical to SEQ ID NO: 844

SEQ ID NO: 10833 - protein, 303 aa, Xylella fastidiosa 9a5c
MSQDGGVTTDERACAAPLQLSNTFPRVSRHAVQTGLSPHPRVRNVIAVGSGKGGVGKSTIAVNLAVALQRTGARVGVLDADIYGPSVPAMLGLSGRPESPDNKLIEPLRAFGIEAMSIGLLIDVDTPMIWRGPMATSALTQLFNDTLWGDLDYLLIDLPPGTGDIQLTLSQKIPVAGAVIVTTPQDIATLDARKALKMFEKVNVPVLGIVENMAMHCCRQCGHVEHLFGEGGAQQMAEHYHVPLLGSLPLDIAIREHGDLGQPITVAAPEGSVGQAYAAVAACLAVELAKRPRAAIPMTTTLG

SEQ ID NO: 10834 - protein, 485 aa, Xylella fastidiosa 9a5c
MLRILAEALTYDDVSLVPSHSTVLPKDVNLETRLTRNIRLKLPVLSAAMDTVTEARLAIVMAQLGGIGIIHKNLTIEQQVAEVTKVKKYESGVIRDPITVDPETSIRDVLALTRAKNISGVPVVDKGQLIGLVTHRDMRFESELDDPVRHIMTKKEALVTVKEGADSQEVLQLLHKHRIEKILVVNDAFELRGLITVKDIQKKSDYPNAAKDAVTRLLVGAAVGVGGETERRVETLAAAGVDVIIVDTAHGYSQGVLDRVAWIKRYFPQLQVIGGNIVTGDAALALMDAGADAVKVGVGPGSICTTRMVAGVGVPQITAVQMVSDALQDRIPLIADGGIRYSGDIGKALAAGASTVMIGGLFAGTEEAPGDVELFQGRTYKSYRGMGSLAAMEKGSKDRYFQEASDVDKLVPEGIEGRVPYRGSVSGIVHQLMGGLRATMGYVGCATIEEMRTKPQFVKITGAGQVESHVHDVQITKEPPNYRMR

SEQ ID NO: 10835 - protein, 469 aa, Xylella fastidiosa 9a5c
MFLPRPDFRIALFICFMAVSFVISRFGSEVRPTLLLALPLVLGHVSTGLIGFVLNVIAGHHSTVTLAASTIGTALLWLPMLVPMGTLISLTVLVSQLHGAERERDIGPLFRQALWLAMLLGLVMFTFLSVVPALLPLFGIVPDIVPGAAKFLHVVRWGSLAFPLYFCMRYFCEGMHCTFPTMLLGFGGLLVLVPLSYALTYGRFGFSEYGVEGLGIATVMVMWLQAVVFALYLWRSRRFAHLQLFAHLELPCWARIRDLLNIGLPIGISILMEGGLFIVTTLLIGRFGTDEIAAHQIALSVAQLCFMIPMGVAEATTVRIGHAVGRCDLLVMRRVAWAGYAIVIGTQTLSASVLLLGYDVIVAAYTDDLVVASLASKLLLFAAIFQFPDGLQMLSSGVLRGMKDTRVPMLLAMISYWGLGMPLGLGLGFALEWNSRGMWIGLIIGLTAAAVLLGWRFRVVSERMFAGIP

SEQ ID NO: 10836 - protein, 293 aa, Xylella fastidiosa 9a5c
MGYFSMTRNTSMVLVGNNLPVPNALGSLEAYISAVHQISVLSVDEEQLLARRYRDQQDLDAARELVHSHLRFVVRVARGYSGYGLSLGDLIQEGNIGLMKAVKRFDPDMGVRLVSFAMHWIRAEMHEFILKNWRIVKVATTKAQRKLFFNLRKSRTRLGWMNAEEVSAVARDLNVSEREVLEMESRLSGRDIGFDAPEEDNAPPSPVGYLIANDGDPSQAYERGNSEETKLRLLQEGLSVLDTRSRDIIQRRWLETDKKITLQELAEEYGVSAERIRQIEANALKKMKALFAA

SEQ ID NO: 10837 - protein, 467 aa, Mycobacterium tuberculosis CDC1551
MQTHPAKDVSVPIATINPATGETVKTFTAATDDEVDAAIARAHRRFADYRQTSFAQRARWANATADLLEAEADQAAAMMTLEMGKTLAAAKAEALKCAKGFRYYAENAEALLADEPADAAKVGASAAYGRYQPLGVILAVMPWNFPLWQAVRFAAPALMAGNVGLLKHASNVPQCALYLADVIARGGFPDGCFQTLLVSSGAVEAILRDPRVAAATLTGSEPAGQSVGAIAGNEIKPTVLELGGSDPFIVMPSADLDAAVSTAVTGRVQNNGQSCIAAKRFIVHADIYDDFVDKFVARMAALRVGDPTDPDTDVGPLATEQGRNEVAKQVEDAAAAGAVIRCGGKRLDRPGWFYPPTVITDISKDMALYTEEVFGPVASVFRAANIDEAVEIANATTFGLGSNAWTRDETEQRRFIDDIVAGQVFINGMTVSYPELPFGGVKRSGYGRELSAHGIREFCNIKTVWIA

SEQ ID NO: 10838 - protein, 598 aa, Mycobacterium tuberculosis CDC1551
MPPLLPPAPPVPPAPNSPPCPPAPPSAPSVPAPPVPPAPKSNPFPPVPPFAPNPPAPPAPPLANSPPVPPAPAVPPAPIKFWERAAWPPVPAAPRNKPASPPRPPAPPVSRPNPPLPPVPPEPISKAAPPVPPVPPWPVVPMPPDPPVPPIPDRIPPAPPDPPSPPSAPVAPWPPLPPLPNNHPPAPPSAPVPGVPLAPLPISGRPVRAWVGSLIALRICCCRVCSGVLAGALNPSRPSSCPPKPPAPAVPAGAPVPPLPPLPPLPISTPLPPAPPLPPLPALPTSPGAPPAPPVPPAPAKDPPPAPPAPPAPLSRPAFPPAPPAPPASKPSPPTPPAPPEPNNVPPSPPIPPAPPPPSGLDPPLPPAPPAAPRLSMPASPPAPPFPPTLIMLVPPLPPVPPAPNSPPEPPSPPAPPPKMPNPPGPPVPPAPNSPPFPPDPPAPPVPASVAPPAPPTPPSANSPPFPPAPPAPPVAPKAAANPPGPPTPAAPNSMPAAPPAPPAPPVPVLALPPAPPAPPLPMSPPAPPLPPAPPLTPAAPDPPAPPLPINQPPSPPLAPVPGAPLVPLPISGRPVFARKNSLIGASSGDTAAASAAA

SEQ ID NO: 10839 - protein, 342 aa, Mycobacterium tuberculosis CDC1551
MEAAGMCRSDHHLVTGDIPMAGFPVLGGHEGAGIVTEVGPGVDDFAPGDHVVLAFIPSCGKCPSCQAGMRNLCDLGAGLLAGESVTDGSFRIQARGQNVYPMTLLGTFSPYMVVHRSSVVKIDPSVPFEVACLVGCGVTTGYGSAVRTADVRPGDDVAIVGLGGVGMAALQGAVSAGARYVFAVEPVEWKRDQALKFGATHVYPDINAALMGIAEVTYGLMAQKVIITVGKLDGADVDSYLTITAKGGTCVLTAIGSLVDTQVTLNLAMLTLLQKNIQGTIFGGGNPHYDIPKLLSMYKAGKLNLDDMVTTAYKLEQINDGYQDMLNGKNIRGVIRYTDDDR

SEQ ID NO: 10840 - protein, 490 aa, Mycobacterium tuberculosis CDC1551
MTRITRANGCPDGTLENAVVALDGGANYPREILGNKGHGIDMMRRHHLPVPPAFCITTEVGVRYLAAPESTIAAIWDDVLDRMSWLETETSCTFGRGPNPLLVSVRSGATQSMPGMMDTILDVGMTDAVERVLARPGAADFAHDTRRRFTSMYRRIVGSAGPITDDPYAQLRASIEAVFASWNSPRAVAYRDHHGLDDQGGTAVVVQAMVFGNLTANSGAGVLSSRNPITGANEPFGEWLPGGQGDDVVSGLVAVAPITALRDQQPAVYDQLMAAARSLERMAGDVQEIEFTVEDSQLWLLQTRGAERSAQAAVRLALQLHHEGLIDDTETLRRVTPTHIETLLRPSLQTETRLAAPLLAKGLPACPGVVSGTAYTEVDEALDAADRGEPVILVRDHTRPEDVMGMLAAQGIVTEVGGAASHAAVVSRELGRVAVVGCGPGVAAALAGKEITVDGYEGEVRQGVLALSAWSESDTPELRELADIAQRISS

SEQ ID NO: 10841 - protein, 260 aa, Mycobacterium tuberculosis CDC1551
MSGRLIGKVALVSGGARGMGASHVRAMVAEGAKVVFGDILDEEGKAVAAELADAARYVHLDVTQPAQWTAAVDTAVTAFGGLHVLVNNAGILNIGTIEDYALTEWQRILDVNLTGVFLGIRAVVKPMKEAGRGSIINISSIEGLAGTVACHGYTATKFAVRGLTKSTALELGPGGIRVNSIHPGLVKTPMTDWVPEDIFQTALGRAAEPVEVSNLVVYLASDESSYSTGAEFVVDGGTVAGLAHNDFGAVEVSSQPEWVT

SEQ ID NO: 10842 - protein, 229 aa, Mycobacterium tuberculosis CDC1551
MLTAMRGDIRAARERDPAAPTALEVIFCYPGVHAVWGHRLAHWLWQRGARLLARAAAEFTRILTGVDIHPGAVIGARVFIDHATGVVIGETAEVGDDVTIYHGVTLGGSGMVGGKRHPTVGDRVIIGAGAKVLGPIKIGEDSRIGANAVVVKPVPPSAVVVGVPGQVIGQSQPSPGGPFDWRLPDLVGASLDSLLTRVARLDALGGGPQAAGVIRPPEAGIWHGEDFSI

SEQ ID NO: 10843 - protein, 302 aa, Mycobacterium tuberculosis CDC1551
MELVSDSVLISDGGLATELEARGHDLSDPLWSARLLVDAPHAITAVHTAYFRAGAQIATTASYQASFEGFAARGIGHDDATVLLRRSVELAQAARDEVGVGGLSVAASVGPYGAALADGSEYRGCYGLSVAALMKWHLPRLEVLVDAGADMLALKTIPDIDEAEALVNLVRRLATPAWLSYTINGTRTRAGQPLTDAFAVAAGVPEIVAVGVNCCAPDDVLPAIAFAVAHTGKPVIVYPNSGEGWDGRRRAWVGPRRFSGSSGQLAREWVAAGARIVGGCCRVRPIDIAEIGRALTTAPPRG

SEQ ID NO: 10844 - protein, 363 aa, Mycobacterium tuberculosis CDC1551
MAERTVPETSWASRPADLYGRRSRDRFFTALWGVRALLGGLGAASRWEPSRVQPVRRTNPAVVTKRELVAPDVVALTLADPGGGLLPAWSPGGHIDVQLPSGRRRQYSLCGVPGRRTDYRIAIRRIADGGGGSIEMHEAFDVGDTCEFEGPRNAFHLGLAERDVLFVIGGIGVTPILPMIRAAEQRGIDWRAIYAGRGREYMPFLDEVVAVAPGRVTVWADDEHGRFASVDELLAGAGPTTAVYVCGPPGMLEAVRVARNQHADAPLHYERFSPPPVVDGVPFELELARSRRVLRVPANRSALDVMLDWDPTTAYSCQQGFCGTCKVRVLAGQVDRRGRIIEGDNEMLVCVSRAVSGRVVIDA

SEQ ID NO: 10845 - protein, 455 aa, Mycobacterium tuberculosis CDC1551
MSTTQLINPATEEVLASVDHADANAVDDAVQRARAAQRRWARLAPAQRAAGLRAFAAAVQAHLDELAALEVANSGHPIVSAEWEAGHVRDVLAFYAASPERLSGRQIPVAGGVDVTFNEPMGVVGVITPWNFPMVIASWAIAPALAAGNAVLVKPAELTPLTTMRLGELAVEAGLDEDLLQVLPGKGTVVGERFVTHPDIRKIVFTGSTEVGKRVMAGAAAQVKRVTLELGGKSANIVFHDCDLERAATTAPAGVFDNAGQDCCARSRILVQRSVYDRFMELLEPAVHSIVVGDPGSRATEMGPLVSRAHRDKVAGYVPDDAPVAFRGTAPAGRGFWFPPTVLTPKRGDRTVTDEIFGPVVVVLTFDDEADAISLANDTAYGLSGSIWTDDLSRALRVARAVESGNLSVNSHSSVRFNTPFGGFKQSGVGRELGPDAPLQFTETKNVFIAVGEEM

SEQ ID NO: 10846 - protein, 399 aa, Mycobacterium tuberculosis CDC1551
MVVLGSTGSIGTQALQVIADNPDRFEVVGLAAGGAHLDTLLRQRAQTGVTNIAVADEHAAQRVGDIPYHGSDAATRLVEQTEADVVLNALVGALGLRPTLAALKTGARLALANKESLVAGGSLVLRAARPGQIVPVDSEHSALAQCLRGGTPDEVAKLVLTASGGPFRGWSAADLEHVTPEQAGAHPTWSMGPMNTLNSASLVNKGLEVIETHLLFGIPYDRIDVVVHPQSIIHSMVTFIDGSTIAQASPPDMKLPISLALGWPRRVSGAAAACDFHTASSWEFEPLDTDVFPAVELARQAGVAGGCMTAVYNAANEEAAAAFLAGRIGFPAIVGIIADVLHAADQWAVEPATVDDVLDAQRWARERAQRAVSGMASVAIASTAKPGAAGRHASTLERS

SEQ ID NO: 10847 - protein, 500 aa, Mycobacterium tuberculosis CDC1551
MTTLWQPHRNDYSPIPGRGVHARRGARRPRPRGGRAERPGTGQLTRSGRRALLVGLTAASVGVLYGYDLSAIAGALLSLSEEFELTTREQELLTTTAVLGQIAGALGGGILANAIGRKKSVVLIVAGYAVFALLGATSVSVPMLVVARLLLGVTIGLSVVVVPVYVAESAPAAVRGSLVTAYQLATLSGIVVGYLVGYLLAGSHGWRAMFGLAAAPATLLLPLLWRMPIPPAGICSRAGSPTRVAAADPAGRDIDAELADMAAAVDERGGGIGEMVRRPYLRATLFVIALGFLVQITGINAIIYYSPRLFAAMGFAGYFAMLALPAMVQVAGLAAVCASLFLVDRLGRRPILLSGIATMITADAVLITVFANDSDGGTGLVLGFAGVLLFIIGFNFGFGSLVWVYAAESFPSRLRSMGSSLMLTSTLTANAIVAAFSLTMLRVLGGAGVFAVFGTFAVVAFVVVYRFAPETKGRKLEEIRHFWENGGRWPAERSPAADEP

SEQ ID NO: 10848 - protein, 293 aa, Mycobacterium tuberculosis CDC1551
MVQNGENLFQFRREGPQVQLSFQDRTYLVTGGGSGIGKGVAAGLVAAGAAVMIVGRNPDKLAAAVKDIEALKTGAIGYEPADITDEEQTLRVVDAATAWHGRLHGVVHCAGGSQTIGPITQIDSQAWRRTVDLNVNGTMYVLKHAARELVRGGGGSFVGISSIAASNTHRWFGAYGVTKSAVDHMMKLAADELGPSWVRVNSIRPGLIRTDLVVPVTESPELSADYRVCTPLPRVGEVEDVANLAMFLLSDAASWITGQVINVDGGHMLRRGPDFSPMLEPVFGADGLRGVVG

SEQ ID NO: 10849 - protein, 466 aa, Mycobacterium tuberculosis CDC1551
MSRTRVYAVPVPGSAQSAYACGVERLLASYRSIPATASIRLAKPTSNLFRARVKHDARGLDASGLTGVIGIDPEARTADVAGMCTYEDLIAATLHYGLSPLVVPQLRTITLGGAVTGLGIESASFRNGLPHESVLEMDILTGAGELLTVSPGQHSDLYRAFPNSYGTLGYSTRLRIQLEPVRPFVALRHIRFSSLTAMVAAMERIIDTGGLDGESVDYLDGVVFSADESYLCIGMQTSVPGPVSDYTGQDIYYRSIQHEAGIKEDRLTIHDYFWRWDTDWFWCSRSFGAQNPRLRRWWPRRYRRSSVYWRLMALDQRFGIADRFENSRGRPARERVVQDIEVPIERTCEFLEWFGENVPISPIWLCPLRLRDHAGWPLYPIRPDRSYVNIGFWSSVPVGATEGATNRKIENKVSALDGHKSLYSDSFYTREEFDELYGGETYNTVKKAYDPDSRLLDLYAKAVQRR

SEQ ID NO: 10850 - protein, 502 aa, Ictalurus punctatus
KLIDKYEPDLTAKQNKHMTKDGFLAYLTHLEGFIFNPAHINVYQDMRQPINHYFISSSHNNYLMQEQLKGASSTEGYIRALLKSCRCVELDCWDGPNGEPVIYHGHTLTSKVLFKDVIKAINEYAFKTSEYPVILSLENHCSVEQQKLMAHHMTSILGSALLTRPLGKEIRSSLPSPEELKGRILIKGKRLNKLEAAFNNNAEDADSVSEEDEAAEAKQGEQETKPKKKKMKLAKELSDLVIYCKSVHFNSFEHSREKQACYEMSSFKESKAKNLAEHSATEFIQHNMDKLSRIYPAGTRTDSSNYSPVTMWNAGCQIVALNFQTYGKEMDVNQGRFLPNGKCGYILKPEFMRNPDSRFDPNAPTEGRWFRKSILHVMVISAQQLPKLNKDKPKSIVDPFVKWEIFGVPGDQARAQTSYINNNGFNPAWNKTFKFPIHVPDLAIVRFVVEDYDAASHNDFIGQYTLPFTSIKNGYRHIPLLTKGGDVIPSAKLFVHIMFMDP

SEQ ID NO: 10851 - protein, 246 aa, Rattus norvegicus
MTMDKSELVQKAKLAEQAERYDDMAAAMKAVTEQGHELSNEERNLLSVAYKNVVGARRSSWRVISSIEQKTERNEKKQQMGKEYREKIEAELQDICSDVLELLDKYLILNATHAESKVFYLKMKGDYFRYLSEVASGDNKQTTVSNSQQAYQEAFEISKKEMQPTEPIRLGLALNFSVFYYEILNSPEKACSLAKTAFDEAIAELDTLNEESYKDSTLIMQLLRDNLTLWTSENQGDEGDAGEGEN

SEQ ID NO: 10852 - protein, 439 aa, Rattus norvegicus
YYGMRALLVLYFRNFLGWDDDLSTAIYHTSVALRYLTPILGALIADSWLGKFKTIVSLSIVYTIGQAVISVSSINDLTDHDHDGSPNNLPLHVALSMIGLGLIGLGTGGIKPCVSAFGGDQFGEGQEKQGNPVFSIFYLAINAGSLLSTIITPILRVQQCGIHSQQACYPLAFGVPAALMAVALIVFVLGSGMYKKFQPQGNIMGKVAKCIGFAIKNRFRHRSKAFPKREHWLDWAKEKYDERLISQIKMVTKVMFLYIPLPMSWALFDQQGSRWTLQATTMTGKIGTIEIQPDQMQTVNAILIVIMVPIVDAVVYPLLIAKCGFNYTSLKKMTVGMFLASMAFVVAAIVQVEIDKTLPVFPSGNQVQIKVLNIGNNDMAVYFPGKNVTVAQMSQTDTFMTFDVDQLTSINVSSPGSPGVTTVAHEFEPGHRHTLLVWG

SEQ ID NO: 10853 - protein, 480 aa, Homo sapiens
MAGYLSESDFVMVEEGFSTRDLLKELTLGASQATTDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREAPLPPPHIATCAASEPSPPAEENGSTSKTIVYHLDEGVYGIFNSVLFDNICPTPILQKKPSTEQPLYSSSLWGPAVDGCDCVAEGLWLPQLHVGDWLVFDNMGAYTVGMGSPFWGTQACHITYAMSRVAWEALRRQLMAAEQEDDVEGVCKPLSCGWEITDTLCVGPVFTPASIM

SEQ ID NO: 10854 - protein, 374 aa, Homo sapiens
MAGYLSESDFVMVEEGFSTRDLLKELTLGASQATTDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKFVQQRGTACLIRMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKSKNHSPCYMSLESIHFIAV

SEQ ID NO: 10855 - protein, 362 aa, Homo sapiens
MAGYLSESDFVMVEEGFSTRDLLKELTLGASQATTDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKSKNHSPCYMSLESIHFIAV

SEQ ID NO: 10856 - protein, 507 aa, Pseudomonas sp. KIE171
MSGDYMVQATTNLVGAAYWRGRADEIQFEGRCLIDGKMVEAQSGYTFDCVSPVDGRVLTKVSAGGEADVNRAVAAARSAFRDRRWSGQSPVSRKRTLQAFAALIRLHRDELALLETLDMGKPISASRSVDVEAVASCFEWYAEAIDKLYEQIAPTAETDLALITREPLGVVGAIVPWNFPMLTAAWKTAPALACGNSVVLKPAEQSPLTAIRLAQLALEAGVPEGVFNVVPGLGGSAGRALACHMDVDGIFFTGSTATGRLLTEYAAKSNLKRVCLELGGKSPNIILASYGDIEKAAVASAESMFNNQGEVCIAPSRLIVERSIHKRVVEIVAEVAKRRQPGDPLDPTTRMGALVDANHADRVMGFIGRAKADGATLVAGGTRALTETGGSYVVPTVFDNVSNCMEIARDEVFGPVLSVIPVANVGEAVAVANDSPYGLGAGVWTDRLSDAHKISRELRAGVVYVNCYNDCDITTPFGGVKQSGNGRDKSLYALDEYTELKTTWIKL

SEQ ID NO: 10857 - protein, 420 aa, Oryza sativa (indica cultivar-group)
MERVFSVEEISDPFWVPPPPPQSAAAAQQQGGGGVASGGGGGVAGGGGGGNAMNRCPSEWYFQKFLEEAVLDSPVPNPSPRAEAGGIRGAGGVVPVDVKQPQLSAAATTSAVVDPVEYNAMLKQKLEKDLAAVAMWRASGTVPPERPGAGSSLLNADVSHIGAPNSIGGNATPVQNMLSGPSGGSGSQLVQNVDVLVKQPTSSSSREQSDDDDMKGEAETTGTARPADQRLQRRKQSNRESARRSRSRKAAHLNELEAQVSQLRVENSSLLRRLADVNQKYNDAAVDNRVLKADVETLRAKKMAEDSVKRVTGMNALFPAASDMSSLSMPFNSSPSEATSDAAVPIQDDPNNYFATNNDIGGNNNYMPDIPSSAQEDEDFVNGALAAGKIGRPASLQRVASLEHLQKRMCGGPASSGSTS

SEQ ID NO: 10858 - protein, 96 aa, Mycobacterium avium subsp. paratuberculosis
IVLSEGRLLNLGNATGHPSFVMSNSFSNQVIAQIELWTKNDEYDNEVYRLPKHLDEKVARIHVEALGGELTKLTKEQAEYIGVDVDGPYKADHYRY

SEQ ID NO: 10859 - protein, 422 aa, Sphingomonas sp. ACM-3962
MSRWLPKTFRDHPAVLLLAATEMWEAFSYVGLRTVLVYYLTQDLGYSTEDASLIYGTFLGVAYVTPILGGWIADRFIGRSAAIVGGALLKMAGYIGLVIGANVTGCLAAIVIGNGLFLPTLPATLGALFSPNAPDRQRSFSFYYLAVSAGALLAPLICGTLGENFGWRYSFLASATGLAAAIVIFLAGRHLLPPDRPGAASHPVDKMPVAQASQSVIPLLAGVLAAVIVLRVAYEQLGNTVALFAASEVDRSLGADFTIPYTWFQSINPLGVILFTPLLVWGWRKAAARASSQNDYFRMAIGSSIMALAFVGLALVIQLGQPGQISWPVLAAFFLMVTFGELWVLPVGLSLFAPGARRTRCNHHRVLVQCACGWQFSCWIDGPREPALGYCNFFLLCAVFPLLAATIFVAIGRRSRRVIEAA

SEQ ID NO: 10860 - protein, 579 aa, Zea mays subsp. mays
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGSGQSADASPAAAGGTDQVMSEVYLGRQICNVVACEGAERTERHETLGQWRSRLGGSGFAPVHLGSNA

SEQ ID NO: 10861 - protein, 581 aa, Zea mays subsp. mays
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNA

SEQ ID NO: 10862 - protein, 578 aa, Zea mays subsp. mays
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGSGQSADASPAAAGGTDQVMSEVYLGRQICNVVACEGAERTERHETLGQWRSRLGGSGFAPVHLGSNA

SEQ ID NO: 10863 - protein, 579 aa, Zea mays subsp. mays
MKREYQDAGGSDGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQCRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGSGQSADASPAAAGGTDQVMSEVYLGRQICNVVACEGAERTERHETLGQWRSRLGGSGFAPVHLGSNA

SEQ ID NO: 10864 - protein, 581 aa, Zea mays subsp. mays
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHDSGTFLDRFTESLHYYSTMFDSLEGAGAGSGQSTDASPAAAGGTDQVMSEVYLGRQICNVVACEGAERTERHETLGQWRSRLGGSGFAPVHLGSNA

SEQ ID NO: 10865 - protein, 581 aa, Zea mays subsp. mays
MKREYQDAGGSGGDMGSSKDKMMAAAAVAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNA

SEQ ID NO: 10866 - protein, 581 aa, Zea mays subsp. mays
MKREYQDAGGSGGDMGSSKDKMMAAAAVAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVKQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNA

SEQ ID NO: 10867 - protein, 582 aa, Zea mays subsp. mays
MKREYQDAGGSGGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNA

SEQ ID NO: 10868 - protein, 581 aa, Zea mays subsp. mays
MKREYQDAGGSGGDMGSSKDKMMAAAAVAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEASHNSGTFLDRFTESLHYYSTMFDSLEGAGAGSGQSTDASPAAAGGTDQVMSEVYLGRQICNVVACEGAERTERHETLGQWRSRLGGSGFAPVHLGSNA

SEQ ID NO: 10869 - protein, 581 aa, Zea mays subsp. mays
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVKSEVYLGRQICNVVACEGAERTERHETLGQWRSRLGGSGFAPVHLGSNA

SEQ ID NO: 10870 - protein, 581 aa, Zea mays subsp. mays
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHHYSTMFDSLEGAGAGSGQSTDASPAAAGGTDQVMSEVYLGRQICNVVACEGAERTERHETLGQWRSRLGGSGFAPVHLGSNA

SEQ ID NO: 10871 - protein, 581 aa, Zea mays subsp. mays
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMSDSLEGAGAGSGQSTDASPAAAGGTDQVMSEVYLGRQICNVVACEGAERTERHETLGQWRSRLGGSGFAPVHLGSNA

SEQ ID NO: 10872 - protein, 581 aa, Zea mays subsp. mays
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRTVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNA

SEQ ID NO: 10873 - protein, 581 aa, Zea mays subsp. mays
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVHQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNA

SEQ ID NO: 10874 - protein, 581 aa, Zea mays subsp. mays
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLSSNA

SEQ ID NO: 10875 - protein, 581 aa, Zea mays subsp. mays
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDRSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNA

SEQ ID NO: 10876 - protein, 581 aa, Zea mays subsp. mays
MKREYQDAGGSGGDMGSSKDKMMAAAAGAGEQEEEDVDELLAALGYKVRSSDMADVAQKLEQLEMAMGMGGVGGAGATADDGFVSHLATDTVHYNPSDLSSWVESMLSELNAPPAPLPPATPAPRLASTSSTVTSGAAAGAGYFDLPPAVDSSSSTYALKPIPSPVAAPSADPSTDSAREPKRMRTGGGSTSSSSSSSSSMDGGRTRSSVVEAAPPATQASAAANGPAVPVVVVDTQEAGIRLVHALLACAEAVQQENFSAAEALVKQIPMLASSQGGAMRKVAAYFGEALARRVYRFRPPPDSSLLDAAFADLLHAHFYESCPYLKFAHFTANQAILEAFAGCRRVHVVDFGIKQGMQWPALLQALALRPGGPPSFRLTGVGPPQPDEIDALQQVGWKLAQFAHTIRVDFQYRGLVAATLADLEPFMLQPEGDDTDDEPEVIAVNSVFELHRLLAQPGALEKVLGTVRAVRPRIVTVVEQEANHNSGTFLDRFTESLHYYSTMFDSLEGAGAGSGQSTDASPAAAGGTDQVMSEVYLGRQICNVVACEGAERTERHETLGQWRSRLGGSGFAPVHLGSNA

SEQ ID NO: 10877 - protein, 198 aa, Capsella rubella
MASSSSPQAFLLLALSMVLVPFSLAQAPMMAPSGSMSMPPMPSGGGGSMIPPPAMTPPPMPMMTPPPMPMMTPPPMPMMTPPPMPMMTPPPMPMMTPPPMSMTPPPMPMMTPPPMSMTPPPMPMASPPMMSMGPSPSPLTVPGMASPPMPSGMESAASPGPMPPPMAASPDSGAFNVRNNVVAVSCVVGVVAAHLLLV

SEQ ID NO: 10878 - protein, 105 aa, Medicago sativa
IAPGLASIGMTPLLTAVYVGAMQNIFSKSAKYSLFDPCKEMAYIPLDEDTKVKGKAAIDVVCNPLGKSGGALIQQFMILTFGSLANSTPYLGGVLLVQNWTREKL

SEQ ID NO: 10879 - protein, 425 aa, Nostoc sp. PCC 7120; identical to SEQ ID NO: 874

SEQ ID NO: 10880 - protein, 435 aa, Ovis aries
FRLVEKKTGKVWAGKFFKAYSAKEKENIRQEISIMNCLHHPKLVQCVDAFEEKANIVMVLEIVSGGELFERIIDEDFELTERECIKYMKQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDIKNRLNCTQCLQHPWLTKNMEAKKLSKHRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGGEEEEEE

SEQ ID NO: 10881 - protein, 391 aa, Synechococcus sp.
MNVHLVAFLNEQEEIGMTQATNPVLDQTRNEGDIDYSALAEAQIKEGTDYVELTLPTKKSRKAKTSRRKETATKKKPYTEDSIRIYLQEIGRIRLLRAEEEIELARKIADLLELERMREQLTEHESRVPTDKEWAEAAGMPLKDFRRRLFHGRRAKDKMVQSNLRLVVSIAKKYMNRGLSFQDLIQEGSLGLIRAAEKFDHEKGYKFSTYATWWIRQAITRAIADQSRTIRLPVHLYETISRIKKTTKILSQELGRKPTEEEIAERMEMTIEKLRFIAKSAQLPISLETPIGKEEDSRLGDFIEADGETPEDQVSKSLLREDLENVLDTLSARERDVLRLRYGLDDGRMKTLEEIGQIFNVTRERIRQIEAKALRKLRHPNRNSILKEYIR

SEQ ID NO: 10882 - protein, 281 aa, Euglena gracilis
MDLDYEGQAPTTSLLLLFPPHLVPEYIGTISNNLRSAEVNHRPSKTFLEEVQVDITRLMRAILVDWMNEVTEEFRLKMETLCLAVNYVDRYLSRVPVPRHQLQLVGVASLLIASKMEEIMHPQIDEFVYITDSTYNREQVLRMELSILNALRYDMTVVTPRDFVGIYLKVAQASPEVCMLADYLLELILQEYAFLHWEPSMIAASAVVLALFGFRLPCWSDDLRRITQYQPNELNACLKEMHRVFQNAPHNNLQAVREKYSHGRFMHISMVAQLPPSPPVF

SEQ ID NO: 10883 - protein, 466 aa, Agrobacterium tumefaciens str. C58 (Cereon)
MSLEKDYIVADINLAAFGRKELDIAETEMPGLMSCRKEFGESKPLKGARITGSLHMTIQTGVLIETLKELGAEIRWASCNIFSTQDHAAAAIAAAGIPVFAVKGESLTEYWEYTDKIFQWTDGGLSNMILDDGGDATMYILLGARAEAGEDVLSNPGSEEEEILFAQINKRLKASPGWFTKQRDALKGVTEETTTGVHRLYDLAKKGLLPFPAINVNDSVTKSKFDNKYGCKESLVDGIRRATDVMMAGKVAVVCGYGDVGKGSAASLQGAGARVKVTEIDPICALQAAMDGFEVVRLEDVVSSADIFITTTGNKDVIRIEHMREMKDMAIVGNIGHFDNEIQVASLRNLKWTNIKPQVDMIEFPKGNRIILLSEGRLLNLGNATGHPSFVMSASFTNQVLGQIELFTKPGEYKNEVYVLPKHLDEKVARLHLEKLGVRLTELSDLQADYIGISKQGPFKAEHYRY

SEQ ID NO: 10884 - protein, 330 aa, Agrobacterium tumefaciens str. C58 (Cereon)
MTKFDVLTVGNAIVDIISRCDDRFLNDNAITKGAMNLIDAERAELLYSLMGPALEASGGSAGNTAAGVANFGGKAAYFGKVAEDQLGEIFQHDIRAQGVYFETKPEGTFPPTARSMIFVTEDGERSMNTYLGACVDLGPEDVEDDVVAKTKVTYFEGYLWDPPRAKDAIRECARIAHENGREVSMTLSDSFCVGRYRDEFLDLMRSGTVDIVFANKQEALSLYETEDFELALTKIAADCKIAAVTMSEEGAVILRGTERVKVEAYPVHDVVDTTGAGDLFAAGFLFGYTQDRSLEDCGKLGCLAAAAVIQQVGPRPMSSLKALGEKHGLI

SEQ ID NO: 10885 - protein, 287 aa, Agrobacterium tumefaciens str. C58 (Cereon)
MKKNMTYAADVLVTALAPAIWGTTYFVTTEFLPQGYPLHVAMLRALPAGILLLLLVRKLPQGIWWPRSFILGALNFSFFWAMLFVSAYRLPGGVAATVGAVQPLIVIGLSRLFLSTPVRPLAIGAGFLGIAGVALLVLTPGAALDGIGVAAGLAGAVSMAFGTVLTRKWRPPVSNLTFTAWQLTAGGILLLPVAYALEPALPAPTAVNVMGMAYLGLIGAALTYLLWFRGLARIEPSAAASLGFLSPVVATLLGWLALGQSLAPAQIAGFIAVLFSIWLSQRSQLPR

SEQ ID NO: 10886 - protein, 186 aa, Agrobacterium tumefaciens str. C58 (Cereon)
MSTEREKMAAGEWYSCMGAELDMLRWHSRRAVHQHNTMPPDERGTIGPLLRALFASVGEGAFIEAPFHCAYGFNITLGRNAYLNAGCTILDSAKVAIGDGAMLGPAVQIYCAEHHLDPVPRAQGIEIAKPVTIGRDVWIGGGAIILAGITIGDGAIVGAGSVVTRNVPARATVVGNPARPINRIAG

SEQ ID NO: 10887 - protein, 694 aa, Agrobacterium tumefaciens str. C58 (Cereon)
MGAFAAALIALAVPYAVTVVLACFFGAVLMGALFYALFGKSFPLPGTLPADYSDVRLRQTQNRSLIAEMQESMGDIVVIRNMNRRIVEANRVFREMTGCTSPEGLSCEEIGIAFRPGDRVHAYDVEIATPFGQRIFSWHDVVTRDLASSRLMISSIARDVTEERLALAEREDARLRAEKADAEKARLLATVSHEIRLPLSGMLGMNHLLSQTKLNQEQRNYLDGMKQSGQSLVQLVEDLLDYSTMEAGRFRLNPRAENLRRLIESIVEMLAHRAHEKGIEIASFVTPDVPDYLDFDPARLRQVLFNLIGNAVKFTQVGGVVIRARMVDGELQITVEDTGPGMSEAEQARIFGEFEQAGPLSQRSAGTGLGLAISARIVREFGGNLTVSSRRGEGSTFKLVFRPGRAPAEMPDSGRSHCLQHTNVLLIAPEGVAAAVTMEAIEAFGGKCILIHQPEDLDRLRNEPVSRTADLTDIIVDLRISALFRDALRDWPQQTIRRTLLVSPEERASTTHASFDAWLIRPLREKSLIDVLCGRLRGIERRDAINDNHPDVGFSSRVVERASGVEILVAEDDAVNARIIRAVLEKSGYIVRAVDNFQALQQSVASGASRLPNLIVSDLNMPGGEGLDVLPDLLGKLKDERNIPVIILSGDAGAGTAEILLKAGAGAVLAKPADPRRLVEEIRRLLEAKRVLSS

SEQ ID NO: 10888 - protein, 299 aa, Agrobacterium tumefaciens str. C58 (Cereon)
MITVFGSINMDLVATAKRLPKPGETVTGDTFSTAAGGKGANQALAARRAGVTVKMAGATGDDTFAAPALTLLRDAGTDLSLVKTAPGPTGTAVILIGEGGENMISVIPAANGEVSAFDATKVVGEMDAGDILMLQFEIPAAAIEAALTAAKAKRITTVINTAPLTADGPRLAGLADIVIANETEFELLIGKNGLSSGERESELKALHDRTGQTLIVTLGADGVIAMRNGKVFSASGLKIEPVDTVGAGDTFCGYLAASLDQGMDFEKALKRAAVAGSLACTRAGAQPSIPQAAEVDAAL

SEQ ID NO: 10889 - protein, 503 aa, Agrobacterium tumefaciens str. C58 (Cereon)
MVMARIIQTPTGLDALTFDDVLLQPGHSEVMPGQTNIATRIARDIDLNLPILSSAMDTVTEGRLAIAMAQAGGIGVIHRNLTPIEQAEEVRQVKKFESGMVVNPVTIGPDATLAEAQALMKAHGISGIPVVENGGAGGHKNGRLVGILTNRDVRFASDPQQKIYELMTRENLVTVKESSVDQQEARRLLHKHRIEKLLVVDGKGNCVGLITVKDIEKSQLNPNATKDAQGRLRAAAAISVGADAIERAERLIDAGVDLLVVDTAHGHSQRVLDAVAQVKKMSNSVRIIAGNVATADGTKALIDAGADAVKVGIGPGSICTTRIVAGVGVPQLAAVMAAVEAASLADIPVIADGGIKFSGDLAKAIAAGASAVMIGSLLAGTDESPGEVFLYQGRSFKAYRGMGSVGAMARGSADRYFQAEVRDTLKLVPEGIEGQVPYKGPVSGVLHQLAGGLKAAMGYVGGSNIKEFQERATFVRISSAGLRESHAHDVTITRESPNYPGAV

SEQ ID NO: 10890 - protein, 248 aa, Agrobacterium tumefaciens str. C58 (Cereon)
MKPLRLLSTDLDGTVVGDNDATRRFRDFWHALPDDLRPVLVFNSGRLIDDQLALLEEVPLPQPDYIIGGVGTMLHAKKRSELETAYTQSLGTGFDPRKIADVMNRIAGVTMQEERYQHGLKSSWFLHDADAAALGEIEAALLAADIDARIVYSSDRDLDILPKAADKGAALAWLCGQLRIGLDESVVSGDTGNDRAMFELKTIRGVIVGNALPELVSLAHQDNRFFHSTAKEADGVIEGLRHWGLNPR

SEQ ID NO: 10891 - protein, 454 aa, Agrobacterium tumefaciens str. C58 (Cereon)
MEKFTKMGPMTTTSETERYPRIALISTHGYVAAHPPLGAADTGGQVVYVLELARKLGQLGYTVDLYTRRFEDQPEFDEVDERVRVVRIPCGGRDFIPKEYLHRHLMEWCENALRFIKKNDLNYSFINSHYWDAGVAGQRLSEALKIPHLHTPHSLGIWKKRQMETDYPEKADTFELEFNFKERIQHELIIYRSCDMVIATTPVQLDVLIEDYGLKRKHIHMIPPGYDDNRFFPVSDATRQMIRQRFGFEGKVVLALGRLATNKGYDLLIDGFSVLAEREPEARLHLAVGGENMDEQETTILNQLKERVKSLGLEDKVAFSGYVADEDLPDIYRAADLFVLSSRYEPFGMTAIEAMASGTPTVVTIHGGLFRAISYGRHALFADPFDKEDLGITMMKPFKHERLYGRLSRMGAHKARSLFTWTGIAQQLLALVEGRTMMPVLEEADWAEPWNDGD

SEQ ID NO: 10892 - protein, 152 aa, Agrobacterium tumefaciens str. C58 (Cereon)
MAERTHFMELALVEARSAGERDEVPIGAVLVLDGRVIARSGNRTRELNDVTAHAEIAVIRMACEALGQERLPGADLYVTLEPCTMCAAAISFARIRRLYYGAQDPKGGAVESGVRFFSQPTCHHAPDVYSGLAESESAEILRQFFREKRLDD

SEQ ID NO: 10893 - protein, 390 aa, Agrobacterium tumefaciens str. C58 (Cereon)
MNMAEVSKNQVEKALETVIYPGSGKNIVALGMVSEIFIADAKAYFSITVPADKASEMEPLRLAAERAAKSVEGIAGAVVALTADRKPGQQQPAPAGPTPARPAAATGRPAAAPGRPTPQPGSSKVGVPGVRAIIAVASGKGGVGKSTTAVNLALGLQALGLKVGMLDADIYGPSLPRLLKISGRPKQQEDRIILPMENYGLKVMSMGFLVDEEAAMIWRGPMVQSALMQMLREVAWGELDVLVLDMPPGTGDAQLTIAQQVPLAGAVIVSTPQDLALLDARKGITMFRKVEVPLLGVIENMSYFIAPDTGARYDIFGHGGAKAEAERIGVPFLGEVPLTISIREMSDAGTPVVVAEPDGPQAAIYREIAEKVWARMGADERKAAPKIVFE

SEQ ID NO: 10894 - protein, 639 aa, Agrobacterium tumefaciens str. C58 (Cereon); identical to SEQ ID NO: 843

SEQ ID NO: 10895 - protein, 307 aa, Agrobacterium tumefaciens str. C58 (Cereon)
MSFFPGNDPVAGDAFACDAIENLIIPRTSDIGGFAVRRALPTRQRRLVGPFIFFDRMGPAILKAGEALDVKPHPHIGLSTVTYLFDGEIKHRDSLGTELVIRPGDINLMTAGRGIVHSERTPENLRGHPLSMSGLQTWLALPDHMEEIAPAFAHTAKEDMPLIDIKGASGRVVIGEFEGLTSPVSAFTDTLYVDLSLEPGVKFPFSADHEERAIYILSGSLDVAGDIFAADQLLVFRPGDDITLQAGSNGCHIMIFGGAALNQRRYIWWNFVSSSKERIEQAKQEWRTGRFDIVPGDEEEFVPLPEG

SEQ ID NO: 10896 - protein, 933 aa, Agrobacterium tumefaciens str. C58 (Cereon)
MRRSQHAGNAVDDRKMTTLLGGERGMKKWVYTFGNGAAEGGAGDVAILGGKGANLAEMASLGLPVPPGLTIIADACALYHKNGRDLPEELKLQVMAGLHGMEIVTGKTFGGSHSPLLISVRSGARASMPGMMDTVLNLGLNDRTVEALGHDAGDARFAWDSYRRFIQMYGDVVMGLDHEMFEEILEDEKGRLGHEYDTDMSAVEWQHVVSLYKKLIEDELGEAFPQDCHVQLWGAIGAVFASWTNHRAVTYRHLHNIPGDWGTAVNVQAMVFGNLGSSSATGVAFTRNPSTGEAELYGEFLVNAQGEDVVAGIRTPQSITEAARLVSGSDKPSMEKLMPEAFSEFLAICKRLETHYRDMQDLEFTIERGKLWMLQTRSGKRTTRAAMKIAVDMVEAGLISQEEAVCRIEPSSLDQLLHPTIDPGISRPIIGSGLPASPGAATGEIVFTSEEAVAAEAEGRRVILVRIETSPEDIHGMHAAEGILTTRGGMTSHAAVVARGMGIPCVTGAGSMRVDMRNKVLIGVGCMLKRGDVITIDGSSGRVLKGEVPMTQPELSGDFGKLMQWADNLRRMTVRTNADTPADARAARAFGAEGIGLCRTEHMFFEGDRIHVMREMILAESEKGRRAALDQLLPMQRSDFTELFQIMHGLPVTIRLLDPPLHEFLPKSDGEIVEVAAAMGMPQTVFRQRLDALHEFNPMLGHRGCRLAISYPEIAEMQARAIFEAAVAAARITGAPVVPEIMVPLVGLRSELDYVKAVIDTVAAEVAEETGMSIEYLTGTMIELPRAALRAHVIAEAAEFFSFGTNDLTQTTFGISRDDAARFINTYQRKGIIERDPFISLDFDGVGELIRIAAERGRQTRPELKLGICGEHGGDPASIHFCEDADLDYVSCSPFRVPIARLAAAQATLAAKAKQGETPSNVAFIPVRGSVGR

SEQ ID NO: 10897 - protein, 493 aa, Agrobacterium tumefaciens str. C58 (Cereon)
MTIATPLKAQPKASHFIDGDYVEDNTGTPFESIFPATGEMIAKLHAATPAIVERAIASAKRAQKEWAAMSPMARGRILKRAADIMRERNDALSTLETLDTGKPIQETIVADPTSGADAFEFFGGIAPSALNGDYIPLGGDFAYTKRVPLGVCVGIGAWNYPQQIACWKAAPALVAGNAMVFKPSENTPLGALKIAEILIEAGLPKGLFNVIQGDRDTGPLLVNHPDVAKVSLTGSVPTGRKVAAAAAGHLKHVTMELGGKSPMIVFDDADIESAVGGAMLGNFYSSGQVCSNGTRVFVQKKAKARFLENLKRRTEAMILGDPLDYATHLGPLVSKAQQEKVLSYIEKGKAEGATLITGGGIPNNVAGEGAYVQPTVFADVTDDMTIAREEIFGPVMCVLDFDDEDEVLARANATEFGLAGGVFTADLARAHRVVDGLEAGTLWINTYNLCPVEIPFGGSKQSGFGRENSAAALEHYSELKTVYVSTGKVDAPY

SEQ ID NO: 10898 - protein, 219 aa, Agrobacterium tumefaciens str. C58 (Cereon)
MLTIYGVYRSRATRTLWLAAELGIEFKHVPVIQARRLADPLATDAPLNTLSPAFLAVNPMGTIPCIEDDGMVLYESMAINLYLARKYGGPLAPVDLKEDAAMLQWSFFAATEIETNSLKISSAIAEGLAESDAGKAVIDVAARLLKRPLRVLEQHLATHDYLVGDRFTVADLNVAEIVRYAQGHQPLFDAHPALKAWLARCQARTAFKSMWDSRTAEAA

SEQ ID NO: 10899 - protein, 319 aa, Agrobacterium tumefaciens str. C58 (Cereon)
MRTIYRYDICLRLKPIAPTPVKERLLPLTGLFRRPCFQQTGETPMYDVSANGANIPALGFGTFRIPEDDVRRILPEALKLGFRHVDTAQIYKNEGAVGEVIAQSGISRHDIFLTTKVWVDRYRHDDFLASVDESLAKLKTDYFDLLLLHWPKSDVPLAERMGALNAVRKAGKARNIGISNFNVALTEEAVKLSDTPLATNQIEYHPYLDQTKVISAARKHGMSVTAYYLMADGKVPNDPVLKDIGAKHGKTAAQVTLRWAVQQPDIVALSKTATESRLKENFDIFDFALSEEEMQAIHALAKPNGRIVSPGHLAPDWDD

SEQ ID NO: 10900 - protein, 778 aa, Agrobacterium tumefaciens str. C58 (Cereon)
MTNVRRATAGDERPYAKFSDLAAWGERLSNDLMGLMNGSDRPMPQVETLLKRLIPILILAFLVVVAASRMLGIAAEYGRMEEAARHSTALTALTAKAALLNNDTIFTAQDRTRAEASLVAALPSGSLADGTMVLLSGSNGRIFAGAGKEASLYVGTSLPALLPEIAIVQRFPGTPGTIETNIDGQQHYATMIPFGDDGAMVIAARSLQPIRSFWRSEIAMNVTLFAGISSILLVVLYAYYMQVKRARDADDIFAESNLRVETALSRGRCGLWDFDLSSRRMFWSGSLYEILGLPPKAAPLSFSDAARMMHSEDGNLYELARAVGCGNLRQIDQIFRMRHSKGHYVWLRARAQVIRTNNGPRVIGIAMDVTEQHRLAQRYAEADQRLADAIESTSEAFVLWDKNDRLVMCNIHYQKAYGLPDSVLVAGTEKSTVYAAAARPVVERRVADPDQSGLSRTTEVQLADDRWLQINERRTRDGGLVSVGTDITLLKRHQERLRDSERRLMATIGDLSASQHKLERQKTELSDANANYLAEKERAQAANRAKSEFLANMSHELRTPLNAILGFSEILQNEMFGPVGSPKYSEYARDIHDSGKHLLNVINDILDMSKIEAGHMRINRETIDLAPLIEETLRLTAIQAEQKNITVQQKVCAGLTMQGDRRAMKQIMLNILSNAVKFTGDGGRIALRTHVHEAAMILTIADTGIGIPAQALQKIGQPFEQVQSQYAKSQGGSGLGLAISRSLVKLHGGTMKIRSCEGRGTVVTIIIPHAAGVCGTVH

SEQ ID NO: 10901 - protein, 445 aa, Agrobacterium tumefaciens str. C58 (Cereon)
MRKDWGDGPGGLGTAMQDKILLIEDSVALSMLLRTRLSDETEAEVVHCASMAEADALMQANNFTLALTGLNLPDAPKGEILTLLSERKVPAIVFTATVDEEARKRYAEKKIIDYIVKDGHRTVDAVVKTVDRIMTNKRFSVLVVDDARTARSGLVEILERQNFKVSEAHSGNRALEILSQDPSIQLVITDYHMPDMDGYELTRRIRDSRSSEDLRVIGISSSTDRLLSASFLKAGASDFVYRPFVPEELQCRIDNNIETLKQLKRLRELAERDHLTGLPNRRSFFERTRALMDVINDNDESGAVAILDIDHFKKINDTLGHDAGDRALKKLAELLQGMCDEQRHIPARLGGEEFAVFLRGLDARAAYAFCEELREQVEKNGRQLSGSSLALTISLGVVEIEKGEPFDNQLNAADQLLYLAKANGRNRVYSDIMIQEGLQKIGLNG

SEQ ID NO: 10902 - protein, 245 aa, Agrobacterium tumefaciens str. C58 (Cereon)
MLDLTGRKALVTGATGGIGEEIARLLHKQGATVGLHGTRVEKLEALAAELGDRVKIFPANLADRAEVKALGEKAEAELEGVDILVNNAGITKDGLFVRMSDEDWDNVIEVNLTAMFRLTRELTHPMMRRRFGRIINITSIVGVTGNPGQANYCASKAGMIGFSKSLAQEIATRNVTVNCVAPGFIESAMTGKLNDKQKDAIMGAIPMKRMGTGAEVASAVLYLASNEAAYMTGQTLHVNGGMAMI

SEQ ID NO: 10903 - protein, 256 aa, Agrobacterium tumefaciens str. C58 (Cereon)
MSNQIIFDLGGRTALVTGSSRGLGRAMAEGLAVAGARILINGTDPSRVAQTVQEFRNVGHDAEAVAFDVTSESEIIEAFARLDEQGIDVDILVNNAGIQFRKPMIELETADWQRVIDTNLTSAFMIGREAAKRMIPRGYGKIVNIGSLTSELARATVAPYTVAKGGIKMLTRAMAAEWAQYGIQANAIGPGYMLTDMNQALIDNPEFDAWVKARTPAKRWGKPQELVGTAVFLSASASDYVNGQIIYVDGGMLSVL

SEQ ID NO: 10904 - protein, 424 aa, Agrobacterium tumefaciens str. C58 (Cereon) [sequence omitted]

SEQ ID NO: 10905 - protein, 473 aa, Agrobacterium tumefaciens str. C58 (Cereon)
MPVEILMPALSPTMEEGTLSKWLKKEGDKVTSGDVIAEIETDKATMEVEAVDEGVIGKLLIDAGTEGVKVNTPIAVLIQEGESADDISSSAKKEEPKAEAANSGSDAAGGKTREAAEEPSAAKEAAKVPAAPKIEVAADPDIPEGTEMVMTTVREALRDAMAEEMRADEKVFVMGEEVAEYQGAYKITQGLLQEFGERRVIDTPITEHGFAGIGVGAAMTGLKPIVEFMTFNFAMQAIDQIVNSAAKTLYMSGGQMGAPMVFRGPSGAAARVGAQHSQCYAAWYSHIPGLKVVMPYTAADAKGLLKAAIRDPNPVIFLENEILYGQSFEVPKLDDFVLPIGKARIHRKGKDATIVSFGIGMTYAIKAVAELEKLGIDVELIDLRTIRPMDLPTVIESVKKTGRLVTVEEGFPQSSVGDFIANQVMRAAFDYLDAPILTIAGKDVPMPYAANLEKLALPNVDEVVQAVKTVCYK

SEQ ID NO: 10906 - protein, 209 aa, Agrobacterium tumefaciens str. C58 (Cereon)
MHCVFLEFNMSVFKKIYFALSAFIVAPHIFLLMSSRHDNPIFRDIEVWSEKLLGKKISGRSGLVASVVELLSLAPEFRNLFYYRVPRARFFKFLSRPENTLHIHTRTIGPGFFIQHGFATIISAESIGADCWINQQVTIGYVDSTGAPKIGDNVTINAGAKVLGNIVIGDNAKVGANAVVVKNIPADCVVVGVPARIIRRAGARVDEAL

SEQ ID NO: 10907 - protein, 287 aa, Agrobacterium tumefaciens str. C58 (Cereon)
MYKERPMQTRRPFMVARTEARQPEQLAIVDPIWGSLLNEARSAAAQDPLLSAFLYSTILNHRSLEECVIYRICELLDHPDMQAVLLRQTFQDMLEDWPEWGSVLRVDIQAVYDRDPACTRFMEPLLYFKGFQAIQTHRLAHWLLQKGRKDLALYLQSRSSSIFQTDINPAARIGKGIFLDHATGLVVGETAVIGDNVSILHGVTLGGTGKEGADRHPKIANGVMIGAGAKILGNIEIGSCSRIAAGSVVLKPVPPKTTVAGVPARVVGEAGCSEPSRLMDQLIGADI

SEQ ID NO: 10908 - protein, 321 aa, Agrobacterium tumefaciens str. C58 (Cereon)
MPVGRRHVHGRARWRRPRVRTAWLRTDRKRKDVDMAQQNAEHIADWRGQSGERWAAYQARLDAMMAPFGQAAIEAAAPTTGERVLDVGCGAGASSRDLAARVGAEGHVLGVDISEPLIERARALAPQDMSVVFRVTDASRAELPDGAFDILFSRFGVMFFNDPTGAFAHMRRALKPGGRAAFVCWRGVTENDWMRLPMGAMKGILPSMTPPGPEAPGPFSFGDQERVERILTKAGFTDIAIEPFDASVSFGEGATRDAALDDAVNMTLEVGPLSRVLADQPDDIRDRASVAVRAALSGCPGERSVMINGATWIVTARNPAS

SEQ ID NO: 10909 - protein, 304 aa, Agrobacterium tumefaciens str. C58 (Cereon)
MLAKVLLMILKNEPDMFSSHTIGDRGRMNFLGITGMQYSGVPFTNNRILLAEDSNVFTQMVSMRLNEMLGVSVEVCRSFEELQACYEHSPEPVTLAISNINLPGAEKGEALEYLIDLSIPTIVFTSTFHEATRETLIAKDVVDYILKDNIFAVDMLTESVCRFLTNHRHHVLIVDDSPTARALLSSRLKRYNFRVSLADSGAKALEILRANPDIGLVVTDYNMPDIDGFELTRRIRTVRGSHELRIIGVSSSTNRLLSARFLKAGGNDFMLRPFIDEEFYCRVNQNLDTLVQIQLAKAGIRPAA

SEQ ID NO: 10910 - protein, 375 aa, Agrobacterium tumefaciens str. C58 (Cereon)
MDVRAAVAIQAGKPLEVMTVQLEGPRAGEVLIEVKATGICHTDDFTLSGADPEGLFPAILGHEGAGIVVDVGPGVTSVKKGDHVIPLYTPECRECYSCTSRKTNLCTSIRATQGQGVMPDGTSRFSIGKDKIHHYMGCSTFSNFTVLPEIALAKINPDAPFDKVCYIGCGVTTGIGAVINTAKVEIGSTAIVFGLGGIGLNVLQGLRLAGADMIIGVDINNDRKAWGEKFGMTHFVNPKEVGDDIVPYLVNMTKRNGDLIGGADYTFDCTGNTKVMRQALEASHRGWGKSVIIGVAGAGQEISTRPFQLVTGRNWMGTAFGGARGRTDVPKIVDWYMEGKIQIDPMITHTMPLEDINKGFELMHKGESIRGVVVY

SEQ ID NO: 10911 - protein, 440 aa, Agrobacterium tumefaciens str. C58 (Cereon)
MARWITARWCANGRTMAPTDKSQNHGPALAAGLFDISENDLLIGGLSVRDIVAETGTPCFLYDNSAMRQAYRDLETALSGFADIYYSVKANPLPAIISLFREEGAGAEIASVGEYRAAVKAGVAPDNIIFAGPGKSMAELREVIEGGIGEIHIESAEEIARIEAINRPVKASIRINPVPDAQAGAMRMGGKATAFGFDEEELENVLKLFANVRHIDLVGIHIYGGTQILDADMLVSQWRHAIALAGRMAQMLGKPLETIDLGGGLGIPYFAGETSLDLAKVAAAIPDLKALLKAHPLIADAHVIVEPGRFLAGPGGLYVVEVNSVKTSRGTTFVVTDGGMHHHLAASGNLGQIVKRNYPIVAPAMMQAAHDETATIVGPLCTPLDTLARNATLPKLNAGDLLAILQSGAYGASASPGGFLSHTVAKEVLVEDGAFEVIGR

SEQ ID NO: 10912 - protein, 157 aa, Agrobacterium tumefaciens str. C58 (Cereon)
MHFVPESRASEVFSSRPLPIWHNTCILVAERELPALTGEAERYFLMKKIEAIIKPFKLDEVKEALQEVGLQGITVTEAKGFGRQKGHTELYRGAEYVVDFLPKVKVEVVLADENAEAVIEAIRNAAQTGRIGDGKIFVSNIEEVIRIRTGETGVDAI

SEQ ID NO: 10913 - protein, 321 aa, Agrobacterium tumefaciens str. C58 (Cereon)
MPLAGRGRFRRETPVDRLKFGHNKMALPHIFLALITVFLWGFNFVAIKVGVADMPPLFLTGVRYLFAAVPLVFFLPKPNVPWRHMIVYGMAMGFFQFGLLYPAIKLGLPAGLASLVMQSQAFFTLALAVVFLGERPLPSQIAGAIVAFGGLAVIGMERMTAAALIPLLMGVGSAIAWACGNIVNRRIGQVNVVSFIAWTSLVPVLPLVLLSLVVEGPDAIVEGLQNATPTMALVVIYMAYGATIVGAGIWSYLLLRYPAGTVAPFSLLVPIVGFISAYLAFAEHITIFEIIGAALVILGLALNVFGRRIGVSRFWVRSPQG

SEQ ID NO: 10914 - protein, 262 aa, Agrobacterium tumefaciens str. C58 (Cereon)
MSTITLNAPKLFDLSGQVALVTGAGSGIGQRIAMGLAQSGANVALLDRRTDDGLAQTADFIARAGRKSIQIAADVTSKQALTDAVARTQAELGALSLAVNAAGIANANPAEEMEESQFQTMMDINLKGVFLSCQAEANAMLKNGRGAIVNIASMSGVIVNRGLMQCHYNASKAGVIHMSKSMAMEWVGRGIRVNTISPGYTATPMNTRPEMVHQTKLFEEQTPMQRMAGVDEMVGPAIFLLSDAASFVTGVDLLVDGGFCCW

SEQ ID NO: 10915 - protein, 318 aa, Agrobacterium tumefaciens str. C58 (Cereon)
MNAPVTAAKLYDCRDAFAETLEALAAANDKVVAVCNDSVGSSKLGGFKSKFPERLVNVGIAEQNMVGVGAGLANGGQLPFVCGASCFLTGRALEQIKADLAYSNANVKLIGISSGMAYGELGPTHHSIEDFAWTRVLPNLPVIAPCDRIETAAAVKWAADYAGPCFLRLSRVGVPDLLPEGHVFELGRANLLREGSDLTLIANGTLTHRIVKAADILLSRGIKARVLNMATVRPIDEAAIIAAAKETGAILTAEEHSIFGGLGSAIAEVVVDHSPVPMKRLGVPGVFAHTGSAEWLLDEFGMAPTAIADAAQALIKRK

SEQ ID NO: 10916 - protein, 745 aa, Agrobacterium tumefaciens str. C58 (Cereon)
MQRERLEKVMSSHTPKLDSCGAEPIHIPGAIQEHGALLVLSAREFSVVQASDNLANYIGVDLPIGAVATEANLPFISVLSAWYSGEESNFRYAWAEKKLDVSAHRSGTLVILEVEKAGVGESAEKLMGELTSLAKYLNSAPSLEDALFRTAQLVSSISGHDRTLIYDFGLDWSGHVVAEAGSGALPSYLGLRFPAGDIPPQARQLYTINRLRMIPDVDYKPVPIRPEVNAETGAVLDMSFSQLRSVSPVHLEYMRNMGTAASMSVSIVVNGALWGLIACHHATPHSVSLAVREACDFAAQLLSMRIAMEQSSQDASRRVELGHIQARLLKGMAAAEKWVDGLLGGEGEREDLLKQVGADGAALVLGDDYELVGNTPSREQVEELILWLGEREIADVFATDNLAGNYPTAAAYASVASGIIAMRVSELHGSWLIWFRPEVIKTVRWGGDPHKTVQESGRIHPRKSFEIWKEQLRNTSFPWSEPELAAARELRGAIIGIVLRKTEEMADLTRELQRTNKELEAFSYSVSHDLRAPFRHIVGFAQLLRERSDALDEKSLHYLQMISEAALGAGRLVDDLLNFSQLGRTQLTLKPVDMQKVVSEVRRSLSHAVSDRQIEWRIGALPVIFGDPTLLRQVWYNLIENAIKYSSREPVSIITISAVETEDDVTYSVEDNGVGFDMAYYNKLFGVFQRLQRVEDFEGTGIGLALVRRIVERHHGLVGAEGTVGEGATFSFTLPVTKVEEEKIA

SEQ ID NO: 10917 - protein, 281 aa, Agrobacterium tumefaciens str. C58 (Cereon)
MHEDIPAVTLPSGNEVPALGLGTWNMGETRSSADDEIESIRKAIDLGMTLVDTAEMYADGRSEEVVGTAIAGRRDEVFLVSKVYPWNASARGTAEACERSLARLGTDHIDLYLLHWRGEHPLGETVAAFERLKSDGKIGNWGVSNFDTDDMEELFTVPEGKNCAANQVLYNLSRRGPEFSLLPWCQEHGVPLMAYSPIEQGRILKNHELIRIAKAYQATPAQLALAFLLDRDGVIAIPKSASVSRIVENRGATDLEITEEDWTALDAAFPPPTRKTSLEML

SEQ ID NO: 10918 - protein, 249 aa, Agrobacterium tumefaciens str. C58 (Cereon)
MKLLENKVAIITGASSGIGRATAMLFVTQGAAVVINARGEKALQEVAADIRDAGGRVHAVAGDAGVAETHSRLADAAVGVFGGLDIAINNAGAVGAMKPLAEISPEEWDHVLNVNLTSAFLGARYQIPPMLKRGGGSIVFTSSFVGTSAGIPGMSAYGTAKAALMGLVKGITADYAINGIRANALLPGGVDTPAAGDPAQKEWAAGLHAMKRIAQPEEIAQAALFLASPMASFVAGAALFADGGNAAVK

SEQ ID NO: 10919 - protein, 329 aa, Agrobacterium tumefaciens str. C58 (Cereon)
MDGSTPICDHVNIHTPWETKMAIQKQMDAREWAMLIALSLLWGGSFFFIGVAVKELPPVTIVTLRVSLAAVALLVVCRIMGLRLPREWAVWRAFFGMGLLNNIIPFCLIVWGQTQIASGLASILNATTPLFTVIVAHFLTADEKMTGNKLAGVLIGFVGVATMIGPAAFGGSSGLWGQIAILGAAISYSFAGIFGRRFKAMGVPPLMTATGQISSSTLMLIPAALLIDKPWTLAMPGLGTWGALIGIALLSTALAYLIFFRILASAGATNLALVTFLIPVSAILLGSLILGEQLEIKHFAGMAMIAAGLAAIDGRLPVKLRSLLRNAPA

SEQ ID NO: 10920 - protein, 684 aa, Agrobacterium tumefaciens str. C58 (Cereon)
MATKVKENEEAENERDGATDGPLLDLSDDAVKKMIKAAKKRGYVTMDELNSVLPSEEVTSEQIEDTMAMLSDMGINVIEDEDAEEAAPAEDDGDSDNEESEGGELAPSGGTALATAKKKEPTDRTDDPVRMYLREMGSVELLSREGEIAIAKRIEAGRETMISGLCESPLTFQALIIWRDELNEGTTLLREIIDLETTYSGPEAKAAPQFQSPEKIEADRKAAEEKEKTRRLRAPTGDEDVTDVGGDGLPPEEEEEDDDESNLSLAAMEAELRPQVMETLDTIADTYKKLRKLQDQQVEARLACTGTLSSGQERRYKELKDQLITAVKSLSLNQNRIDSLVEQLYDISKRLMQNEGRLLRLAESYGVKRDSFLEQYHGAELDPNWMKSITNLAARGWKEFAREESNTIREIRQEIQNLSTETGISIAEFRRIVSMVQKGEREARIAKKEMVEANLRLVISIAKKYTNRGLQFLDLIQEGNIGLMKAVDKFEYRRGYKFSTYATWWIRQAITRSIADQARTIRIPVHMIETINKIVRTSRQMLHEIGREPTPEELAEKLAMPLEKVRKVLKIAKEPISLETPVGDEEDSHLGDFIEDKNALLPIDAAIQANLRETTTRVLASLTPREERVLRMRFGIGMNTDHTLEEVGQQFSVTRERIRQIEAKALRKLKHPSRSRKLRSFLDS

SEQ ID NO: 10921 - protein, 465 aa, Agrobacterium tumefaciens str. C58 (Cereon)
MSSSVVAETVPSGSGSWFSHFKATLVLGIPLIGAQLAQLGIHTTDMVIVGQLGAEKLAAMVLAGQFFFVVFIFGSGFSVAVVPMVAQAYGQGDATSARRSLRMGMWVAIAYWLLALPIFFNAERILVYLGQNPNVAALTGHYLAIAKFGLLPALLFYVLRGLVSAIGRAGIILYVTIIMLVMNGLMAYVLVFGHFGLPAMGMNGAAVVAVIVNAFSFIFIVAYVQTREETKKYELFVRFWRPDWHALFEVLRLGLPISITILAEVTLFAAASILMGQIGTVQLAAHGIALQLASIAFMIPLGLSQAATVRVGVARGQGDFKNLIRASIMIYAIACGIALCGGILFAAVPEFLAKWFLDPKLPEAAEVLAYASSLVVIAGIFQLVDGIQAVTAGLLRGLKDARIPAMLALISYWPIGLALAWTMAFPLGFGGRGVWFGFVIGLSTAAVLLTVRFVLLVKREMKTAR

SEQ ID NO: 10922 - protein, 300 aa, Agrobacterium tumefaciens str. C58 (Cereon)
MTRVQANMLLLLAAAIWGGGFVAQSSAMSSIGPFWFVGLRFAIAAIAVLPFALMETRSLKSPPRRREIGSFILVGLALFGGATTQQVGLLTTTVTNSSFLTGLYVIFVPVIAVVLYRRHPHWVVWPCALMMLGGIFLLSGGAFETLTTGDILSIICAFFWAIQITLAGRFVSESGRPLALSFTQFAVCSLLSCMIGVVFEPISMAAIEASMMEILYVGLVSSGLAFVLQVIGQRYTTAPQAAIFLSSEALFGALMASIFLKETISSAGYVGCLIIFVAILIVELVPELTRKRQKTVAEAS

SEQ ID NO: 10923 - protein, 305 aa, Agrobacterium tumefaciens str. C58 (Cereon)
MGAAGFTTPPPFPEVAPEITPEITIASPPPLGITCLNMCEVMQKGESMHRTVIVTGSTSGIGLGIAQRFAREGANIVLNGFGDDDEIEKLRLLLEAESGGRVLYHPADMTKPDEIADLIQSSHEKLGSVDVLINNAGIQHIAPIEEFPTEKWDWIIAINLTSSFHTMRAAIPLMKKAGKGRIINISSAHGLVASPFKSAYVAAKHGIMGLTKTAALELAQTGVTVNAICPGYVLTPLVEKQIPEMAKVRGISEAAVKNDVMLELQATKQFVTVDDVAAAAIFLASDAASNITGTHISVDGGWTAQ

SEQ ID NO: 10924 - protein, 1243 aa, Agrobacterium tumefaciens str. C58 (Cereon)
MRRHPEIFDSTGMDCRGVEYRLTEGCGLLEKACRAVAALELPACIKDGELRYVVVNEAYGRVMGRAPSAFEGQTSLSLSGDIRDAEREDRERRSLVFATDEAIACHAALSAQSHMLRCERFIGDDGSLFLFEVFEEMPSAVSRKSAAVGGASDILFSSGVMDFIDAGIVVYDRDNQLVYCNARFAEFYSDLDIELKPGIRLEALMKTLYSSSVYRCAKNDGPSFEDWMQKQLHDFSLPYLERVEQFADGRWVRMVNKRLENGMLVGLRVDVTEFKAHETLLSTQIRETWLLRAALEQLPVGVFLRDQDRRLTYANAAYNTFLGGNLADHIGKTETEMFPQNGPRFRQENERILQTGEAIERTGNMPWRDGGAVPVITRLGRVATPDDEYYLVGSVTDVSLLQDREKALIAAQAEAEALHRQLQAVLRALPVGVLLLNADLVIEYVNPFFYQVWGEIGGEKSLVGKSYREFMEMNFDSGLYDYGDRPFDDVYEERVQRLLKADAFAPREVRSKSGKVTVISKTRLEGGKILSTYADVTDVRMRDAEISKARAELERVGEYMQGATRAMAQGLVLVEQGTIIMSNEAMARMFDVPPHLLEKGRNWAGFFAHCAGRGDFGTAAEAGETLRIWRENIAANRPFSWLVHVAGKSWLNLEATNSSGNYWLIIVTDVTEMKVREEELQRLLSRAEAADRAKSEFLANMSHEIRTPMNGVLGMAELLAKSKLDTRQKTFTDIIVKSGNALLTIINDILDFSKIEAGQMKLRSVPFDPAEAVEDVVSLLSSAALEKDIELIVRIDASVSGKVIGDAGRFRQIVTNIVGNAVKFTETGHVLVELSAQSAEASESIFSLRVEDSGIGIPVDKLETIFDKFSQVDGSATRRHEGTGLGLAITVGLVGLFDGKINVVSEVGRGSAFEVDIPFQVMERRRDVPLLSVAIDDIRVLVIDDNDVNRRILTEQLRSWGIDGHAVENGPSGIAVLQEAASLGFAIDAIILDYHMPVMNGLDVVERIRADKRFDDIAIVFLTSMDVVGDETLFTDLSVQAHLMKPARARLLRSTLFDVVRDVRLKRIRQHPLAQGTGGEKARPESRPAEKKQRAEAPATVPERSRPCLLDVLVAEDNDVNQIVFSQILQQAGLRFLIVGNGKRAVQAWEEYNPALILMDVSMPVMNGHQATQAIRAAEQAAGDSRHVPVIGVTAHTQEADRERCLEAGMDDYLSKPISPESLEDKIAQWLGENVLRRDAPGV

SEQ ID NO: 10925 - protein, 302 aa, Agrobacterium tumefaciens str. C58 (Cereon)
MTPQNTIARELLFLALLSTLWAASYTFIKIGVETIPPLTFIAARTLIAGLLLLVVIRLRGLRLPRDPATWRLFFVQACINSVLPFTLIAWAEQSIDAGLAVILNATTPIFTFLLTALVIRHETVSGRKLFGTIAGMTGVCLIIGVEALGGAGEAIWSQLAVLTAAFSYACAAIFSKNFKGLDPVMPAAGSLICGAVLLLPVSLIVDRPWTLSPSAASLTALVCLSVFSTALAFMIYFRLMQTLGSVGTTSQAYLRVPVGVAIGMVFLGEVPTSAMWVGLVCVIAGVLAMTLPSRRRPATQGG

SEQ ID NO: 10926 - protein, 354 aa, Agrobacterium tumefaciens str. C58 (Cereon)
MITKTPLTFHGEGDSALLTGPDHLPVRAWPQKEQFAASRPSGAIARGIVVRHRRCSMSLDRLAPAIFVFLWSTGWVTAKYAVYYTGPLTFLCLRYLLAGLLLWAICRFSGISWPKQRADVLRAILSGVFLHGIYLGMIWWAIGQGVPAAIGGIIAGLQPLMTAVAARFMIGERISPLQRAGLLLGFAGIAIAVLPKVMATGALGMSVPLYAVAVNVLGMVSVTYGTLYQKKYVHGGNIMAVATLQYVGALLVTVPFALLLEDGHVDWSLGLAATLGWSVGAISIGAVALLLYLIRRGQVSRAASLIYLVPPLAAVEAAVLFGETLTPAMIAGTVLAVTGVYLANRKPAASVAVR

SEQ ID NO: 10927 - protein, 306 aa, Agrobacterium tumefaciens str. C58 (Cereon)
MNMGTIRILDGGMSRELQRLGAELKQPEWSALALINAPDIVRQVHAEFIEAGADVVTTNSYALVPFHIGEERFQKDGASLIALSGQLAREAADASGRKVQVAGSLPPIFGSYEPQNFDATRVQDYLKVLVDNLAPSVDVWLGETLSLIAEGEAVRQAVAATDKPFWISFTLNDDAAAVAGGEPALRSGETVKAAAEWAAQSGAAALLFNCSKPEIMKAAVETASAVFADKGVSLEIGVYANAFEGEQGDSAANEGLHGTRTDLTDDVYSRFACSWADAGATMIGGCCGIGAAHIHTVATALRRAAA

SEQ ID NO: 10928 - protein, 256 aa, Agrobacterium tumefaciens str. C58 (Cereon)
MGILQKFSLENRTAIITGSGRGLGFEIAKGFAEAGAHVWLTGRNAETLQQAVDTLRKAGGKADYAAFDIADTAAGSALVRRIMDEAGHLDILVNNVGARDRRPLAEFTDDDVLELIRTDLTSSISLSRDAAEAMNANGYGRIITITSILGHIVRPGDAIYPVAKQGLTGLMRAIAVEYGARGITSNAIAPGMFATETNAALAENPDMVAFAKLRVPLERWGRPDEIAGAALFLASDAASFVNGHILTVDGGMSVRL

SEQ ID NO: 10929 - protein, 256 aa, Eimeria tenella
LRLLLKLLLLLLGQQKHWPERQQQQQPQPWLDRQQQQQQHNQQLQKQQWPEGQRQQLWPEQQQQQWPEQHQQAQQQQQWPQQQPQMQQEQWPQQQPQVQQQQQWPQQQHRRQHGQQQQCMNSQQQLQQCGQQQQQQLQQQWSEQQQQQQQQQWPEQPEQQQQQQWPEQQQQQWSDQNQQQQAQQWQAQQQQQWPQQQQQPQQQQQQQQQQDLGPDGVGIVVPYLGSSPADFEVQNLGVSVLPRIKLPLPKFDNDDG

SEQ ID NO: 10930 - protein, 300 aa, Agrobacterium tumefaciens str. C58 (Cereon)
MARNSLPTITAGEAGLNRYLDEIRKFPMLEPQEEYMLGKRYAEHGDRDAAHKLVTSHLRLVAKIAMGYRGYGLPIGEVVSEGNVGLMQAVKKFDPERGFRLATYAMWWIKASIQEYILRSWSLVKMGTTANQKRLFFNLRRLKGRIQAIDDGDLKPEHVKEIATKLQVSEEEVISMNRRLHGDASLNAPIKASEGESGQWQDWLVDDHESQEAVLIEQDELETRRRMLAKAMGVLNERERRIFEARRLAEDPVTLEELSSEFDISRERVRQIEVRAFEKVQEAVQKEALEAARALRVVDA

SEQ ID NO: 10931 - protein, 397 aa, Agrobacterium tumefaciens str. C58 (Cereon); identical to SEQ ID NO: 841

SEQ ID NO: 10932 - protein, 116 aa, Agrobacterium tumefaciens str. C58 (Cereon)
MGNQMKIVMAIIKPFKLDEVREALTGVGIQGLTVTEVKGYGRQKGHTEIYRGTEYAVSFLPKLKIEIAVPSDVVDKAVEAIASAAKTGQIGDGKIFVYSIEQAVRIRTGETNTEAL

SEQ ID NO: 10933 - protein, 245 aa, Agrobacterium tumefaciens str. C58 (Cereon)
MEADMSRVALISGGTSGIGAAIARALQAAGYRVAVNYAFTTDRAEAFQKETGIPAFQWDVRDYDACVDGITKVEETFGPVEVLVNNAGITRDAMFHKMSPQQWREVIDTNLTGVFNMTHPVWPGMRERGFGRIVNISSINGQKGQAGQVNYSASKAGDIGFTKALAQEGASRNITVNAICPGYIGTEMVRAIPEKVLAERIVPQIPVGRLGEPEEIARCVLFLVSDEAGFITGSTMTANGGQYFA

SEQ ID NO: 10934 - protein, 259 aa, Agrobacterium tumefaciens str. C58 (Cereon)
MTHEKTGTKGAVAITGGASGIGFSTAQLLMARGWQPWLLDLKREALDIACEKLGIDLWRGIVCDVADEASIEMAFAALTANGADHAVDLVAVVNSAGIGIDKLSVDTSVEEFRRIVDVNLVGSFAVARAAARYWLERDVAGSIVNISSVSGMCGNRGRSAYGASKGGVNLLTMVMANELGQSGIRVNAIAPGPVDTPLTQAVHTENVRDQWHSRVPMHRYGRTDEIASAVAFLVSDDASYINGQVLAVDGGFITAGLAV

SEQ ID NO: 10935 - protein, 253 aa, Agrobacterium tumefaciens str. C58 (Cereon)
MVSNMSTHYDLDGRVAVVTGATGGFGVAISQRLRDCGATVIHWDLPAAVKDGALGDLPHAGVDISDAKSIETAAIDLKQRFGRLDILVNNAGIVGNVAPLWEIPIEEFRRIIDINLFGSFLVCRALVPLMIETARTSRFGRIVNVASIQAKEGMHQAAAYSASKAGLVAMTKSLGKELATADILVNAITPAASMTAMSIDAPKERLDDILSRIPMRRFLEPAEVANMVAWLSSSECSFSTGAVFDLSGGRATY

SEQ ID NO: 10936 - protein, 264 aa, Agrobacterium tumefaciens str. C58 (Cereon)
MRSLKFNGSATLAVGFSGRLFMVQDFNGRTVVITAAGQGIGRATAERFISLGARVIATDINEQALSTLKGAETRVLNVLDGDGVEDFAADIGHADVLFNCAGFVHSGTILDCEEKDWDFSFDLNAKAMYRTCRAFLPGMLEKGKGAIVNMSSVASSVKGVPNRFAYTASKAAVVGLTKAIAADFVTKGIRCNAICPGTVDSPSLHDRLRATGNYEQALADFIARQPMGRIATPEEIAALVTYLASDEAGFTTGQIHVIDGGWTG

SEQ ID NO: 10937 - protein, 239 aa, Agrobacterium tumefaciens str. C58 (Cereon)
MRDGTGPLLIFDCDGVLVDSEPVSIAVLLDMLSHLGVTMGEEEAYERFLGRSVASMTTTLFEEYGVETDIDFLDHMRATLFERFRTELKPIDGIAETLDELLPLKRCVASSSQPERIRYSLGLTGLIDKFEPHVFSATMVRNGKPAPDLFLHAARSMGVEPRQCIVIEDSPAGIAAAKAAGMGVFAFTGGSHARFPAFREKIAGLGADAVFDAMPDLVQLVGSYVGRGGFDGQVERDAG

SEQ ID NO: 10938 - protein, 270 aa, Agrobacterium tumefaciens str. C58 (Cereon)
MRRVPFAPPAIPDRQSLGRYLWPQNNEDSMQFSGKSVIITGAGKGIGRACAQLMAARGAEVVAISRTQSDLDSLKSEIGGRSIRVDLADIAATRAAMAEAGPCDFLINSAGINVLESVLDMSDAGYEAVLGINLRAALVTCQEFARGRVANGGGGAIVNITSIAGHRGFQDHLCYAASKAGLEGATRVLAKELGPHGIRVNAVAPTITLTELAAEAWNDPEKSQPMMVRHPLNRFAEAEEVAQSIALLLSDDSKMISGAVLPVDGGFLAV

SEQ ID NO: 10939 - protein, 277 aa, Agrobacterium tumefaciens str. C58 (Cereon)
MHNVTANGATIPALGFGTFRIPGSDVLRIVPHALKVGFRHVDTAQIYGNEAEVGEAIANSGVARGDIFLTTKVWVENYGHDAFIKSVDESLKKLKTDYVDLLLLHWPNEAVSLAEQIGALNEVKEAGKVRHIGVSNFNTELMAESVKLSRAPIVTNQIEYHPYLSQDVVIAAARKAGMSVTGYFGMADGKVFNDPVLRDIGARHGKSVAQVVLRWLVQQEGVIALSKTVGEARVLENFAIFDFALSADEMAAIHALAVPGGRIVSPDGLAPVWDKAA

SEQ ID NO: 10940 - protein, 312 aa, Agrobacterium tumefaciens str. C58 (Cereon)
MPMALGHEAAGVVEALGEGVRDLEPGDHVVMVFMPSCGHCLPCAEGRPALCEPGAAANAAGRLLGGATRLNYHGEVVHHHLGVSAFAEYAVVSRNSLVKIDRDLPFVEAALFGCAVLTGVGAVVNTARVRTGSTAVVIGLGGVGLAAVLGARAAGASKIVAVDLSQEKLALASELGATAIVNGRDEDAVEQVRELTSGGADYAFEMAGSIRALENAFRMTKRGGTTVTAGLPPPGAALPLNVVQLVGEERTLKGSYIGTCVPLRDIPRFIALYRDGRLPVNRLLSGRLKLEDINEGFDRLHDGSAVRQVIEF

SEQ ID NO: 10941 - protein, 298 aa, Agrobacterium tumefaciens str. C58 (Cereon)
MTRLASSPPARYVPKTGAPALTSALKRMNVIGNIYLQECNVERLEETVGLNLFDLSGRRALITGSSQGIGFALAQGLSEAGAEVVLNGRDEAKLKAAAAGIKGARTLAFDATDHGAVREAIDRFEAEVGAIDILVNNAGMQHRTPLEDFPADAFERLLQTNIASVFHVGQATARHMISRGRGKIINIASVQTALARPGIAPYTATKGAVGNLTKGMATDWAKYGLQCNAIAPGYFDTPLNAALVADETFSAWLEKRTPAGRWGKVEELVGACIFLSSDASSFVNGHILYVDGGITASL

SEQ ID NO: 10942 - protein, 449 aa, Agrobacterium tumefaciens str. C58 (Cereon)
MFNRRQLLGVSAAMVSSAAWAKTSNSSLPEAALMETAATQAPVKPTTGPDYNPVVTINGWTLPFRMNNGVKEFHLVAEPVEREMAEGMTARLWGYNGQSPGPTIEAVEGDRVRIFVTNKLPEHTTIHWHGMILPSGMDGVGGLSQPHIPVGKTFVYEFDLVKSGTFMYHPHSDEMVQMAMGMMGFFVIHPKDPAFMPVDRDFVFLLNAFDINPGASVPKIMTMTDFNLWAWNSRVFPGIDPLVVSKNDRVRVRVGNLTMTNHPIHMHGYDFEVTCTDGGWVRPEARWPEVSIDIPVGAMRAYEFDAKYVGDWAIHCHKSHHTMNAMGHDVPTFIGVDKKTVTEKIRKIRPDYMPMGTAGMADMGAMEMEIPENTVPMMTGWGPHGPIEMGGMFSVVKVREGISAGDYTDPGWYENPPGTQAWEWTGELPDTQKNSDPKTQITPKPMKHG

SEQ ID NO: 10943 - protein, 511 aa, Agrobacterium tumefaciens str. C58 (Cereon)
MRREPIMHEPLTAAEYKAIASDLQFPANAFIDGAFRPAGSGKTFKTINPATGETLADISACDVSDVDYAVGKARAAFDDGRWRLLPPGERKAILLTFAKLLEQHRHELAVMESLDSGKPVSECQTVDIPDTIHTIRWHAELIDKLYDNTAPVGSNALALVVREPVGVVGCVLPWNFPLLMLAWKIGPALASGCSVIVKPAEETTLTTLRVAELAHEAGIPAGVFNVVPGGGKEVGEPIGMHMDVDMVAFTGSTPTGRRFLRYAADSNLKRIVLECGGKNPAVVLDDAEDLDLVAEQVVNGAFWNMGENCSASSRLIVHAKIKDELLQRIGAYMREWRMGDPLDPQNRVGALVSKAHFDKVHSFLEDVKAENLTIVHGGKTEKGIFIEPTVVDAVPPASRLFREEIFGPILSVTTFNTLAEAVALANDTNYGLAASVYTGSLRKAIKLSREIRAGVVTVNCFGEGDATTPFGGYKESGFGGRDKSIFAHDNYCELKTIWIDVSDRSVDETVR

SEQ ID NO: 10944 - protein, 248 aa, Agrobacterium tumefaciens str. C58 (Cereon)
MNRIDLDGQAAVVTGGAQGIGLAIARRLIESGAKVSLWDMSETAIEQACGVLGEGASGKVVDVTDFAGLARVHAEVEAETGPVSILVNSAGIAGSNATLEDYDIEEWRRVVEINLNGTFYVNKTVIPSMKARNYGRIVNISSVAGKEGNPKLSAYSAAKAGVIGLTKSLGKELAAHDIAVNAITPATARTRILETLTPEFIDYMLTRIPRGRFLEVEEAAAMVAWLVSRENSFTTASVFDLSGGRTTY

SEQ ID NO: 10945 - protein, 642 aa, Agrobacterium tumefaciens str. C58 (Cereon)
MTADVQSIRCGGRRGVKEAVDVESFYLLLLVATVLVLVAAFSSLIAFRFGAPLLLLFLVIGLAAGVDGLGIEFTNNPLAYMLGSLILAVILFDSGFGTSLQSFRLSAAPAVALATVGVILTSVFFAGAAALLLGLSWLEGLLLGAIVASTDAAAVFFLLRIGGIHIRDQVRSTLEVESGTNDPMAIFLTVALVEIVAKGQGLAGIDSGFLLLFIEEMGLGVIFGLLGGLMIATVVNRFAADRGLAPIFVLALALLVFSFTGAIGGSGFLAVYVAGIVAGNRRIFAKETIRRFHEGLTWLAQIIMFLMLGLLATPSQFPAIAIPAVLLALFLIFVARPLAVWLSLMPFNYTQQETSFVAWVGLRGAVSILLAIMPILGGLDDAQIYFNAAFIIVLVSLLVQGWTIKPVATRLGLIVPPRMGEVDKLEVDLPGTANHELISYRVAKGSAIMQGERIPRWAMPSLVVRDGKSIRYQYAGRLRENDLVYLFIAPNYTRLIDRLFASALPVADDDADFFGIFTISPSRPAKEMEAAYGPGLISPAEHAMTIAELIETRLAGKAGYADRVRLGPLVLIVRALDEQEAITGVGISLEPVEPAIGLPIFISFSDILRRARTHLAQRRQLRSADAGEGVSAPAKTVTENEA

SEQ ID NO: 10946 - protein, 248 aa, Agrobacterium tumefaciens str. C58 (Cereon)
MKRLEGKVAIVTGAGRGIGRATAKLLATEGAKVAVLSLTPANVDAVVADIEAAGGTALGIAIDVSDADAIKPAIDTVVATWGGIDILVNNAFDPSVVQSSVLDLSVEQLQRNFDTGPIAFLRMMQAAYPHLKTSGEGRIINFGSMAGVTGMVPYAPYNMAKEAIRALTRVAAREWGADKITVNNVLPIADTWGAAAANIPAPANALARHGSPEDDIAPVVLFLASKDAQFITGYSLTPDGGMIIDAGR

SEQ ID NO: 10947 - protein, 422 aa, Agrobacterium tumefaciens str. C58 (Cereon)
MNHFGYIDGVLHAENVPVPEIAKAVGTPFYVYSTATLERHYKVFSGAFADVDAMVCYAMKANSNQAVLKTLAKLGAGIDVVSGGELRRALAAGVPASRIMFSGVGKTVAEMDYALEAGIYCFNIESEPELEVLNLRAVKAGKRAHVSFRINPDVDARTHAKISTGKKENKFGISYERARAVYAHAATLPGIEVTGIDMHIGSQITELQPFEDAFRLLRELVEVLRTDGHAISHVDIGGGLGIPYRDDNNPPPLPDAYAHIVKNELKSLNCKIVTEPGRLIVGNAGILVTEVIYVKDGGDKTFVIVDGAMNDLIRPTLYEAYHGIRPVVQPSENAPRIKADIVGPVCETGDYLALDREMAAPQPGDLIAVSSAGAYGAVQAGTYNSRLLVPEVLVKGDRFHVIRPRGTYEELIALDSVPAWLD

SEQ ID NO: 10948 - protein, 246 aa, Agrobacterium tumefaciens str. C58 (Cereon)
MELKHKTALVTGACGGIGRAVVAALVAQGARVIAFDRDIEAVTALAKGFGSACDPVAVDLGDAAALQAVMRDIAGRFKVIDILVNNAGVLSPHKLAATTLEEWHRLMAVNLDAALLLTQAVVPAMKENRWGRLINISSYAWKSGGLTAGTAYSVSKSALVGLTYSSARELASFGITANAVAPAYVVSPMIMEQLSEEDRQRQLAAIPVGRFCQPEEVAHAVRFLASPLSGFMTGTVVDMNGGLQFG

SEQ ID NO: 10949 - protein, 337 aa, Agrobacterium tumefaciens str. C58 (Cereon)
MARMTMIEAVRSAMDVSMERSDDVVVFGEDVGYFGGVFRATQGLQGKYGKTRCFDAPISESGIVGTAIGMAAYGLRPCVEIQFADYMYPAYDQITQEAARIRYRSNGDFTCPIVLRMPTGGGIFGGQTHSQSPEALFTHVCGLKVVVPSNPYDAKGLLIASIEDPDPVMFLEPKRLYNGPFDGHHDRPVTPWSKHEMGEVPEGHYTIPIGKAEIRRPGNDVTVIAYGTMVHVALAAAEETGVDAEIIDLRSLLPLDLDTIVKSVSKTGRCVMVHEATLTSGFGAEVVSLVQEHCFYHLEAPVVRVAGWDTPYPHAQEWDYFPGPARVGRALVDVMEA

SEQ ID NO: 10950 - protein, 297 aa, Agrobacterium tumefaciens str. C58 (Cereon)
MQRIALSDKLELSRIVYGMWRIGDDADTSPAHVQAKIEACLAQGITTMDQADIYGGYTAEAILGGGLKAAPGLRDKIEIVTKCGIVAPAGRHSSARVKHYDTTAGHINVSVEASLRDMGTDHVDLLLIHRPDPLIDAEETGKALDALVASGKVKAVGVSNFRPWDFSLLQSAMSNRLVTNQIEMSLLATDTFTNGDLAYLQEKRVSPMAWSPLGGGSLFSGAYGGTMAALQRIGKEQGVDATAVAIAWLLRHPAKIVPVLGTNNLERIRTAADALRVTMDRQTWFELYTLAIGKEVA

SEQ ID NO: 10951 - protein, 512 aa, Agrobacterium tumefaciens str. C58 (Cereon); identical to SEQ ID NO: 776

SEQ ID NO: 10952 - protein, 247 aa, Agrobacterium tumefaciens str. C58 (Cereon)
MKNPFSLEGRKALVTGANTGLGQAIAVGLAAAGAEVVCAARRAPDETLDIIAKDGGNASALLIDFADPLAAKDSFTDAGFDILVNNAGIIRRADSVEFSELDWDEVMDVNLKALFFTTQAFAKELLAKGRSGKVVNIASLLSFQGGIRVPSYTAAKHGVAGLTKLLANEWAAKGINVNAIAPGYIETNNTEALRADAARNKAILERIPAGRWGHSEDIAGAAVFLSSAAADYVHGAILNVDGGWLAR

SEQ ID NO: 10953 - protein, 550 aa, Agrobacterium tumefaciens str. C58 (Cereon)
MEVPLLFPRTRHLMSVQAGLGTHMDGTHLFELVIAMFLAIIVLHYIAHRLGLPPSVALLAGGGTLAFVPGLPTISVNPELVLVIFLPPLLLDGAWSISVDRLKRHVFGIASLAIGAVLFTTVIVAVVVHFLMPSLPWAACAALGAIVSPPDAVSARAVLERIRIPRRLQILLEGESLLNDASGLVLFRFAVAAAAGGVFSTVDALGEFFFLAVGGAAVGAFVGLLWVKTVRHLGDEYLMIAATAVLSWAAYILAEQAQTSGVIATVTAGLIASWHQHTVLSAATRMRGTSFWNVLVFLMEAMVFILIGLSLRDVVERGGGFGSIASSMALPALAVLVTLVAARFVWIFASDLVIRLFHGLKLAHSKPLGPGAVTALGWAGMRGVVTLALALSLPEDFPGRDFILVMAFAVIMGTVLIQGTTLGRIIAWAGLGGIEPERAPMTMSEAEASMAQVQFTTVQGLAYDENGELIHPQLLKRYEHRLAASVKYAESTEKYSPLLHAHFDVVLKAVAAGRKELIRLRREGQIDDETLRELEHDLDLEELTAISAKA

SEQ ID NO: 10954 - protein, 241 aa, Rickettsia conorii
MSELTIVTGGTRGIGKATALELKNKGLTVVANFFSNYDTAKEIEEKYGIKTKRWNIANFEECRKAVKEIEEEFKKPVSILVNNAGITKDKMLHRTSYQDWNDVMNINLNSCFNMSSSVMEQIRNQDYGRIINISSINAQARQIGQTNYSAAKAGIISFTKALARETASKNITINCIAPGYIAIKMVGAVPEDVLVKIVNSIPKKRLGQPEEIARAVAFLVDENAGFITGETISINGGHNMI

SEQ ID NO: 10955 - protein, 498 aa, Rickettsia conorii
MNNPKNDNYLSELSKVIWPIERYENKKFLPMAFMMFCILLNYSTLRSIKDGFVVTDIGAEAISFLKTYIVLPSAVIAMVIYVKLCDILKQENVFYVITSFFLGYFALFAFVLYPYPDLVHPDPETIESWSVAYPNVKWFIRIVGKWSFASFYTMAELWGTMMLSLLFWQFANQITKTDEAKRFYSMFGLLANLALPVTSVIIGYCLHEKTQIVAEHLKFVPLFVIMITSSFLVILTYRWMNKNVLTDPRLYDPALVKEKKAKAKMSLIDSFKMIFTSKYVGYIALLLIAYGVSVNLVEGVWKSKVKELYPTKEAYTIYMGKFQFYQGWVAIAFMLIGSNILRKVSWLTAAMITPLMMLITGAAFFAFIFFDSVIAMHLTGILASGPLALAVMIGMIQNVLSKGVKYSLFDATKNMAYIPLDKDLRVKGQAAVEVIGGRFGKSGGAIIQSTFFILFPAFGFVEATPYFASIFFVIVILWIYAVKGLNKEYKVLVNKTEK

SEQ ID NO: 10956 - protein, 319 aa, Rickettsia conorii
MANLHQRQIIDKIQHITFKDGTFLNEVISDIIIKGNNIGFSIDISGKNKLEAEEIRLKAINKLNEISEVNKITIVFTESKPMEKKVQKPKHFVENVKKIILVASGKGGVGKSTISALIAQQLSLANYRVGIVDADIYGPSIPHIFGINEVPQTKDGRIIPVLAQSIEIISIGFFVKDHSAIIWRGPMASKTIYQLLSVTKWDNLDYLIIDMPPGTGDIHLSILENYHLDGVIIVTTPQKISEIDVIRSIDLYQKLNLPILGIIENMSYMLKNNSGGHLSQKYNIPLIAQMPITPQIAEACDKSLPLTNLLTLPLEKYLQ

SEQ ID NO: 10957 - protein, 497 aa, Rickettsia conorii
MNHNKYIVRLSFIILFLNIVINMMFYRYFMIKEMIVKQVALEHTKIVELYTDNIWNTHQNVISKLRKFDYLKLLQDQDFINFAKVTTQWFTNLNINISLYDLKGNKFITSNMLHMYSVDNYKDDSLVEIVTAKIDKFFLKSFTSKAPLRDAFEGITSHILLPRVVIENESDLTVEEASFVTSYIPVINNNLDFPVDAVFEINTNITSQWQNITSLEQKVFITFIIIFIIFCTIIISNTNYARQIIEEQLEINRNLKAQIVKVEKTSSSNTKFFTNISHELRTPLNAIIGFSEILMSERDAEKSKNYIKDINDAGKHLLSMINDILDLSKASADKLKVDSIDLDLNKLIRSSLILVKTRADQAEVALISRLPKEHVVIKADPKRLKQVFLNLLSNAVKFTNSGGSVTIALEKDELAKLVYIKVIDTGIGIEEKDIPKTLSAFGQIDSELSRKYEGTGLGLPLTKKLVELMNGKFDLQSKINEGTTITITFTYDCSIEI

SEQ ID NO: 10958 - protein, 326 aa, Rickettsia conorii
MQITVREALRDAMQEEMIRDDKVFVIGEEVAEYQGAYKVTQGLLEQFGPKRVIDTPITEYGFAGLAVGAAFAGLRPIVEFMTFNFAMQAFDHIVNSAAKTHYMSGGQVKCPIVFRGPNGAASRVAAQHSQNYTACYSHIPGLKVVAPYSAEDHKGLMLTAIRDDNPVVFLENEILYGHSFDVPKTIEPIPFGQAKILREGSSVTIVTFSIQVKLALDAANFVQNDNIDCEVIDLRTIKPLDTETIIESVKKTNRLVVVEEGWFFAGVGASIASIVMKEAFDYLDAPIEIVSGKDLPLPYAVNLETLALPSESDVIEAVKKVCYYSI

SEQ ID NO: 10959 - protein, 293 aa, Rickettsia conorii
MTNNINALAISSESGFYSYLQKINKIPSLTQEEELLLAKSYLEGNDLQAAHKLVTSHLKLVAKIASGYRTYGLPITELVSEGNIGLMQAVKKFNPELGFRLSTYAMWWIKAAIQEYILKSWSLVKMGTTAAQKKLFFSLNKVKHKITNLYSRAITTDDFVQIADELGVSVNEVSEMNTRISGPDLSLNNSINSDDAESGELIELLPETRPTPEAMAINKQNSTSKRQLLSNAMKILNDRELRILTERKLTDTPKTLDILSNEYNISKERIRQIENTAFEKIKKFILNHSREAA

SEQ ID NO: 10960 - protein, 507 aa, Rickettsia conorii
MDSVDSNFTIWNKARNSKFRHIVWPIRSYELTKFIPMALLMFFILLNQNLVRSIKDSFVVTLISSEVLSFIKLWGEMPMGILFVIFYSKLCNIMTTEQVFRIITGTFLFFFAIFGFILFPYREFFHPDPELIKHYITVLPHLKWFLIIWGQWSLVLFYIMGELWPVIVFTLLYWQLANKITKVEEAPRFYSFFTLFGQTNLLISGTVIIYFAKSEHFLLPLFSHLNDTNEILLKSFITVILISGLICLALHKLIDKSVVEADKNIKFKNQRMDILKLSLVDSAKVILTSRYLGFICLLVMSYSMSISLIEGLWMSKVKQLYPATKDFIAYHGKVFFWTGILTLVSAFLGSSLIRICGWFWGAIITPIMMFGAGVMFFSFTVFENHLGNIVNTLGYSAPLVVIVFIGGLWHVLSKSVKYSLFDATKEMVYIPLDSEMKTKGKAAVDVMGAKIGKSIGAIIQFISFSIFPNAIHNDIAGLLMFSFIIVCLLWLYGVKVLSKYYNKMIQR

SEQ ID NO: 10961 - protein, 338 aa, Rickettsia conorii
MKILNIMLSRDLGGIQQAFLDYSTALEMQKIEIINITSYKAKINSFLHKQSLKLPNIVPFDLLSVLIFKYIIHKTKPDIIIAHGNRAINFSKFAKSQNIKLIGIAHNYSLKGLRKCDFVIALTHHMKEFLLKNHFAESRICILPNMINIAKDFIPNKTYRKPVVIGVLARFVAKKGVDVFIKAIKILKEKKYDLHAVIGGSGEEKDNLIALAHKLNLQDQISFTGWVNDRDKFFKQIDIFCLPSLHEPFGIIVLEAMEASMPIVSTDTEGPTAILNDMQDGLICKAGSAEDLAAKIVYLIENPIKAKEFSKNAYLTLKQNYEIKVVSEKLQHILESFR

SEQ ID NO: 10962 - protein, 475 aa, Rickettsia conorii
MNLLKNITGKNYINGEFIEFGKQISVINPATLKEIATVPNLGLSEINSAINNTVTSFSLWSQSSFEARIAILRRWYNLVIENIEELSYILTLEQGKVLAESKKEILYGASFIDWYTYAIHNIHSTIKPGNSNTHKIVTQYEPVGPSAAITPWNFPNAMITRKVVPAIAAGCSVILKPSSLTPLSALVLAKFASDAGLPAGVFNVITGSSDIIGKAFCEDFRLRKLSFTGATNVGKILYQNAANTLKRLSLELGGNAPFIITADNNLEKVVSDLVIAKTRNSGQSCTSPNRIFIEESIYEKFIEILKAKFTKLKAGDGFDKESDIGPLINSAAIEKIQKLLADAQSKGAKLICGGKTVDNFIEPTIIIDCLDNMDIFRIEIFGPVVACYKFKDLDEVIEHANNTEYGLQGYVYSNNISVAQMIASKLDFGMVSINDPLPANAKAPFAGRKASGFGVEGSFEGIFEYLNTKYINLQN

SEQ ID NO: 10963 - protein, 511 aa, Rickettsia conorii
MTINPSNVENSSSKINSYFSKLTDYIWPIKRHEVSKFLFITLLMFCILFIQNLIRALKDSIVTTMIGAEIISFLKFWGVMPSAFLMTAIYVKLVNKMKAENIFYLIISIFLTFFALFAYVIFPNHEMLHFSPVTVQNLMASLPNLKWFIWLLSKWSFSLFYIIAELWPNVVFALLFWQFVNNITTVEESKRFYPLFGLLSQTGIYLAGQFLENLSNINDYVTNKFALQSSFHTLSIQIILTIVLILGIIAIKTFWLLNHKVLDKEHMALLRFKAKKKSMTIAESFQMLLSSRHIRLIATLLICYGIAINLVEGPWKAAATKIYKTPTEYAAFIGSYLSYTGVFTILFVVLGSNIVRRLGWFTAAVITPLIVFITGILFFAVNNFERFAGLIIANFILTDPALIAITIGAIQNVLSKSSKYTLFDSTKEMAYVPLDPEIKIKGKAAADVIGTKLGKSGSAFLQSLVFIILPSASYQSISTCLMIIFIITCLTWLWATKALNKEYKNSIKFSQ

SEQ ID NO: 10964 - protein, 501 aa, Rickettsia conorii
MLPPKIFFEKVKEIMWPIERKELKLFIPMALMMLCILFNFGALRSIKDSLVVPSMGAEIISFLKLWLVLPSCVIFTVLYVKLSNNLNFEYIFYIIVGSFLLFFLLFAYIIYPNQDIYHPNDEMINKLIASYPNFKWFIKIGSQWSYALMYIFAELWSAVVINLMFWQFANHIFDTSKAKRFYPVLGMVGNIGLIIAGSVLVFFSSGQDVIDSELLPDSFNSSAGNAIMLQPIMSIIVTAGIIAMLLFRIINRFILTDSINVLDAKKVTAKMKTKLSVIESIKLVIHSKYIGRIALLIICYGLLINIVEGPWKAKIKELHPNTIDYVNFMGRFNIWMGISCVTFMIIGSNILRRLGWLISALLTPIMLSITGLMFFIFIIFIEEIGECFGDFNLLYAAIIVGAIQNILSKSSKYSLFDSTKEMAYIPLSLELRTKGKAAVEVIGTKFGKSLGAFIQSLIFIIIPTATFDSIIIYLLITFIVMMSLWIWNVIKLNKEYVELCK

SEQ ID NO: 10965 - protein, 882 aa, Rickettsia conorii
MIYDMKKLIYYFGSNGSDGNASMKNILGNKGAGLAEMSNLKLPIPDGFTITTELCNYFYTHNNNFPKNFQSDLKKAITELEIITGKIFGSTSNPLLLSVRSGSKVSMPGMMDTILNLGMNNEVCNALADSCGDKRFALDSYKRFLEMYGSTVLSIPSDLFEQICEKHKMQADIHKDSDITVELLEKIIDDFKRLHIKYTKQLINDPYEQLESAIKAVLHSWMSNRAVIYRKINNISEDCGTAINIQAMVFGNLGKTSATGVAFTRSPSTGEKKLFGEFLINAQGEDIVSGTRTPMPIIANDSNSMQAMMPEVFKELSQIAQKLEEHYLDMQDIEFTIENNKLYILQTRTAKRTAIAAINIAVQMVEEKLISKEQALMRIDPESLNQLLHTRIDYSKGLTSIAEGLPASPGAATGIAVFSPYDAEKLSHHHKVILVRHDTSPEDINGMHVSSGIVTIRGGMTSHAAVVARGMGKPCVCGTSNLSIDEKKQILTAGDIVIKQGDIITIDGGSGKIFLGEMPLIQPTFSEESKLILDWADEISSLKVRANAETVNDALVSVKFGAQGIGLCRSEHMFFDKNKIPLVRDMIIAPDIERRKLAVQKLLPLQTEDFKALFRVMKDKPVNIRLLDPPLHEFLPTTEEDKKNLANSLNLPLSMINQRLHAMHEVNPMLGHRGCRLGICSPEIYQMQIEAIFTAIFELHKKEHIECNLELMIPLISNVGEIQKLKMDIYAVIEKLEQRYRYKFSFTLGTMIELPRAALGSKKIAKEVDYFSFGTNDLTQTTYGISRDDIASFLPYYLEEKIFESDPFTTLDEEGVGELIDIAIKRGKSSNANLKLGACGEHAGNPASIEFFHRMNLNYVSCSPYRIPIARIAAAQAKIKHG

SEQ ID NO: 10966 - protein, 499 aa, Rickettsia conorii
MLSTSSRSFKNKFRAAFWPVHNYELGKFIPMSTLMFCILFNQNVLRILKDSILISEISAEIAGFAKVYCVTPAAALFVIIYAKMINYLTFEKIFYYLSAFFISFFVLFTFVIYPNIHIFHVHPNNLADWMERYPHFKWYISLVGNWGYIVYYSLAELWPNIFYVLLFWQFANELTTTEEAKRFYTLFSLFGNSSLILVGFLMMNLSSEDTIIKKFMSISDSKITLVQVSTTIVAIVAIICCLLVRFISKNVFTNPLFYAKAKSGRSTSERMGLIKSFKYIAKSKYLWLLLICSAAFGFAINLVEAVWKAKIKELYPTVNTYAEFNSLYILWTGVAIMVMTIIGNNIMRMHNWFVAAVISPVIIMVTGILFFVLIVFDQQILSLFDGAILMSPLALAVSIGGIQNILAKGTKYSIWDTSREMLYIPLDEELKTKGKAAVDVISAKVGKSSSGLVQSIIFTLVPTATFTLISPILMVVFTFVCLAWIYAVRKIYCEYQKIA

SEQ ID NO: 10967 - protein, 248 aa, Rickettsia conorii
MIKRRKKMIDLTGKTSLITGASGGIGGAIARLLHKLGSHVIISGSNEEKLQSLGKVVKDNYTIEVCNLADKEECRNLISKASKLDILVCNAGITSDTLAIRMKDEDFDKVIDINLKANFILNREAIKKMIQNRYGRIINISSIVGISGNPGQANYCASKAGLIGMTKSLSYEVATRGITVNTVAPGFIKSDMTDKLNEKQREAIVQKIPLGTYGMPEDVAHAVAFLASDQASYITGQTIHVNGGMLMV

SEQ ID NO: 10968 - protein, 168 aa, Rickettsia conorii
MNILLDKEANFNNFFMEQALKQAKIAFDKNEVPVGAVVVDRLHQKIIASTHNNTEEKNNALYHAEIIAINEACNLISSKNLNDYDIYVTLEPCAMCAAAIAHSRLKRLFYGASDSKHGVVESNLRYFNSSACFHRPEIYSGILAEDSGLLMKEFFKRIRTVISSHRMT

SEQ ID NO: 10969 - protein, 634 aa, Rickettsia conorii
MSNSNIDNDLDKIDSLLKKAKSKKIPVTYDDINNALPLNKNPSIRQLEEAILKFSDAGVDILESNEDDEIKLDIGMDEEFKLSTNVDNEPEDEVEEENIGTTDDPVRLYLKDMGGVDLLTREHEVEIAKRIEEGHKTMIASLCRSPIAMRCFIVWYEDLVNEKMLLRDLIDLEANMLHDETPENDEENSSETEGEEHEDNHLSMSRVETQILPNIIERMKKIAFICEELLIEAKKCYEKSFEPKVLQNSKKYNNLELLINEVSEIHFNSKRTEEILGKMYGINRDLINKETAFLKLAEKYGVTRQNFLDEYIGSVINAAWKEKMLKNKKVAWKELMTKESDYIDQMIAELSVIESKTGLLVNDFKKLVNTIQKSERQTLQAKKDMIEANLRLVISIAKKYANRGLQFLDLIQEGNIGLMKAVDKFEYRRGYKFSTYATWWIRQAITRAIADQARTIRIPVHMIETINKILRTSRQMLNELGYEPTATEIANRLSMPLDKVRKVMKIAKEPISLENPVGDDSDGGQLGDFIEDKNAVAPIDAAIQSNLREVTTRVLATLTPREERVLRMRFGIGMNTDHTLEEVGQQFKVTRERIRQIESKALRKLQHPIRSKKLNSFRSGGKRGDGNSSDLLEA

SEQ ID NO: 10970 - protein, 200 aa, Clostridium acetobutylicum
MNNLIVFAHPNPNSFGKGILDEVVKASEESGAAVRIRDLYQLGFDPILKPADFETFQRGEVPQDIKDEQENVKWANMITFIYPVWWAGLPAMLKGYVDRVYSYGFAYEYVDGQPRGLLTGKKALIFCTTGTPSDVYGANGMHNSMKQTTDEGIFKFCGIEEVRHNFFGAVPHVSDEIRKDYLRAASEIVKEHISSSKSFV

SEQ ID NO: 10971 - protein, 303 aa, Clostridium acetobutylicum
MKSKTIKSNIILLITALIWGLAFTAQSVGMKYVGPFTFNGIRFILGAICIVPVMLFFKEDKIEENSKYARAALVGGIICGMVNFLGTTLQQIGLMYTTVGKAGFITGLYIVIVPIIGIFLKHHMGINSWIGVLFALVGLYLLCNTGSFSVGYGETLELSGAFFFAVQIFIIDHFSKKANCYRLAFFQYVTCGAVSLIIALFTEKITFNALYGAAIPILYGGLGSVGIAYTLQIIGQKNAKPSHAAIIMSMESVFGALGGAIILGERMGAKNLIGCGLMLLGMLVAQIKLTKTSKKQIIEKKAV

SEQ ID NO: 10972 - protein, 147 aa, Clostridium acetobutylicum
MKNEFLNEAIKEAKLAKKEGEVPVGAVIVKDNKIIATSHNLKESLKNPSAHAEIIAIERAAKYLNNWRLNGCEMYVTLEPCPMCAACICQSRISKVYVGTFDPISGACGSVVNITENDYLRYHTEVEWLYSNECSDILKGFFKARRV

SEQ ID NO: 10973 - protein, 108 aa, Clostridium acetobutylicum
MLMIKAILRPQKVTNVLSELSDAGFPAVTKFSVVGRGKQRGVKVGDIYYDEIPKEMLLIVVNDEDKDDVVNIIAKNAKTGEKGAFGDGKIFIVPVEQAYTISSGKAGL

SEQ ID NO: 10974 - protein, 125 aa, Clostridium acetobutylicum
MKEIMAIIRMNMVEKTKEALLKGGNPAITCLKVLGRGRQKVDFSMIEDYIPNLMDQKMAEELSEIHRLISKRLIIILAKDEDVKEIVDEIIEVNRTGNPGDGKIFVINIADAMRIRTEETGDMAI

SEQ ID NO: 10975 - protein, 260 aa, Clostridium acetobutylicum
MNFSIQDFSMDFFSLKGKVAIVTGGNTGLGQGYALALAKAGADLFIVTHGTNWDETRKLIEDEGRKVEFYKADLSKKESIPGIFDKCMELYGRLDILVNNAGTIRRAPITEYRDEDWEYIINTNLNSIYHLSQRAAKIMIKQGSGKIINIASMLSFQGGKFVPPYTASKHGVAGLTKAFANELADKNIQINAIAPGYIVTKNTEAIRNDESRNNEILSRIPAGKWGYPFDVMGTVVFLASRASDYINGHILAVDGGWLVR

SEQ ID NO: 10976 - protein, 1212 aa, Clostridium acetobutylicum
MNSSLKNLLNNKILVLDGAMGTCIQSFNLDEGDFKGSLSCTCHSNQKGNNDVLNLTKPEIIKEIHKRYLEAGADIIETNTFNATEISQKDYNMQDKIYDINFKGAKLAKEACTYYTKLNPNKPRFAAGSIGPTNRTASLSPDVENPGFRNVTFDELCNAYKHQIEALIDGGVDLLLIETIFDTLNARAAIFAAETVFENKKIKLPIIISGTIADKSGRILSGQTLDAFAESLKNENIIAIGLNCSFGAEELIPFIKRLSETQNRYISFHPNAGLPNSLGEYEELPEETASIVKKLALEGHLNIVGGCCGTTPEHIRAISSVVKGISPRKVPNLEPKTIYSGLENIKIDKNSNFINIGERTNVAGSRKFARLIREKNYEEALTIARHQVENGAQIIDINFDDALLDARSEMETFLRLIASEPEISKVPVMIDSSNFEVLKVGLKSIQGKAIVNSISLKVGEEKFIEEAKFIKNFGAGVVVMAFDEEGQAATYERKIEICKRAYTILTEKVEFPPENIIFDPNILSIATGIEEHDNYAVNYIKAVKWIKENLPYAKVSGGVSNLSFSFRGNDAIRRAMHSVFLYHAINAGMDMGIVNPAMIDLYDDIDKDLLEKVENVVLNKSSNASESLLEFAQTYKKTTETLEKHEDEWRQKSPSERLSYALVKGNVEFIEEDIEEARKEYTNALEIIEVPLMNGMKKVGKLFGEGKMFLPQVVKSARVMKKAVECLLPYINEEKSKNHNKSAGKVVFATVKGDVHDIGKNIVSVVLSCNNFEVIDLGVMVPPETILETAKRENADIIALSGLITPSLNEMAYVAEEMKRLNFDIPLMVGGAATSKTHTALKLATKYKYVVHSTDASDAVTVAKNLMSENKFTFLEKLNEEYSKIRETFSTNKIELISIQNARKNRFTIDWNKTKITEPKFVGIKKLQAVPINELRKYIDWTFFFTSWDMGMNYPKIMKDPKYGAEAQKLFKDANEMLDLLQKENLITCNGVFGIFPANSVNDDIEIYTDKGTVTINTLRQQQILKDSDYKALSDYIAPKGIGIKDYIGGFIVTAGIGAKEYSDKLKKKCDDYGATMLKLICDRLAEAFSELLHLRVRKEYWGYSQDENLSLEKLLKGSYRGIKPAIGYPSIPDHSEKAKLFDLLLGKTSIGVELTESYMMNPTSSVCGLYFANERAKYFNINKIGKDQLEDYAVRSNKDINEIKKLLDTLL

SEQ ID NO: 10977 - protein, 431 aa, Clostridium acetobutylicum
MKLFGSMHEENNELYIGGISSKELAKKYGTPLYVIDEKLVRQNCKEYYENFKVKEKKNRVAYAGKAFLPIAMCQIIKEEGLSLDVVSGGELYTAYKAGFNMENVLFHGNNKTIDEMEMGVRLNVGRFVADNFYEIEKVNEIAKKMGKVQKVFLRITPGIEAHTHEYIKTGQIDSKFGFTLSNGDALKAVKEVLNFQNVELSGLHCHIGSQIFDIAPYLEETRVMLAFIKEIQKETNYEIKELDLGGGFGIYYTEVDKPRGAEEFCSAILKEAEESSKKLGVKLPKLIIEPGRSIIGNAGSTLYTVGSIKEIQHMRKYVSVDGGMTDNIRPSLYNAEYECEIANKFNASKEKVTISGKCCESGDILINDVNISEVESGDILVVSTTGAYGYSMSNNYNKIPKAAVVLVSDGKERLICKRETYEHMLSNEIMI

SEQ ID NO: 10978 - protein, 121 aa, Clostridium acetobutylicum
MDYKMSKVDIVTRPEKFDELKSELNKIGVTGMTVTNVLGCGLQKGTLEYYRGNPVEITLNPKIKVEIVVCSVPVEKVVETAKNVLNTGKIGDGKIFVYDVSKVVKIRTGEEDYDALQDDKE

SEQ ID NO: 10979 - protein, 186 aa, Clostridium acetobutylicum
MFKSIRYDINRVLQNDPAARNGLEVFLLYPCIHALIWYRIAHVFYKHKMFFIARLLSQIVRAFTGIEIHPGATIGKGLFIDHGMGVVIGETAEIGDNVVMYHGSTLGGTGKETGKRHPTVGNNVFIGSGAKVLGPIKLGDGCKIGANAVVLKDVPSNSTAVGIPAKVILPSSKKEKVIDFNDYCNK

SEQ ID NO: 10980 - protein, 431 aa, Clostridium acetobutylicum [sequence omitted]

SEQ ID NO: 10981 - protein, 466 aa, Clostridium acetobutylicum
MKILMLSWEYPPKNVGGLSNHVYNLSHALASLGHEVYVVTCEEKTAPVEENDDGVYVHRVTPYKIDTEDFTKWVMHLNFSMIEECTRLMKKIGKVDMIHVHDWLCVYCGKVLKWSYKIPMVCTIHATEKGRNNGIRTEMQRYISSAEWLLTYESWKIVACSGYMKAQIVDTFNTPEEKVWIIPNGIDLNSFDFDFDWLKFRRKYACDDEKIVFFIGRHVFEKGIQILIDAAPGIVSEYNKTKFIIAGTGPMTEELKDKVKSIGLQDKFLFTGYMDNKTKKKFYRVASVAVFPSLYEPFGIVLLEAMAAGCPAVVSDTGGFGEIIQHRSNGMKMINSSVESLKDNVLEILKNDSLAQTVRRNAIKTVEDKYTWQRVSKLTTEMYELIKEEARYTEWDQGSNKLKEDKLKKNKEKTKVKVKNSLKDENTEETNIKKSSRVKGISSDVTKVILTEAATKELLGEVESKE

SEQ ID NO: 10982 - protein, 324 aa, Clostridium acetobutylicum
MFDNDISMSLVRVTEAAALQSSKYMGRGDKIGADQAAVDGMEKAFSFMPVRGQVVIGEGELDEAPMLYIGQKLGMGKDYMPEMDIAVDPLDGTILISKGLPNAIAVIAMGPKGSLLHAPDMYMKKIVVGPGAKGAIDINKSPEENILNVAKALNKDISELTVIVQERERHDYIVKAAIEVGARVKLFGEGDVAAALACGFEDTGIDILMGIGGAPEGVIAAAAIKCMGGEMQAQLIPHTQEEIDRCHKMGIDDVNKIFMIDDLVKSDNVFFAATAITECDLLKGIVFSKNERAKTHSILMRSKTGTIRFVEAIHDLNKSKLVVE

SEQ ID NO: 10983 - protein, 378 aa, Clostridium acetobutylicum
MKNKTEVKNGGEKKNSKKVSKEESAKEKNEKMKIVKNLIDKGKKSGSLTYKEIMDELQEVDLGPEQIEKIYEVLESVGVDVVGDMHEIEVEEEDLDLTIPEGIAIDDPVRMYLKEIGKVPLLSPEEEIDLAQRIKNGDRSARKKLAEANLRLVVSIAKRYVGRGMLFLDLIQEGNLGLIKAVEKFDFKKGFKFSTYATWWIRQAITRAIADQARTIRIPVHMVETINKLIRVSRQLLQELGREPQPEEIAKIMDMPVDKVREIMKIAQEPVSLETPIGEEEDSHLGDFIPDDEAPAPADAAAFRMLKEQLLKILNTLTPREEKVLRLRFGLDDGRARTLEEVGKEFNVTRERIRQIEAKALRKLRHPSRSKKLKDYLD

SEQ ID NO: 10984 - protein, 469 aa, Clostridium acetobutylicum
MGENNSHKHSLLFIVLISCAAGLGGLLYGYDTAVISGAIGFLKKLYNLSPAMQGFVISSIMVGGVLGVGFSGFLGDAIGRRKVLMLAAALFAISAVISSISTSAFMLIFARIVGGLGIGMASALSVTYITECAPPSIRGRLSSLYQLFTILGISITFFVNLGIVNMGSETWRVSTGWRYMLACGTVPAIVFLITLFFVPESPRFLVKSGNIKKAAAVLTKINGAEIAKQELDSISKSLATENDSSLGQLLQPGLRRALLIGIFLAIFNQAIGMNSITYYGPEIFQMIGFKNNSSFLATSVIGVVEVFSTILAMFLIDKLGRKKLMEIGSAAMAVFMLLIGTSFYIKLSNGFVILIFIICFVVSFCISMGPIPWIMIPEIFPNHLRARATGIATIFLWGANWAIGQFTPMLLNGIGGAYTFWIFCGINVICFLVVTTKVPETKNKSLEEIEKFWIPKSKQNAKGSSVGAK

SEQ ID NO: 10985 - protein, 455 aa, Clostridium acetobutylicum
MNKKISPALIYFFGAFGGFMFGYDIGIINGALPGINATWHVSSWLEGFITSGLFVGAMIGASLMASLADRFGRRRMIMWSAIVFALGALGSAVSTSTNLLIGARVILGVAVGGASALVPMYMGEISPAETRGKLSGLNQLMITVGMLFSYGVNFAFAGAFEGWRWMLGGAMVPAMVLLIGTFILPESPRFLARIGKTELAKQVLQTLRSKEEAETEYQEIINSKHTETGSFGDLFAKQALPAVIAGCGLTLLQQIQGANTIFYYSSQILSNVFGSANGGTISTVGIGVVLVLATIVTLLVVDKFKRRTLFMTGSIGMGASLLLVGLIYPYSEAKHAWATWLVFFFICLYVVFYAYSWAATTWIVVGELFPSNVRGLATGIASAVNWFGNILVALFFPVLLETVGLSVIFFGFAAICIIGFLFAKYVLYETKGKSLEEIETYLYNRSIGKVRGLNE

SEQ ID NO: 10986 - protein, 337 aa, Clostridium acetobutylicum
MKNNIIQIDKLGFQWKGHDPFLYCMHHKDAYPEGNDEMGPRVSLSGRDLGDDFSYKDGFSMYHGASVPGFPKHPHRGFETVTIVLKGYVDHADSSGALGRYGAGDVQWLTSGRGCNHSEMFPLLNTEEDNPLELFQIWLNLPSKDKFVEPHYKMLWAEEIPVIELKDTNKKISTMRIISGSYNNIKSLQPSPNSWAKDENNNVNIFVISMEAGALLELPRISSTLNRTLYYYSGNGINISETSIDVLSGVRLKGDEVIKIENGLKESKLLLLEGEPIGEPVKSYGPFVMNTEEEIEEAFSDYRETGFGGWQWQRDDVVHQRNKGRFAEYPDGTVEYR

SEQ ID NO: 10987 - protein, 257 aa, Clostridium acetobutylicum
MVINKVEICGVNTSKLPVLKEKEMRELLISMRNGNTTAREKFIKGNLRLVLSVIQRFNNRGENADDLFQVGCIGLIKSIDNFDLSQNVKFSTYAVPMIIGEIRRYLRDNNSIRVSRSLRDIAYRALQVRDRLISKNNKEPTVSQIAKELKIPREEVIFALDAIQDPISLFEPIYHDDGDAIYVMDQISDNKNLDDSWLQNISIKEAMKKLSDREKMILNMRFFDGRTQMEVADEIGISQAQVSRLEKTALKHMKKYV

SEQ ID NO: 10988 - protein, 566 aa, Clostridium acetobutylicum
MKKKLVLYNLGILIITLIMITVLFIKIEDYEYRQNTEQDLKRTNNVVSNVIDMNKGKDISSALKVVIKNSDIRVTYINKNGVVLYDNDINAEKLDNHNKRVEVAEARKNGYGYSVRYSKSLKNNIIYYAKVRGDGTVVRTAVELSSVERFEARYLKFYIYVIALSIIAAVYLSFKLSYVILNPIRELQNTSSRIAMGELETRVNVESRDEIGQLGKTFNNMAGRLQSTIRESVEKQKKLEAILVSMDSGVIAVDRKHKIIMINPYAEKIFGIDKNIIGQSLMDCIRNYEFEDIFNKRAEGYAEIKTSWPKERNLRIKTADIINGYECIGTVAVVQDITDIRKLENMRTQFVANVSHELKTPLTSIKGFAETLRYVEDDNQKGEFLDIIDDEVDRLTRLISDILTLSDIEIRPFMKKEEFDVNEIIKAVCGLLEKSASRKNISLKVFGEDVPNLIGDNDKFKQMIINLVDNAIKYTEAGGEVSVYKKYTKDDVIISVKDNGVGIPKEHLQRIFERFYRVDKARSRANGGTGLGLAIVKHIVLNFNGSINIESKLGVGTEFIITIPYK

SEQ ID NO: 10989 - protein, 398 aa, Clostridium acetobutylicum
MEVKNVVIGVSGGIAVYKALDVISRLKKADFGVDVIMTNSASKFVTPLSFQSLSGNKVINDMFEEPKSWEIQHISLAKKADILVVVPATANIIGKVANGIADDMLSTTIMAAYGRCPIVFAPAMNTNMYKNPIVQNNIKKLKDYGYIFIEPEKGRLACGDVGEGKLADTELIYENIKSLLYNKRDLAGKKVMVTAGPTIAPIDPVRFITNHSTGKMGYAIAEEARDRGAEVTLISGETSLKPPFGVDFIKVSTNSEMMEKVLEKFSGSDIVIKSAAVADYKAKNYSELKIKKASDNLNIEFVKDNDILKKLGEIKKHQILVGFAAESNDLIENAYGKLTRKNLDYIVANDILSKDAGFASDENRVVILGSDGSKLELDKMSKRKVAENLFDLLSKKRS

SEQ ID NO: 10990 - protein, 385 aa, Clostridium acetobutylicum
MKNISILGATGSIGTQTLDVIRNDSEAFKLLAVSAHSNFKKMIEIIDEFKPELVVMVDKLAYNKVLDYCCEKKLKTSVKVGYEAFNEVASYKDSNIVVTSIVGMIGLIPTLEAIKAGKDIALANKETLVVAGELVTKEAKKYGVNILPVDSEHGAIFQCLQGNKYKDINKILLTASGGPFRGKSFDELNNVTLNDALNHPKWTMGRKITIDSATLMNKGLEVIEAHWLFNVDYEKIQVLVHPQSIVHSMVQYKDGSVIAQLGPTDMRLPIQYALNYPVRKERIVEPVDFYSTPDLHFEKPDMDTFRCLRLAYDAGMAGGIMPAILNSANEYAVDLFLKDKIKFTNIQEIIEDALNHFENVNNLTANTIINKSNEVTKYLKGKIGF

SEQ ID NO: 10991 - protein, 274 aa, Clostridium acetobutylicum
MLDINSFTVLNNGVKMPWLGFGTYKIEYEESSVDYIKTALKVGYRHLDTAAVYGNEPIVGKAVKESGIPRNEIFITSKVWNNKHGYDKTLKAFEDTLKRLDTDYLDLYLIHWPKTLNKETWKALEKLYKDGRVRAIGVSNFKVHHLEEILEDCEIVPMVNQVEYHPQFPQTEVHEFCKKNKIQLESWGPLMQGKIFDIPLMKELSLKYGKTISQIALRWDLQMGVVTIPKSINENRIKENCDLYDFEISKEDMKKIESLNTGVRIGHDPDTITF

SEQ ID NO: 10992 - protein, 619 aa, Clostridium acetobutylicum
MYNILDNYEDVDDIKNMSSDELKEFASEIRKFLIDKISKTGGHLASNLGVVELTLSLHKVFNLKKDKIIWDVGHQAYVHKILTGRKDKFDSLKQFNGLSGFPKRNESIYDAFETGHSSTSISAASGIARARDLSKDNYDVIAVIGDGALTGGMALEALNDIGYKKTNVIIILNDNQMSIAKNVGSISKYLNKIRLDPKYNKLKKDVKTKLQRTNIGSEVANSIERIKGGIKQMVVSGMFFEDIGIKYLGPIDGHNIEELTSVISKAKEIKGPVILHVKTQKGKGYSYAEENPNKFHSIGKFNSKTGEALSKPKDTYSKAFGKAMVQMAENNDKIVAITAAMTDGTGLCEFSKKFPQRFFDVGISEQHAVTMAAGLAATGYKPVFAVYSTFLQRAYDQVLHDVCIQKLPVVFAIDRAGIVGEDGETHQGVFDISYLSSIPNMTIMAPKCVEELNYIMNWAVKQNYPIAVRYPKGGNDISDVLAPLKEFRHGKWEILKDGKDVAIVAVGKMVQRAMVVRDELLKYGIDCAIINATFIKPIDKDTLNRFARDNYKFVVIEDNVLHGGIGSLILEHLNDMKFKNDVLNLGFKDEFITHGNIEILYKLYDLDIEGICKRIISFK

SEQ ID NO: 10993 - protein, 241 aa, Clostridium acetobutylicum
MAIDGIVDDREALIKKYIPLVKYIASRVIIGKSKYIEYEDLVGYGMIGLMDALKKFDQSKGMKFSTYSSIRIKGAMIDELRKNSPISKGAMDKLNRYNLVVERLEKELSREPTELEIASGLGVGRKEVGEIEGYINYISVVSLEDLIFSEDDDMPLIGTIEDEKSPSPEKALEEKEEIEYLAKGIELLNEKDRMVLSLYYYEGLTLKKIGNILNVSESRVCQLHTRAIMHLRKSLKKLKYE

SEQ ID NO: 10994 - protein, 252 aa, Clostridium acetobutylicum
MGKENTLKKEEPNYNDNEKLIKSVHEGNKEALNKIIENNLPLVSAISRKFLNRGYEYDDIFQIGCMGLVKAVNNFNSDYKVKFSTYAVPMIMGEIKRFLRDDGIIKVSRSVKSTARQLHYDREKLVKELNREPTIDELSKFSGIDKEEIIMATESTTSMQYLYDVVHQDDGSPVLLIDKLSDPYSEDSDVIDKIVLKQIIKSLDNKSKQIIMLRYFKDKTQTQVANMLGISQVQVSRIEKRILKAIREKLTK

SEQ ID NO: 10995 - protein, 236 aa, Clostridium acetobutylicum
MNYDLTNPYEIAKYIKEAKKTTPLKVYVNGNLGDCTADDIDCFGTDDFYILFGESDKISAFLESHGDKIKKFKIEQDRRNSAIPLIDMTKIDARIEPGAIIRDKVSIGKNAVIMMGAVINIGSEIGEGAMIDMNAVVGARGKIGKRAHIGAGAVIAGVLEPPSKSPCEIGDDVLIGANSVILEGVKIGANSVIAAGSVVVEDVPSGVVVAGTPARIIKEVDDKTKDKTQIMDDLRK

SEQ ID NO: 10996 - protein, 267 aa, Clostridium acetobutylicum
MNILKDFSLEGKIALVTGASYGIGFAIARSYANAGATIVFNDINQDLVDKGLKAYEAEGIKAHGYVCDVTDEDKVNGFVKKVEKEVGLIDILVNNAGIIKRIPMLEMKAEDFRKVIDVDLNAPFIVSKAVIPGMIKKGHGKIINICSMMSELGRETVSAYAAAKGGLKMLTRNIASEYGEHNIQCNGIGPGYIATPQTAPLRELQADGSKHPFDQFIIAKTPAARWGTPEDLMGPAVFLASDASNFVNGHVLYVDGGILAYIGKQPQ

SEQ ID NO: 10997 - protein, 215 aa, Clostridium acetobutylicum
MGIKAVIFDLDGVIVSTDEYHYRAWKAMADEEGIYFDKRINERLRGVGRMESLEIILEKAKKTYNTKEKIQMTERKNFIYRELLNELTPKHILKGVMNVLETLRAKNIKIAIGSSSKNTSIILEKIKLDKYFDAVADGREIKKSKPNPEVFLLAAKKLKVSPEECLIVEDADAGVEAAIAGGMKVLAVGYASNNIKANYKFKDLSCVDIKEVICK

SEQ ID NO: 10998 - protein, 248 aa, Clostridium acetobutylicum
MFEDLVGKVALITGSSRGIGKSIAEEMAKMGIEVVINYRNDEKGALDTLKSIKNSGGIAEVYKCDITSYSEVKNMFEFIISKFGKIDLLVNNAGISKIGLFIDMKENDYNEIMDNDFRGVFNCTSLAVKYMLERKSGSIINISSIWGNVGASCEVLYSAAKGAVNSFTKALGKELAPSGIRVNAISPGVIDTEMNGSFSNDEKNDLENEIPMCRFGKTSEIAKIAIFLASEEASYITAQVITADGGML

SEQ ID NO: 10999 - protein, 485 aa, Clostridium acetobutylicum
MAKILKQAYTFDDVLLVPNKSEVLPKEVDLSTNLTKKIKLNIPLMSAGMDTVTESKMAIAMAREGGIGIIHKNMTIAEQASEVDRVKRQENGVITNPISLSKDNSVQEALDLMKRYRISGVPITDNAGKLIGIITNRDIVFETDYSKKIEELMTTENLVTAPQGTTIDEAKNLLKKHKIEKLPLVDENFVLKGLITIKDIEKIRKFPNAAKDSQGRLLCGAGVGVTKDMMDRVKALVDASVDVIVLDTAHGHSQGVLEAVKTIKKAYPELQVIAGNVATAAAVHDLIEAGADCVKVGIGPGSICTTRVVAGIGVPQLTAVMDCVEEANKYGVPIIADGGIKYSGDIVKALAAGAKAVMMGSMFAGCEEAPGETEIYQGRSYKVYRGMGSLAAMQCGSKDRYFQEGNKKLVPEGVEGRVPFKGSVIETVFQILGGIRSGMGYLGSRNMTELFEKATFVVQTSAGLRESHPHDISITKEAPNYSVNQ

SEQ ID NO: 11000 - protein, 277 aa, Clostridium acetobutylicum
MSKCDSCPSKSNCSSESSCSSINCKYGNIKNIIGVISGKGGVGKSTVTGILAVKLRKKGYKVGVLDGDITGPSMPRILGISDKRSLIVQKKGSEDVKFVPVETKQGIKVISLNLMIESEDQPVIWRGPVVNNVLNQMYTDTEWGELDYLIIDMPPGTGDVALTVMQNIPLSGMIIVSTPQDMVSMIVKKVVTMAQKMKVNMLGVVENMSYIVCNKCGDKMRVFSKKSAKEQSEYLGLPLICEMPIDLDLVENLENGTAEEYIYNSSEYDEILNDVIK

SEQ ID NO: 11001 - protein, 314 aa, Clostridium acetobutylicum
MSNPIKSILDDFPVVILDGALATELEKRGCNLNDSLWSAKILANNPEIIENVHYDYFVSGSDCAITSSYQATIDGFMKNGFPRDKAKDLIRNSVAIAKKARDRFWGNPTNRRNRAKPFIAGSVGPYGAYLADGSEYRGDYKIDENALIKFHKSNVKLLIEAGADILACETIPNLTEARAIVKLLEEFPGVYAWISFSCKNDYEISDGTPIFECAKVLNSCKNIAAIGVNCTSPKYINSLIKEIKKASDKPIIVYPNSGEEYDANTKTWHGASSSNAFSISAKEWFENGASVIGGCCRTTPSDINATYKILKNID

SEQ ID NO: 11002 - protein, 563 aa, Clostridium acetobutylicum
MSKVIYKISIDLGGIVKRNFEKETKNCGKVNEEVLFKILKSNDKSEIGIKFKFKDIKSIRQFKDSVPITEYKDYEKYINRMADGEGNVLMSEKVEYFGHTSGTTGKQKLVPCTKNSRRRASKYMALLVNRFCYDNFKENWNYARGMMIADIVMTTYTKGKIPICSATSGGMKGIKHLLPYLYTSPIEVMEIKDKETALYLHLLFGLEEEELLYISGVFISNILDLFRTLEKNNKALVRDIQKGSISEELNIDEGLRKVLNKKLKPNNKRAMELEKEFKKGFKGIAKRIWPNLLYIASVTGANFSIYNDKVYYYIDSIPIYSAAYGSTEAMIGINPYASKVLYVITPSAVFYEFIPIGEKGEESFDTLLLSELKLGGRYEVVITNYAGLYRYKIGDVVKVVGFYNKCPEIEFLYRKNQVLNMAAEKTNEEHLTYAIKNTIKKLNLDLVDYTTEPDNSITPGRYIFYFEFRNNMYGFSTEKLQNILDDELRVSNLAYNRARNNKKLGMLKVEVLAPNTFDLIKEALFNKGISKNQIKIPRVIINNKIVMDIINRNKIKFVKKSVI

SEQ ID NO: 11003 - protein, 327 aa, Clostridium acetobutylicum
MESVFDYEDIQLIPAKCIVRSRSECDTSVILGEHSFRLPVVPANMQTIIDENIALFLAQNGYFYIMHRFEPEKRLSFIKNMKSKGLFASISVGVKREEYDFIKQLAQENLSPEYITIDIAHGHSNTVIEMIQHIKKYLPKSFVIAGNVGTPEAVRELEHAGADATKVGIGPGKVCITKIKTGFGTGGWQLAALRWCSKAASKPIIADGGIRTPGDIAKSIRFGATMVMIGSLFAGHEESPGETIEKDGKLYKEYFGSASEFQKGEKRNVEGKKMFVEYKGPLKDTLIEMEQDLQSSISYAGGKSLDAIRTVDYVIVKNSIFNGDRIY

SEQ ID NO: 11004 - protein, 249 aa, Clostridium acetobutylicum
MEKLLSGKVAVVTGAGRGLGRAIALKLAAEGANLVVNYRSSEAETQKLIKEIEELGSKAVAVKADISKYDEAETIIKKALDEYGTVDILVNNAGITKDNLLLRMKEEDFDSVINVNLKGAFNCIKHTSRVMLKKKSGKIINISSVIGLIGNAGQVNYAAAKAGIIGMTKSVAKELASRGITVNAVAPGIIKSDMTDALTDKQRESIVAAVPLNKVGEAEDVANLVLFLASDLSSYITGQVINVDGGMVM

SEQ ID NO: 11005 - protein, 293 aa, Sulfolobus solfataricus
MIIVVGSYNVDVILKVNKIPEIGETVIADELYITHGGKGSNQAVSASRLGSHVKIIVAVGDDKHGTDAIEFWKSENIDVSKVKVKSGINTGTAYIFVDKKGRNIIVVNRGANYYLSEDDLNNSLEGDILLMQLEIRESVVKKAAKEFNGIKILNPAPANLKDTEILSLVDIITPNEIEFKELVNTDDFEYGLNLLLKKVKKAVIVTLGERGALLATRDGKKVLIPAPKVNVIDETGAGDVFNAALSVYLEKGYDLETAVEYANKVAALSVTKIGALGPKLDEVVRFLEEIDKA

SEQ ID NO: 11006 - protein, 313 aa, Sulfolobus solfataricus
MMQGNIYSMRETFGRLLADLGDKNKDLVVITADVGDSTRALYFREKFKDRYFNVGIAEQDMVNFAAGLAAVGKKPAIVNFGMFLMRAWEQIRNSIARMNLDVKMFVTHTGYSDHGDGSSHQVLEDIALMRVLPNMKVVVPADPKDIERSLPVIINEERGPLYYRIGREYSPPITIGQEYEFKIGKAYVIKDGSDLAIIGAGVVLWDALKAAEELEKLGISVAVINLFSIKPIDENTIEYYARKAGKIITIEEHSIYGGIGSAVAEVTARRYPVPIRFVGATTFGRSARSQRDLLDYYNINYKTIIREAIDLLK

SEQ ID NO: 11007 - protein, 338 aa, Sulfolobus solfataricus
MKRLALALKQRKVASWKLEEVKELTELIKNSNTILIGNLEGFPADKLHEIRKKLRGKATIKVTKNTLFKIAAKNAGIDIEKLEQYLTGPNVFIFTKDNPFITNMFFENYKLRRYAMPGDKAEEEVVIPAGDTGMPAGPILSVFGKLKVQTKVQDGKVHVVKDTVVAKPGDVIPAEALPILQKLGIMPVYVKLKIKVAYHEGLVIPAESLKLDLEGYRSNITEAYRNAFTLAVEIAYPTPDVLKFTISKVFKNAIALASEIGYITPESAQAVISKAVAKAYALATAIGGKVDLGVQLPTVQQSQSQQPAAEEKKEEKKEEEKKGPSEEEIASGLASLFG

SEQ ID NO: 11008 - protein, 371 aa, Sulfolobus solfataricus
MIILYLILMKGAILYKYNEPLIIEDNIQIDEPKVGETKIRIEATGLCHSDVNVFEGKTPVPPPVIAGHEIAGVIEEVGNNVTDFKPGDRVISAFIHPCGKCKNCITGKENLCEVFAKNRLNGTLLDGTTRLHFKDGTPIRAFLGGGFAEYAMVPYTALTKVPEDLDLRKVAVLGCAGLTAYGAVNSAKIEPGETVAVIGVGGVGLSVIQMLKIAGAGRIIAVGTRKWKLEKALELGASDVVNSKETDVVRAVKNITGGGPDVVIEVAGTTETVKMSLDMVRIGGKVVLVGLPPTTAEIPIRIASIVRGGIKIIGDYGGRPRVDMPRLIELVKLGKYDPTALVTGKFRLEEINEAVKLLEQGEAIRSLIIPN

SEQ ID NO: 11009 - protein, 199 aa, Sulfolobus solfataricus
MNKLANGPNYKVKPRRRREGKTNYYKRYVYVISKQTRFIVRITNKYVIVQIAKIDPKGDIMIASAHSAELAKKFGWKGDENNTPAAYLTGYLAGLRAIKRGVTECVADIGLHVPSKGNRVFYVIKGAIDAGLKIPIGDISIENDRIKGEHIAKYAEKLKSENSDLYSKLFSRYLQRGLNPENLPSHFEEILNKIKSSGG

SEQ ID NO: 11010 - protein, 442 aa, Sulfolobus solfataricus
MIKFAYLDKQIKILSFLCSFDKKLPMSYKIKDLSLASEGKKQIEWAERHMPTLMEIRKRFKAEKPLKGINISAVLHVTKETAALVKTLKIGGANVALAGSNPLSTQDDVAAALVEEGISVFAWKGENETEYYSNIESIVKIHEPNIVMDDGADLHAYIHEKVSSKLDIYGGTEETTTGVIRLKAMEKDGVLKYPLVAVNNAYTKYLFDNRYGTGQSAIDGILRATNILIAGKIAVVAGYGWVGRGIANRLRGMGARVIVTEVDPIRALEAVMDGFDVMPIAEASKVGDIFVTATGNTKAIRVEHMLNMKDGAILSNAGHFNVEVDVKGLKETAVKVRNIRPYVDEYTLPNGKRVYLLADGRLVNLAAAEGHPSEVMDMSFANQALAVEYLVKNRGKLEKKVYNMPMELDYEVARIKLKSMGIQIDELTEEQKEYLEQWKSGT

SEQ ID NO: 11011 - protein, 799 aa, Sulfolobus solfataricus
MGSFLLVEAISSEEDLILDVSQVTKDMVQLAGGKGANLGELTSIGVRVPPAFILTSKAFKYFLEYNNLFDKIRDTLSSSETSEEASEKIKQLIKNAKMPDKLSSMIYQAYDELSKKVGKEILVAVRSSATAEDIETASFAGQQDTYLNVTKDELIDRIKDVWASLYNARAMEYRKSKGIDDLSILIAVVVQKMVNSRSAGVMFTLHPVTGDEKYIMIESNWGLGESVVGGKVTPDEVLIEKSTLRIVEKKVSNKNIKIVYDKQLKKNVTITLDEKESRLMSITDEEAIELAKLALKIEEHYKRPMDIEWAIDNDLSFPENIFIVQARPETFWSSKRKENKNIAEKSAPIGGKVLVRGLAASPGIAFGKAKIILDIKDPKVHEFQKGEILVTKMTDPDWVPLMKIAGAIITDEGGMTSHAAIVSRELGIPAIVGSREATKIIRDNQEITVDAIRGIVYEGKVLQTSETVSQQAQPSIGIQGISREVLLSLYPVTATKIYMNLGEPDVIDKYLDLPFDGIGLMRIEFIVSEWVRYHPLYLIKIGNAELFVDKLAEGIAKVASAIYPRPVVVRFSDFKTNEYKKLIGGEEFEPDERNPMIGWRGVSRYVSKEYEPAFRLEAKAIRKVREEMGLKNVWVMFPFVRTTWELEKAIKIMEEEGLRRDSDFKVWIMAEVPSVVVLAEEFAKIVDGFSVGSNDLAQLTLGVDRDSELLARMGYYDERDPAVLESIRKLIKAAHKYGKTVSICGQAPSVYPAVVEYLVKAGIDSISVNPDAVINVRRQVASIEQQIILRNLNGKRKNK

SEQ ID NO: 11012 - protein, 419 aa, Sulfolobus solfataricus [sequence omitted]

SEQ ID NO: 11013 - protein, 566 aa, Sulfolobus solfataricus
MKRIESLWLPEDIKKVWMITFELQKIASVGGLGNAVYNIAKHLAEKGVDITVFLPSHGRHLNEYYRSLLSLRHIDMIVEGRRKGIDNNYYNYKIGFEEGKIDNFKVILVKGLDYNTGRVLDSWNIYDNTMEKISLLTRGLEGFTLGNLSNLPDIIHAQDWHAVIPAVRIKQLLEERRIIVPFIYTIHLLNYIGVPWHYASQDWSGIEDCWHYIWMVAKHELYKYSYVWDVLSGGKIEKFGCYEADMVSSVSYSYLSFDVFNFVGNWVANKSCVTYNGTDWDVEEIQNKAVTMYGTKDRRELRRRLLSSLHSLRVIPEDYTTGNMLWNNRNRLGLRDDWTYDDLGEGPLVLFTGRLVYQKGVDLLLRAMKTVVNEINNARLLIFGLPSGDYNLLWDIIERASEIKDNIRLIVGRMDLDLYKLFHYVSSVFVIPSRWEPFGINSIEAMAMGLPVIAYSVGGLRETVVDIREDKNNATGLLIKPESIDELARAIRIALYLSEASELNKSDLLYKASEVKVDDTRYWDKVRENAITRVKSRFRWDAVINSLTECYRKTLDMAKYRALASF

SEQ ID NO: 11014 - protein, 332 aa, Sulfolobus solfataricus
MKIRGIAQAIAEGIRQEMERNDRIVVLGEDVTYWGAVFGFTMGLFDKFGRKRVIDTPITEQTFMGISVGAASSGLHPVVSLMFVDFLGAGFDQMFNHMAKNYYMSGGQYPMPITVITAIGGGYGDSSQHSQVLYSLFAHLPGFKVIVPSTPYDAKGLTIKALRDNNPVIIFGHKLLTGLPFLPFEGNEEEVPEEPYEIEFGKAAIRKEGTDLTIISAGLMVHRSLKAAEMLQKEGISAEVIDVRTFVPLDEETIIKSARKTGRVLIVDEDYMSYGVTGEIAFRIQSKALKDLKVPISRLAVPDVPIPFSEPLENAVIPNVNTIYSEAKKLIQ

SEQ ID NO: 11015 - protein, 324 aa, Sulfolobus solfataricus
MRQITFTEAINEALRQEMERDPSVILIGEDIGVYGGAFGVTKGLIEKFGSDRVIDTPISEAGFIGAAVGAALAGLRPVVELMFVDFFGVAMDQIYNQMAKLRYMSGGQLKVPLTLRAPIGAGISAAAQHSQTLYSIFAHVPGLKVVVPSTPHDAKGLLISSIRDDNPVVFLEHKVLYGIKGEVPEEEYTIPLGKAEIRREGDDVTVIGIARTVWHSLEAAEQLSKESISVEVIDVRSIVPFDKETVIKSVKKTGRVVIVDEDYDRCGFASWVSSIIADEAFEYLDAPIKRITTPNVPIPFSPPLEQYILPDSKKIVNTVKSILG

SEQ ID NO: 11016 - protein, 269 aa, Sulfolobus solfataricus
MSVSKIYLLDHGKISADLAWFLPNPMTIEDMKNPKPRNWVDVSVMSAVIEHKDGVILFDTGIPDNVSGKWPQIALSVFPVTKYSEENKMENQLKKIGYKPEDIHFIILSHLHLDHTGSLELFKNSKPDVIVHEKELKYALLNLWLNKPVPYLLRDLEILREMNIVPMSTEYLEILPGVELLLIGGHTPGSILLKVRTQNDNNYIFTGDFIHVPEELSFESKGWLLGNAEEYYTRIRLLKSMQKLPRTNIIISHDPKLWEKYPKAPKELK

SEQ ID NO: 11017 - protein, 255 aa, Sulfolobus solfataricus
MIRMELFSLKGRTAVVIGAGSGIGKAIAKLFTDLGGKVVASDVKGLEDLQSTYDTFKADITNVNDVRQLVEFSLNKLGEIYALYITPSINIRKRIENYTLDEFDRVVNLNLRGNFIVLKEFLKVMKENKNGGSIVLFSSIRHLVTEPGQAVYASTKAAIVQLAKTAAAEYGKYGLRVNVIAPGVVDTPFTQQIKNNPEWYRAYTEKTILKRWADPMEIASVAVFLAMPASSYITGTVIYVDGGWTAIDGRYEPDI

SEQ ID NO: 11018 - protein, 470 aa, Sulfolobus solfataricus
MMSQEVIEVRSPSNLNVIGTVKRMHKDEVRGEIEEAYKGFEIISKMPLYKRTAILRKVSEILEREQERLAKLLAMEAGKPIRDSRVEVLRASRLFRHAAEEVGMVLEGKNYRVDAYEYPPGNENRIVVSTREPIGVVTAILPFNFPINSFAHKVAPALAVGNSVVVKPSINTPLAAIEMKKILVEAGLPDSAVRVVTGYSSEIGDEIITHPLVGLITLTGSTQTGLKIASKAVSLGKRIIMELGGSDPIIILEDANIERASSIAVRARFEYAGQNCNAGKRIIVREEIYDKFVKAFNDKARALKVGDPLDETTDVGPVINKESVENLNSVLADAKAKGGKVEILNKGPESGSFFPLTMVTNPSLDMLVLKSEVFGPIVPIVSVKSDEEAIRIANSTEYGLQSAIFTNDVNRALKLSRELKFGAVIINDSTRLRWDSLAFGGFKKSSIGREGVRETMLEMTENKLIAITLL

SEQ ID NO: 11019 - protein, 470 aa, Sulfolobus solfataricus
MMSLEVIEVRSPSNLKVIGTVKRMSKDEVRGEIEEAYKGFEIISRMPLYKRTAILRKISEILEREQERLARLLAMEAGKPISDSRVEVLRASRLFRQAAEEVGIVLEGKNYRVDAYEYPPGNENRIVLSTREPIGVVTAILPFNFPINSFAHKVAPALAVGNSVVVKPSINTPLAAVEMKKILVEAGLPDSAVRVVTGYSSEIGDEIITHPLVGLITLTGSTQTGLKIASKAISLGKRIIMELGGSDPIIILEDANIERASSIAVRARFEYAGQNCNAGKRIIVRQEVYDKFVKAFNEKAKALKVGEPLDETTDVGPVINKESVENLNSVLEDAKVKGGRVEILNRGPESGSFFPLTMVTNPSLDMLVLKSEVFGPIVPIVSVKSDEEAIRIANSTEYGLQSAIFTNDVNRALKLSRELKFGAVIINDSTRLRWDSLPFGGFKKTGIGREGVRETMLEMTENKLIAITLL

SEQ ID NO: 11020 - protein, 274 aa, Sulfolobus solfataricus
MQRTTISFLRWIVPLSLFWGFAFPLTKIIAYSASPMIISAFRIGIAAIFFLILGRGLSVGKKQFINGLMNFAFFLILINLGIGLSPDPGLVAVMIYTQPIFVLIIERLLGHKITPKGIVGVLLGVVGVISSATLSFNIGLVFGLLAGILWAGGTIYYSRNLAKEDIVKLNAFMTLTSLPIVLAFTPIDYYFRFSLVTLSLLLLLAILAQILGFYFWFNGVRELGTVYASTGSLLVPVMAYITSFAVLGVAPTLPQIIGSLITLFGVYLTITSRS

SEQ ID NO: 11021 - protein, 492 aa, Sulfolobus solfataricus
MAEKAAVKAGEAIARMDRIPIWGLSYIFIGILGIGFLFTFYDIFDINVSFIQTALTLFHVSNPTSPQIPALLGPIVLLNLVGYIIGALILSPISDVIGRRRMLMITMIITGLGSLYNALANNYVNFLVARTITGIGVGADLAIVNTYIGEVAPINGRARYTSLVFLFSTLGATLGIWLGLFLTTPSAPFPLGLPFALGGSGFFAVNGWRVMYGIGALLALIGLLLRFSLPESPRWLISKGKLTEAERIVEVMEKKATGKLGNLPPLPNIIQPYIAERYSYLDALKTIFSSSLYIKRFGILVSMWLFGYMTVYTLAAGLTSVLASLGFAPPEAGMIAAIGVIGFILVPITTFFVGDRLERKTWTVISVVFTIIGGLLIAIAGTNIALSFLGSIILFYGFNLWVPTSYAWTAESFPTRARSTGFALCDGVGHIGGGIGIIAISSFIGSLIASGVTTALAIEVFLLIALFQVISTIIAIAIGHRSANKRLDEVSP

SEQ ID NO: 11022 - protein, 259 aa, Sulfolobus solfataricus
MVVSYHMRFKDKVILITGGTRGIGRAITEAFLREGGLPIVLYNSAEDEAKKLREKGVFTIKCDVGNREDVKKSKEIVEKEFRRVNVVVNNAGIMLTMPFEEFDEEKYNKMIRINLNGTIYTTYEFLPLLKASENGAIVNIASNAGIGTAAEGTTFYAITKASIIILTKRLAFELGKYGIRVNAVAPGWVETDMTLSGKSKEEVERLRDLFRNKTVLKTTGKPEDIANIVLFLASNEARYITGQVIVADGGRIDNLTHSL

SEQ ID NO: 11023 - protein, 348 aa, Sulfolobus solfataricus
MKAAVYKGYGLPLEIEEVPNPAPKEGEVLVKVASTGICHSDLHLLSGELVGPLPNGFIIGHEIAGWVEKIGENVKNPYGLKEGDPVLVSWIVPCGICRYCANGKENYCKDNAKRLVGLIGINGGHAEYLTVPEIAVIPLAKNLDPYYSSPIACAYGTAYNALKSANATSGKSVVIVGAGGVGSAAIQLANSIGLNPIVAVDIDENKLKSAKLLGATHIINANENDARAKVLEALEDGADIVYETKPYPDFKLSLEVVKSGGTIVVTGLGGFSTLAQIPVTLFVSRGITLIGSLGYRPRIDLPDLVSLASSGKIDIKKLVSHIYTPDMINEAYENLKKGLHIRAIIRWN

SEQ ID NO: 11024 - protein, 466 aa, Sulfolobus solfataricus
MELPSVFAPFKRDPTFYPSPKMAMKSPPEDLAYVACLYTGTGINRPDFIAVVDVKPESETYSKVIHKVELSYVNDELHHFGWNACSSALCPNGRPNFERRFLVVPGLRSSRIYIVDTKLNPRQPNIVKTIEPEEVKKVTGYSRLHTVHCGPDGIYISAFGNENGEGPGGILMLDHYSFEPLGKWEIDRSDQYLAYDFWWNLPNEVMVTSEWAVPNTIENGLRLEHLKDRYGNRIHFWDLRRRKKVSSVTLGEENRMALELRPLHDPTKLMGFINMVVSLKDLSSSIWLWYYEDGKWNGEKVIEIPAEPTEGGLPEILKPFKAVPPLVTDIDLSLDDKFLYVSLWGIGEIRQYDVSNPFKPVLTGKVKLGGIFHRADHPSDHKLTGAPQMIEISRDGKRVYVTNSLYSTWDNQFYPEGLKGWMVKLNANPDGGLDVDKEFFVDFGEARSHQVRLRGGDASSDSYCYP

SEQ ID NO: 11025 - protein, 252 aa, Sulfolobus solfataricus
MRKFCDLSGRIAIVTGGASGIGRAIAFKLASLGATVVLGDVKLEELKNVVNEITQQTSSKVLPLYVNVGDFNSAKEFYQKATEILGIDYVDILVNNAGINRDALFVKMTFEQWDEVMKVDLYSMFNMTKQVVDGMIRRNYGRIINMSSMSWLGNIGQANYSAAKAGVIGFTKTLARELAKYNITVNAITPGFIDTPMTRAVPEKVRQKIIERIPMGRVGSPEEVANLIAFLSSEEASYITGEVIGVTGGLVL

SEQ ID NO: 11026 - protein, 478 aa, Sulfolobus solfataricus
MKSYQGLADKWIKGSGEEYLDINPADKDHVLAKIRLYTKDDVKEAINKAVAKFDEWSRTPAPKRGSILLKAGELMEQEAQEFALLMTLEEGKTLKDSMFEVTRSYNLLKFYGALAFKISGKTLPSADPNTRIFTVKEPLGVVALITPWNFPLSIPVWKLAPALAAGNTAVIKPATKTPLMVAKLVEVLSKAGLPEGVVNLVVGKGSEVGDTIVSDDNIAAVSFTGSTEVGKRIYKLVGNKNRMTRIQLELGGKNALYVDKSADLTLAAELAVRGGFGLTGQSCTATSRLIINKDVYTQFKQRLLERVKKWRVGPGTEDVDMGPVVDEGQFKKDLEYIEYGKNVGAKLIYGGNIIPGKGYFLEPTIFEGVTSDMRLFKEEIFGPVLSVTEAKDLDEAIRLVNAVDYGHTAGIVASDIKAINEFVSRVEAGVIKVNKPTVGLELQAPFGGFKNSGATTWKEMGEDALEFYLKEKTVYEGW

SEQ ID NO: 11027 - protein, 265 aa, Sulfolobus solfataricus
MRLCNKDVSQIGFGTWKIGGGYWNPDYSKDSHYIEILKYVISKGINVIDTAEMYGGGHSEELVGKAIENFDRDKIFIITKVWSNHLKYDDLIRSAKNSLKRLNAKYIDLYLIHWPNSSVPLEESLRAMEELVDQGIVNCIGVSNFDIKLLEETMSITKKYEITANEIEYNVENKSAEKDVIPFCERNNIKVIAYSPLARGNAKNNKILEEIGRKYNKTSVQVALNYLLRRSIPIPKASSKDHIDEILGALGWNLSDEDYERISKI

SEQ ID NO: 11028 - protein, 155 aa, Streptococcus pneumoniae TIGR4
MYYTLEEKEVFMREALREAEIALEHDEIPIGCVIVKDGEIIGRGHNAREELQRAVMHAEIMAIEDANLSEESWRLLDCTLFVTIEPCVMCSGAIGLARIPNVVYGAKNQKFGAAGSLYNILTDERLNHRVEVEIGILEDECAAIMQDFFRNRRKK

SEQ ID NO: 11029 - protein, 271 aa, Streptococcus pneumoniae TIGR4
MTNTSFSIEQFSLKGKIALITGASYGIGFAIAKSYAEAGATIVFNDINQDLVNKGIEAYREVGIQAHGYVCDVTDEDGIQAMVKQIEQEVGVIDILVNNAGIIRRVPMCEMSAADFRKVIDIDLNAPFIVSKAVIPSMIKKGHGKIINICSMMSELGRETVSAYAAAKGGLKMLTRNIASEYGGANIQCNGIGPGYIATPQTAPLRELQEDGSRHPFDQFIIAKTPAARWGNTEDLMGPAVFLASDASNFVNGHILYVDGGILAYIGKQPE

SEQ ID NO: 11030 - protein, 243 aa, Streptococcus pneumoniae TIGR4
MKLEHKNIFITGSSRGIGLAIAHKFAQAGANIVLNSRGAISEELLAEFSNYGIKVVPISGDVSDFADAKRMIDQAIAELGSVDVLVNNAGITQDTLMLKMTEADFEKVLKVNLTGAFNMTQSVLKPMMKAREGAIINMSSVVGLMGNIGQANYAASKAGLIGFTKSVAREVASRNIRVNVIAPGMIESDMTAILSDKIKEATLAQIPMKEFGQAEQVADLTVFLAGQDYLTGQVVAIDGGLSM

SEQ ID NO: 11031 - protein, 205 aa, Streptococcus pneumoniae TIGR4
MGWWRETIDIVKENDPAARTTLEVLLTYPGVKALAAHRLSHFLWKHGFKLLARMYSQFWRFWTQIEIHPGAQIDSGVFIDHGSGLVIGETAIVEKGVLLYHGVTLGGTGKDCGKRHPTVRKGALISAHAQVIGPVEIGENAKVGAAAVVVADVPSDVTVVGIPAKIVRLHGKKDEPVIHEVEEKREYYVNKLEQAKDASHRSSGL

SEQ ID NO: 11032 - protein, 369 aa, Streptococcus pneumoniae TIGR4
MATKQKEVTTFDVQVAEFIRNHKQKGTATDDEINASLVIPFTLDADGIEDLLQRIQDAGISITDNEGNPSARVLSNEEEPELSDEDLIGSTSAKVNDPVRMYLKEIGVVPLLTNEEEKELALAVEAGDIEAKQRLAEANLRLVVSIAKRYVGRGMQFLDLIQEGNMGLMKAVDKFDYSKGFKFSTYATWWIRQAITRAIADQARTIRIPVHMVETINKLVREQRNLLQELGQDPTPEQIAERMDMTPDKVREILKIAQEPVSLETPIGEEDDSHLGDFIEDEVIENPVDYTTRIVLREQLDEILDTLTDREENVLRLRFGLDDGKMRTLEDVGKVFNVTRERIRQIEAKALRKLRQPSRSKPLRDFIED

SEQ ID NO: 11033 - protein, 441 aa, Streptococcus pneumoniae TIGR4
MRIGLFTDTYFPQVSGVATSIRTLKTELEKQGHAVFIFTTTDKDVNRYEDWQIIRIPSVPFFAFKDRRFAYRGFSKALEIAKQYQLDIIHTQTEFSLGLLGIWIARELKIPVIHTYHTQYEDYVHYIAKGMLIRPSMVKYLVRGFLHDVDGVICPSEIVRDLLSDYKVKVEKRVIPTGIELAKFERPEIKQENLKELRSKLGIQDGEKTLLSLSRISYEKNIQAVLAAFADVLKEEDKVKLVVAGDGPYLNDLKEQAQNLEIQDSVIFTGMIAPSETALYYKAADFFISASTSETQGLTYLESLASGTPVIAHGNPYLNNLISDKMFGTLYYGEHDLAGAILEALIATPDMNEHTLSEKLYEISAENFGKRVHEFYLDAIISNNFQKDLAKDDTVSQRIFKTVLYLQQQVVAVPVKGSRRMLKASKTQLISMRDYWKDHEE

SEQ ID NO: 11034 - protein, 434 aa, Streptococcus pneumoniae TIGR4
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKVLPTPMMNIINGGSHSDAPIAFQEFMILPVGAPTFKEALRYGAEIFHALKKILKSRGLETAVGDEGGFAPRFEGTEDGVETILAAIEAAGYVPGKDVFIGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 11035 - protein, 330 aa, Streptococcus pneumoniae TIGR4
METKTMSFRDTIILAMSEEMRRDENVFLMGEDVGVFGGDFGTSVGMLEEFGPERVRDCPISEAAISGAAAGAAMTGLRPIVDMTFMDFSVIAMDNIVNQAAKTRYMFGGKGQVPMTVRCAAGNGVGSAAQHSQSLESWFTHIPGLKVVAPGTPADMKGLLKSSIRDNNPVIILEYKSEFNQKGEVPVDPDYTIPLGVGEIKRQGTDVTVVTYGKMLRRVVQAAEELAEEGISVEIVDPRTLVPLDKDIIINSVKKTGKVVLVNDAHKTSGYIGEISAIISESEAFDYLDAPIRRCAGEDVPMPYAQNLENAMIPTVESIKDAIRKTYNKE

SEQ ID NO: 11036 - protein, 453 aa, Streptococcus pneumoniae TIGR4
MYKTKCLREKLVLFLKIFFPILIYQFANYSASFVDTAMTGQYNTMDLAGVSMATSIWNPFFTFLTGIVSALVPIIGHHLGRGKKEEVASDFYQFIYLALGLSVVLLGMVLFLAPIILNHIGLEAAVAAVAVRYLWFLSIGIIPLLLFSVIRSLLDSLGLTKLSMYLMLLLLPLNSGFNYLLIYGAFGVPELGGAGAGLGTSLAYWVLLGISVLVLFKQEKLKALHLEKRIPLNMDKIKEGVRLGLPIGGTVFAEVAIFSVVGLIMAKFSPLIIASHQSAMNFSSLMYAFPMSISSAMAIVVSYEVGAKRFDDAKTYIGLGRWTALIFAAFTLTFLYIFRGNVASLYGNDPKFIDLTVRFLTYSLFFQLADTFAAPLQGILRGYKDTVIPFYLGLLGYWGVAIPVRTLFDSLTDFGAYSYWIGLIISLIVSGALYRWRLTVIMKRFESLAKSKC

SEQ ID NO: 11037 - protein, 577 aa, Streptococcus pneumoniae TIGR4
MTEMLKGIAASDGVAVAKAYLLVQPDLSFETITVEDTNAEEARLDAALQASQDELSVIREKAVGTLGEEAAQVFDAHLMVLADPEMISQIKETIRAKKVNAEAGLKEVTDMFITIFEGMEDNPYMQERAADIRDVTKRVLANLLGKKLPNPASINEEVIVIAHDLTPSDTAQLDKNFVKAFVTNIGGRTSHSAIMARTLEIAAVLGTNNITEIVKDGDILAVNGITGEVIINPTDEQAAEFKAAGEAYAKQKAEWALLKDAQTVTADGKHFELAANIGTPKDVEGVNNNGAEAVGLYRTEFLYMDSQDFPTEDEQYEAYKAVLEGMNGKPVVVRTMDIGGDKELPYFDMPHEMNPFLGFRALRISISETGDAMFRTQIRALLRASVHGQLRIMFPMVALLKEFRAAKAVFDEEKANLLAEGVAVADNIQVGIMIEIPAAAMLADQFAKEVDFFSIGTNDLIQYTMAADRMNEQVSYLYQPYNPSILRLINNVIKAAHAEGKWAGMCGEMAGDQQAVPLLVGMGLDEFSMSATSVLRTRSLMKKLDTAKMEEYANRALTECSTMEEVLELQKEYVNFD

SEQ ID NO: 11038 - protein, 183 aa, Streptococcus pneumoniae TIGR4
MANILLAVTGSIASYKSADLVSSLKKQGHQVTVLMTQAATEFIQPLTLQVLSQNPVHLDVMKEPYPDQVNHIELGKKADLFIVVPATANTIAKLAHGFADNMVTSTALALPSHIPKLIAPAMNTKMYDHPVTQNNLKTLETYGYQLIAPKESLLACGDHGRGALADLTIILERIKETIDEKTL

SEQ ID NO: 11039 - protein, 328 aa, Streptococcus pneumoniae TIGR4
MLNEFPIFDYEDIQLIPNKCVIKSRAEADTSVTLGNHTFKLPVVPANMQTILDENVAEQLAKGGYFYIMHRFDEAGRIPFIKRMHNQGLIASISVGVKDYEYDFVSQLKADTPEYITIDIAHGHADSVISMIQHIKKELPDTFVIAGNVGTPEAVRELENAGADATKVGIGPGKVCITKVKTGFGTGGWQLAALRWCAKAARKPIIADGGIRTHGDIAKSIRFGASMIMIGSLFAGHIESPGKTIEVDGEQFKEYYGSASQYQKGAYKNVEGKRILLPAKGHLQDTLTEMEQDLQSAISYAGGRQVADLKHVDYVIVKNSIWNGDASH

SEQ ID NO: 11040 - protein, 280 aa, Streptococcus pneumoniae TIGR4
MNTYQLNNGVEIPVLGFGTFKAKDGEEAYRAVLEALKAGYRHIDTAAIYQNEESVGQAIKDSGVPREEMFVTTKLWNSQQTYEQTRQALEKSIEKLGLDYLDLYLIHWPNPKPLRENDAWKTRNAEVWRAMEDLYQEGKIRAIGVSNFLPHHLDALLETATIVPAVNQVRLAPGVYQDQVVAYCREKGILLEAWGPFGQGELFDSKQVQEIAANHGKSVAQIALAWSLAEGFLPLPKSVTTSRIQANLDCFGIELSHEERETLKTIAVQSGAPRVDDVDF

SEQ ID NO: 11041 - protein, 416 aa, Streptococcus pneumoniae TIGR4
MKTPFINREELEAIVAEFPTPFHLYDEKGIREKARAVNQAFSWNKGFKEYFAVKATPTPAILKILQEEGCGVDCSSYVELLMSHKLDFLGSEIMFSSNNTPDKEYAYARELGATINLDAFEDIEHLERVAGIPEIISCRYNPGGVFELGTDIMDNPGEAKFGMTKDQLFEAFAILKEKGAKTFGIHSFLASNTVTHLYYPELARQLFELAVEIKEKLGISLDFINLSGGIGVNYHPDQEPNDIALIGEGVRKVYEEVLTSAGLGQVKIFTELGRFMLAPHGALVTRVTHKKETYRTYLGVDASAVNLMRPAMYGAYHHISNVTHPDGPAEVVDVVGSLCENNDKFAVNRELPHTEIGDLLVIHDTGAHGFSMGYQYNAKLRSAEILYTEEGKARQIRRAERPEDYFATLYGFDFEE

SEQ ID NO: 11042 - protein, 443 aa, Streptococcus pneumoniae TIGR4
MKRYLQFWLVNLSVSLILIAGMALTWISKGIGLFLLALSLGLGGYWLFCLWKWEVAFETLHQPLLTSSEYFLEKGQEDLKSLAQYVSGLKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 11043 - protein, 232 aa, Streptococcus pneumoniae TIGR4
MTATKMNAQEIIQFIANAEKKTSVKVTFEGQLATAVPSSVVKLGNVLFGDWKDVAPLLEGLVENQDYVVEQDARNSAVPLLDKRAINARIEPGAIIRDQVEIGDNAVIMMGSVINIGAEIGAGTMIDMGAILGGRAIVGKNSHVGAGAVLAGVIEPASAEPVRVGDNVLIGANAVVIEGVQIGSGSVVAAGAIVTQDVPENVVVAGVPARIIKEIDAQTQQKTALEDALRTL

SEQ ID NO: 11044 - protein, 310 aa, Streptococcus pneumoniae TIGR4
MMRSTKELRHVYRDFLLEANQSDSDIVVLEADLSSSMATNNLEKDFGDRYVNVGIMEAEMVGLAAGLSIQGFRPYLHTFGPFASRRVFDQLFISLGYAQLDATVIGSDAGVTAEMNGGTHMPFEEIGLLRLIPKSIIFEATDDIQFREILNQTLDLKGLKYIRTIRKAPVPVYQGGEDFSKGYIELRHGEDLVIVASGIMVAPSIRVADELSKLGYSVGVIDLFRIKPIPEQIKTMLSGKTIFTVENHNQIGGIGSALCELFSDDGITKIHRMGVQERFGQVGKMDYLLNEYGLSESNIKEKVLEIYNAR

SEQ ID NO: 11045 - protein, 492 aa, Streptococcus pneumoniae TIGR4
MSNWDTKFLKKGFTFDDVLLIPAESHVLPNDADLTTKLADNLTLNIPIITAAMDTVTESQMAIAIARAGGLGVIHKNMSIAQQADEVRKVKRSENGVIIDPFFLTPEHTIAEADELMGRYRISGVPVVETLENRKLVGILTNRDLRFISDYNQPISNHMTSENLVTAPVGTDLATAESILQEHRIEKLPLVDEEGSLSGLITIKDIEKVIEFPNAAKDEFGRLLVAGAVGVTSDTFERAEALFEAGADAIVIDTAHGHSAGVLRKIAEIRAHFPDRTLIAGNIATAEGARALYEAGVDVVKVGIGPGSICTTRVIAGVGVPQVTAIYDAAAVAREYGKTIIADGGIKYSGDIVKALAAGGNAVMLGSMFAGTDEAPGETEIFQGRKFKTYRGMGSIAAMKKGSSDRYFQGSVNEANKLVPEGIEGRVAYKGAAADIVFQMIGGIRSGMGYCGAANLKELHDNAQFIEMSGAGLKESHPHDVQITNEAPNYSM

SEQ ID NO: 11046 - protein, 155 aa, Streptococcus pneumoniae R6
MYYTLEEKEVFMREALREAEIALEHDEIPIGCVIVKDGEIIGRGHNAREELQRAVMHAEIMAIEDANLSEESWRLLDCTLFVTIEPCVMCSGAIGLARIPNVVYGAKNQKFGAAGSLYDILTDERLNHRVEVETGILEDECAAIMQDFFRNRRKK

SEQ ID NO: 11047 - protein, 271 aa, Streptococcus pneumoniae R6
MTNTSFSIEQFSLKGKIALITGASYGIGFAIAKSYAEAGATIVFNDINQDLVNKGIEAYREVGIEAHGYVCDVTDEDGIQAMVKQIEQEVGVIDILVNNAGIIRRVPMCEMSAADFRKVIDIDLNAPFIVSKAVIPSMIKKGHGKIINICSMMSELGRETVSAYAAAKGGLKMLTRNIASEYGGANIQCNGIGPGYIATPQTAPLRELQEDGSRHPFDQFIIAKTPAARWGNPEDLMGPAVFLASDASNFVNGHILYVDGGILAYIGKQPE

SEQ ID NO: 11048 - protein, 243 aa, Streptococcus pneumoniae R6
MKLEHKNIFITGSSRGIGLAIAHKFAQAGANIVLNSRGAISEELLAEFSNYGIKVVPISGDVSDFADAKRMIDQAIAELGSVDVLVNNAGITQDTLMLKMTEADFEKVLKVNLTGAFNMTQSVLKPMMKAREGAIINMSSVVGLMGNIGQANYAASKAGLIGFTKSVAREVASRNIRVNVIAPGMIESDMTAILSDKIKEATLAQIPMKEFGQAEQVADLTVFLAGQDYLTGQVIAIDGGLSM

SEQ ID NO: 11049 - protein, 684 aa, Streptococcus pneumoniae R6
MELLIYLILFLLVLIVSSTTNKLLPFLPLPLVQILLGIVIGLFLPNTDFHLNTELFLALVIGPLLFREAEEADVTAILKHWRIIVYLIFPVIFISTLSLGGLAHLLWFSLPLAACLAVGAALGPTDLVAFASLSERFSFPKRVSNILKGEGLLNDASGLVAFQVALTAWTTGAFSLGQASSSLIFSILGGFLIGFLTAMTNRFLHTFLLSVRATDIASELLLELSLPLVTFFLAEEVHVSGIIAVVVAGILKASRFKKITLLEAQVDTVTETVWHTVTFMLNGSVFVILGMELEMIAEPILTNPIYNPLLLLLSLIALTFVLFVIRFIMIYGYYAYRTRRLKKKLNKYMKDMFLLTFSGVKGTVSIATILLIPSNLEQEYPLLLFLVAGVTLVSFLTGLLILPHLSDEEEESKDYLMHIAILNEVTLELEKELEDTRNKLPLYAAIDNYHGRIENLILSQENQDDQEDWAALKLLILSIESDGLEQAYEEGNISNRAYRVYQRYLKNIEQGINRKLASRLTYYFLVSLRILRFLLHEVFTLGKTFRSWKDKEQSRLRALDYDQIAELYLANTEMIIESLENLKGVYRRSLISFMQESRLRETTIISSGAFVERVINRVKPNNINEMLRGYYLERKLIFEYEEKRLITTKYAKKLRQNVNNLENYSLKEAANTLPYDMVELVRRN

SEQ ID NO: 11050 - protein, 434 aa, Streptococcus pneumoniae R6
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKVLPTPMMNIINGGSHSDAPIAFQEFMILPVGAPTFKEALRYGAEIFHALKKILKSRGLETAVGDEGGFAPRFEGTEDGVETILAAIEAAGYVPGKDVFLGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 11051 - protein, 330 aa, Streptococcus pneumoniae R6
METKTMSFRDTIILAMSEEMRRDENVFLMGEDVGVFGGDFGTSVGMLEEFGPERVRDCPISEAAISGAAAGAAMTGLRPIVDMTFMDFSVIAMDNIVNQAAKTRYMFGGKGQVPMTVRCAAGNGVGSAAQHSQSLESWFTHIPGLKVVAPGTPADMKGLLKSSIRDNNPVIILEYKSEFNQKGEVPVDPDYTIPLGVGEIKRQGTDVTVVTYGKMLRRVVQAAEELAEEGISVEIVDPRTLVPLDKDIIINSVKKTGKVILVNDAHKTSGYIGEISAIISESEAFDYLDAPIRRCAGEDVPMPYAQNLENAMIPTVESIKDAIRKTYNKD

SEQ ID NO: 11052 - protein, 453 aa, Streptococcus pneumoniae R6
MYKTKCLREKLVLFLKIFFPILIYQFANYSASFVDTAMTGQYNTMDLAGVSMATSIWNPFFTFLTGIVSALVPIIGHHLGRGKKEEVASDFYQFIYLALGLSVVLLGMVLFLAPTILNHIGLEAAVAAVAVRYLWFLSIGIIPLLLFSVIRSLLDSLGLTKLSMYLMLLLLPLNSGFNYLLIYGAFGVPELGGAGAGLGTSLAYWVLLGISVLVLFKQEKLKALHLEKRILLNMDKIKEGVRLGLPIGGTVFAEVAVFSVVGLIMAKFSSLIIASHQSAMNFSSLMYAFPMSISSAMAIVVSYEVGAKRFDDAKTYIGLGRWTALIFAAFTLTFLYIFRGNVASLYGNDPKFIDLTARFLTYSLFFQLADTFAAPLQGILRGYKDTVIPFYLGLLGYWGVAIPVATLFDSLTDFGAYSYWIGLIISLIVSGALYRWRLTVIMKRFESLAKSKR

SEQ ID NO: 11053 - protein, 328 aa, Streptococcus pneumoniae R6
MLNEFPIFDYEDIQLIPNKCVIKSRAEADTSVTLGNHTFKLPVVPANMQTILDENVAEQLAKGGYFYIMHRFDEAGRIPFIKRMHDQGLIASISVGVKDYEYDFVSQLKADAPEYITIDIAHGHADSVISMIQHIKKELPDTFVIAGNVGTPEAVRELENAGADATKVGIGPGKVCITKVKTGFGTGGWQLAALRWCAKAARKPIIADGGIRTHGDIAKSIRFGASMIMIGSLFAGHIESPGKTIEVDGEQFKEYYGSASQYQKGAYKNVEGKRILLPAKGHLQDTLTEMEQDLQSAISYAGGRQVADLKHVDYVIVKNSIWNGDASH

SEQ ID NO: 11054 - protein, 416 aa, Streptococcus pneumoniae R6
MKTPFINREELEAIVAEFPTPFHLYDEKGIREKARAVNQAFSWNKGFKEYFAVKATPTPAILKILQEEGCGVDCSSYVELLMSHKLDFLGSEIMFSSNNTPDKEYAYARELGATINLDAFEDIEHLERVAGIPEIISCRYNPGGVFELGTDIMDNPGEAKFGMTKDQLFEAFAILKEKGAKTFGLHSFLASNTVTHLYYPELARQLFELAVEIKEKLGIWLDFINLSGGIGVNYRPDQEPNDIALIGEGVRKVYEEVLTSAGLGQVKIFTELGRFMLAPHGALVTRVTHKKETYRTYLGVDASAVNLMRPAMYGAYHHISNVTHPDGPAEAVDVVGSLCENNDKFAVNRELPHTEIGDLLVIHDTGAHGFSMGYQYNAKLRSAEILYTEEGKARQIRRAERPEDYFATLYGFDFEE

SEQ ID NO: 11055 - protein, 443 aa, Streptococcus pneumoniae R6
MKRYLQFWLVNLSVSLILIAGMALTWISKGIGLFLLALSLGQGGYWLFCLWKWEVAFETLHQPLLTSSEYFLEKGQEDLKSLAQYVSALKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 11056 - protein, 232 aa, Streptococcus pneumoniae R6
MTATKMNAQEIIQFIANAEKKTSVKVTFEGQLATAVPSSVVKLGNVLFGDWKDVAPLLEGLVENQDYVVEQDARNSAVPLLDKRAINARIEPGAIIRDQVEIGDNAVIMMGAVINIGAEIGAGTMIDMGAILGGRAIVGKNSHVGAGAVLAGVIEPASAEPVRVGDNVLIGANAVVIEGVQIGSGSVVAAGAIVTQDVPENVVVAGVPARIIKEIDAQTQQKTALEDALRTL

SEQ ID NO: 11057 - protein, 310 aa, Streptococcus pneumoniae R6
MMRSTKELRHVYRDFLLEANQSSSDIVVLEADLSSSMATHNLEKDFGDRYVNVGIMEAEMVGLAAGLSIQGFRPYLHTFGPFSSRRVFDQLFISLGYAQLDATVIGSDAGVTAEMNGGTHMPFEEIGLLRLIPKSIIFEATDDIQFREILNQTLDLKGLKYIRTIRKAPEAVYQGGEDFSKGYIELRHGEDLVIVASGIMVAPSIRVADELSKLGYSVGVIDLFRIKPIPEQIKTMLSGKTIFTVENHNQIGGIGSALCELFSDDGITKIHRMGVQERFGQVGKMDYLLNEYGLSESNIKEKVLEIYNAR

SEQ ID NO: 11058 - protein, 462 aa, Sulfolobus tokodaii
MAIVPFKRDPTFYPSPKMAMKAPPEDLAYVACLYTGTGINRADFIAVVDVNPKSETYSKIVHKVELPYINDELHHFGWNACSSALCPNGKPNIERRFLIVPGLRSSRIYIIDTKPNPREPKIIKVIEPEEVKKVSGYSRLHTVHCGPDAIYISALGNEEGEGPGGILMLDHYSFEPLGKWEIDRGDQYLAYDFWWNLPNEVLVSSEWAVPNTIEDGLKLEHLKDRYGNRIHFWDLRKRKRIHSLTLGEENRMALELRPLHDPTKLMGFINMVVSLKDLSSSIWLWFYEDGKWNAEKVIEIPAEPLEGNLPEILKPFKAVPPLVTDIDISLDDKFLYLSLWGIGEVRQYDISNPFKPVLTGKVKLGGIFHRADHPAGHKLTGAPQMLEISRDGRRVYVTNSLYSTWDNQFYPEGLKGWMVKLNANPSGGLEIDKEFFVDFGEARSHQVRLSGGDASSDSYCYP

SEQ ID NO: 11059 - protein, 468 aa, Sulfolobus tokodaii
MSEVIEIKSPSNLKVIGTVKRMSKDEVRGEIEEAYKGFETISRMPLYKRTAILRKVSEILEREQERLARLLAMEAGKPIKDSRVEVMRASRLFRQAAEEAAIVLEGKNYRVDAYEYPPGNENRIVISTREPIGVVTAILPFNFPINSFAHKVAPAIAVGNSVVVKPSISTPLSAIEMKKILVEAGLPDSAVRIVTGYSNEIGDELITHPLVGLITLTGSTQTGLAIASKAVSLGKRIIMELGGSDPIIVLEDANIDRASSIAVRARYEYAGQNCNAGKRIIVREEIYDKFVKAFKEKVKALKVGDPLDESTDIGPVINQESVEKLNKALEDAQSKGGNVEVLNKGPETGYFFPLSLVTNPSLDMLVLKTEIFGPIAPIVSVKSDEEAINIANSTEYGLQSAIFSNDVNRALKIAKELKFGAIIINDSTRLRWDSLPFGGFKKTGIGREGVRDTMLEMTENKLIAITLL

SEQ ID NO: 11060 - protein, 253 aa, Sulfolobus tokodaii
MYSLKNKVVVITGSGRGIGRALALRLASEGALIVVNAKKRAEEMNETVKMVKDQGGEAIGILADVSTREGCETLLKKTLDVYKVVDILVNNAGIGLFSPFLNVDDKLIEKHISTDLLSVIYCSQMFAKEIREGGEILNIASVAGIVPAYGLSIYGAMKGAVITLTKYLALELAPKIRVNAIAPGFVKTKLGESMYKFLGITEKEFAEKVTIMGKLLEAEDVAELATAILKIESLTGQVFVIDSGESLKGGLKF

SEQ ID NO: 11061 - protein, 271 aa, Sulfolobus tokodaii
MSSTTLFVKWMIPVAIVWGLSYPLTKLVSEYSSPMIISVARVAVGFIFFYSLSRSLSIGVKQFINGLLNFVGLLTFLNLGVYFSRNPGLVAVMIYTQPLFILVIEYILGTRIKTKGTIGIILGVIGITAAAFVSFDLGLLFGLLGGLVWAIGTVYYRRNLLKEDIVRLNASMALTSLPILLVLTPIDFHFTFTLTAISLIIILALIAQVGGFFFWFNAVKYLGSIKAGTGSLLVPVMAYVLSYAFFRTIPTPIEIIGSAITLIGVYLTMTS

SEQ ID NO: 11062 - protein, 267 aa, Sulfolobus tokodaii
MKKFKWFSISPLALGTWGMGGGYWSTDYSNDENDIKAIIKAIELGITAIDTAEMYGNGHAEELVGKAIKNFKREELFIITKVWPNHAKYEDVLKSAIASSKRLGTYIDLYFLHWPSNVPICETIKAFEDLVDKGVIRYFGLSNFKWREIEKASECVKKYEIAAVENHYSLWDRGDEETLEYANKKGLLYLAYTPIEKGRIKNDKFLSEIAKKYNKTPIQIALNWYIRIPSLVPIVKSSNISHLEENVGALGWELSEEDWKKINEHFK

SEQ ID NO: 11063 - protein, 298 aa, Sulfolobus tokodaii
MMSSNPFRISSPQPQKQPRDLRKVNQQVQAADLKIQMKMKTVKYKIAVLSGKGGVGKSFVSSNLAMALAAAGRSVGIVDVDFHGPSVPKMLGVRGQYLTADDKGGINPVIGPFGIKVVSIDFLLPRDDTPVVWRGAIKHTAIKQFLGDVNWGELEYLIIDMPPGTGDEALSVAQLVPNLTGMIIVTIPSEVSTLAVKKSINFAKTINAKILGVIENMSYFLCPSDNKPYYIFGEGKGKQMAEEMGVPLLGQIPLDPIVAQANDLGEPFFLKYPDNPASKEFMRIAEQVIHIVENSNQQ

SEQ ID NO: 11064 - protein, 415 aa, Sulfolobus tokodaii
MDYKVKDLSLAEQGKKQIEWAEIHMPALMEIRKQFEKEKPLQGLRISAVLHVTKETAVLVKTLKIGGATVALAGSNPLSTQDDVAAALVEEGIRVFAWRGETEKDYYDNIKEILKYEPQIIMDDGGDLHAYVHENMPQLKLFGGTEETTTGVIRLKAMEEQGVLRYPVIAVNNAFTKYLFDNRIGTGQSTIDGILRATNILIAGKVAVVAGYGWVGRGIAQRLRGMGARVIVVEVSPLRALEAVMDGFDVMPMSKAAELGEIFITATGNINVIRKEHILKMKDGAILANSGHFNVEIDVKGLKEMAKSSRLIRPNLEEYELPNGKRIYLLAEGRLVNLAAAEGHPSEVMDLSFSNQALSVKYIYENRGKLENKVYNVPQEIDETVAKLKLNGMGIEIEPMTQEQIEYMKQWRYGT

SEQ ID NO: 11065 - protein, 196 aa, Sulfolobus tokodaii
MAHGPNYRVKYRRRREGKTNYYKRYTYVINNTTRLVVRLTNKYIIAQIAKFNPKGDVIVVAAHSMELAKKFGWKGDLNNTPAAYLTGYLLGVRALKAGIKEAVADIGLFVPVKGSRIFTAIKGAIDAGLSIPVGDLGIKEDRIKGVHIASYAQKLEAENPELFKRLFSKYLERGLHPKDLPSHFEEILNKIKSGGA

SEQ ID NO: 11066 - protein, 572 aa, Sulfolobus tokodaii
MAEMKRIEAIWFPEEIKSVWMITVELSNVASVGGLGNAVYNMAKGLAEQGINVTVIMPSHGRHLNDQYRSALKLRELSLTAYGDRIGMDGKRYPYALGFEEGRLDGFNVILVKGLDYNTGVLIDNWNVYNNIMEKSALLARGVQAYSVFSIPGNIPSVIHAHDWHAVLAGVMAKQTFETRKVVVPLVFTIHLLNKVGAPWHYASEDWAGLSNCPHYIWQVVSHKLYTTRQVWDELSQGLIEKFGAWEADVVTTVSKSYLTYDVYNFIGNWIENKSCVTYNGTDWSIDEVKNYARKIFNTEDRVEVRRRLYNMLENLRLIPEDYTTGNILWNNRFRIGIKDDWTYTRLDDGPLVLFAGRLVYQKGVDLLIRAFREVVNKIPNARLVILGLPSGDYGLLYDLVNKASEIGGNVRIIASYSMPKDIYKLFYYAASVFVVPSRWEPFGIVALEAMAVGTPVVAYAVGGLRESIIDLRSDINNGTGFIIGPENIWELYRGILTSLALSMSSETKNKNYLYMDDLILKTDDTDLWNKVRQNGIRRVEENFRWSATAKYLINCYSKAQTMAKYRASASF

SEQ ID NO: 11067 - protein, 476 aa, Sulfolobus tokodaii
MSSYEDLLKVLDSRKVTRLYWIITILAAIGGFLFGYDTAVIGTAAEFAPYHYSGFLLGYEIASASLGAAIGAIIAYFYTDRYGRKSLLILDAGIYTAAAVLSALTINGIMLLVMRTIIGIAIGADSAVATAYITEYAPKDKRGSLAIMQQWMITIGILGSYLVGSAILYFLPSLAYVFDWRLILGLAAVPALIGLIFRFMMPESPRWLIYTGQFDKLKRELAKFGISVSDDVLERTRTEIQSEMSIKLDTAAKKALLLVGLWLVFQQITGINVPFYYGPILLSKLHIFSSTTNPVYSAIDGVLESTILAVINVAATYIAFRYIDKIGRRTLGISAYIGMAIFDLIGGISTLFGFDIGLLISFAGFIIFFAYGVGGTGWLIQAEYFDTRIRGRMAAIGALIDWLANFALIEVFPVMLSTVGLGGSMFIFFILDLVALVFVYFFIPETKGMSLEDVVKMFSSVPISKIKNGREIVLSK

SEQ ID NO: 11068 - protein, 312 aa, Sulfolobus tokodaii
MYNEWLPVAFSDEVKDVYETNVLGQDIVIIRKNEKLYGLSNRCPHRLAKLSKGKIIEDEIQCPYHGWRFNLEGKLTIVPSLGKKINVNLRKYYIKEKYGIIWVCINEPKDDLPEIKEWESFRKIKCGPYYINANPFRVLENLFDVSHFPYVHENYLGDPKYPYIPEYNVEITNEGIVAKNIKIYQPNPDGSHAEKYESYTYIIYRPLFLYFTKTDESERTFSMIFAIKPESKNKSVVFAWIFMNYDYETDENVIRNFEDTIIMQDKEVLETQPDIYYLDLSKEIHVKADKLSIFYRHYLKRRIGKFPELGLL

SEQ ID NO: 11069 - protein, 250 aa, Sulfolobus tokodaii
MGIELNGKIAIVTGASSGIGRAIAFKLASRGANLILGDVKIDELRKVAEEIAKETKVKVIPLYVNVGDFNSTKEFYNKGISELGVDYVDILVNNAGINRDALFVKMTYEQWDEVIKVDLYSMFNMTKQVVDGMVKRNYGRIINISSLSWLGNIGQANYSAAKAGVIGFTKTLARELGKYNITVNAICPGFIDTPMTRAVPEKIRQRIIERIPMGRIGQPEDVANLVAFLASDEASYITGEVIGVTGGLVL

SEQ ID NO: 11070 - protein, 416 aa, Sulfolobus tokodaii [sequence omitted]

SEQ ID NO: 11071 - protein, 764 aa, Sulfolobus tokodaii
MINIAGGKGANLGELISMGIRVPPGFVITSHAYKYFISYNKLDEKIKEIFEKEKDDEIISSKIRELILSSQIPPDLANQILSAYENLSKLVGKEILVAVRSSATAEDIESASFAGQQETYLNVSKGELLDAVKKVWASLYTARAISYRRFKGIDQITVEMAVVVQKMVNSRSAGVMFTLHPVTGDRNYIMIESSWGLGEAVVSGKVTPDEVVIEKSSLKIVEKKVSHKILKIVYDREKRQNIIINLSNEEADQMSISDEEAIELARLALKIEEHYGRPMDIEWAIDADMKFPDNVFIVQARPETYWTSKQIERKKEEVKVSVGKVLTKGLPASPGIAYGKARVILDVKEAKDFEKGDILVTKMTDPDWVPIMKIASAIVTDEGGMTSHAAIVSRELGIPAVVGTGNATKVIKDGEEITVDAIRGIIYEGKLTFETEEKKEATQPVSVGGISRDVLLSLYPVTATKIYMNLGQPDIIHKYLDLPFDGIGLMRIEFIVSEWIKYHPLYLIKTGKPELFVDKLAEGISMVASAIYPRPVVVRFSDFKTNEYKRLIGGEEFEPEERNPMIGWRGVSRYVSPQYEPAFRLEVRAIRKVREEMGLKNVWVMFPFVRTTWELEKAIKIMEEEGVRRGQDFKVWIMAEVPSVVVLADKFSQLVDGFSIGSNDLAQLTLGVDRDSDLLARMGYYDERDPAVLESIKRLIKVAHKYGRTVSICGQAPSVYPEINEFLVRQGIDSISVNPDAVIQVKRQVASIEQKIMLEKLRKK

SEQ ID NO: 11072 - protein, 337 aa, Sulfolobus tokodaii
MRIMAVITQERKIAKWKIEEVKELEQKLREYHTIIIANIEGFPADKLHDIRKKMRGMAEIKVTKNTLFGIAAKNAGLDVSKLEPYLTGPNAFIFTNKNPFEIQLFLSKFKLKRYAMPGDKADEEVVIPAGDTGMPAGPALSIFGKLKIKTKVQDGKIHVTQDTVIAKPGDPIPPDAIPILQKLGIMPVHIKLNIKVAYDNGLIIPGNQLSINLDDYKTDIMKAYQSAFGLAVEIAYPIPDVLKVSAEKAARNALSLAAEIGFITPETVQAVFSRAISKAYALASAISGKVDLGIQVPQTQQAPAQQAEKKEEKKEEEEKKGPSEEEIGGGLSSLFGG

SEQ ID NO: 11073 - protein, 260 aa, Sulfolobus tokodaii
MCMSSQSYFKSVMYALVTGGTRGIGRAITEALLKEGYNVAVLYHGSEDKAKELREKGVLTVRCDVGDRNQVKKAKEEISNHFPRLDVLVNNAGIWYLMPFEQFDEEKYERMLRVNLNGTIYVTYEFLSLLKKSSAASIINIASNAGIGTAAEGTTFYAITKAGIIILTRRLAFELGKYGIRVNAVAPGWIETDMTLGNKSDEEKEKLREIFRNKTVLHTTGKPEDIANIVVFLASEKARYITGQVIVADGGRIDNLTHSV

SEQ ID NO: 11074 - protein, 361 aa, Sulfolobus tokodaii
MRAAVLFNYKEPLKIEEVEIEDPKENEVMVQVVATGLCHSDINVFVGATPVPPPVVAGHEIAGIVKKVGPGVTRVKPGDRVISAFIHPCGKCKNCISGHENLCETFSSVRLKGTMFDGTTRLRLKNGTIVRTFLGGGFAEYAIVHENALTVVPQDMDLQKVAVLGCAGITGYGAVDSAKIEPGETVAVIGVGGVGLSIIQLLKASGAGRIIALGTKKWKLEKAMELGATDVINTKETDPIKALKEVTNGGPDVVIEAGGTQETVQMAIESVRIGGRVVLVGLPPVSAQIPLRIAMIVRNGITILGNYGGRPRIDMPRLLELVRSGKYDPGKLVTGKYRLEEVNEAVKLLEEGEAIRSLIIP

SEQ ID NO: 11075 - protein, 267 aa, Sulfolobus tokodaii
MLVWSSAYPLIKIALQYMSPIILAIIRLLVGGLILLIYGKGIIYGLKEFIGSLLNVAIFMILLNLGVLLSPNPALSATLIYTQPVFVAIFSYFIFKEKIGILKIFGIIIAISGAIIASGNLEVNIGALISLLGGITWAVGTIYYRKYLINEDVIRLNSFFALSSVPVLVPLIPFQFYFKVSLEGIVVAIIIGITAQALGFIFWFSSVKNLGAFKASSISLLVPALSYFFSYIILGDMPTLIEMIGSFLVLFGVLLTNLKISNFSSRF

SEQ ID NO: 11076 - protein, 313 aa, Sulfolobus tokodaii
MMQRSTLPMRDTFGRLLAELGEKNKDIIVITADVGNSTRAMYFREKFPDRYFNVGISEQDMVNFAAGLSVTGFKPIVVGFAMFVMRAWEQIRNSIARMNLDVKIMVTHSGYSDSGDGSSHQALEDIALMRVLPNMKVIIPADSEDVKRSLPVVVNELRGPLYYRMGRDYTPVITEGLDYDFKLGKAYVLRDGEDLAIMGAGVVLADALKAAEELEKMGISAAVINLMSIKPIDEDLIEYYARKTGRIITIEEHSIYGGIGSAVAEVVVKKYPVPMRFIGAITFGRSARSERDLLDFYGINYKSILNAVMELVK

SEQ ID NO: 11077 - protein, 291 aa, Sulfolobus tokodaii
MITVVGSYNVDFILKVDEFPNEGETVFAKEIYINHGGKGSNQAVSASRLKAKVRIIAAVGNDEFGKNAIRFWEDEGIDTAYVKIKNSVTGSAYIIVNSRGENVIVVNRGANALLNEEDIDNALSGDILLTQLEIDEKVVKKALKEFNGIKILNPAPAILKDFSILDYVDILTPNEIEFKELTNTDDIDSGIQLLLKKVKKAVIITLGERGALIATKHEKILVPTIKVNPIDTTGAGDVFNAALAVYLERNYDLRTAVRIANKLASYSTTIIGALGPRYEEVKNLIEEENEN

SEQ ID NO: 11078 - protein, 294 aa, Sulfolobus tokodaii
MIRGIYGILEGKRTVDGAGVKLYRVFGGPTTVQLTDPFLLLDFFGSANPEDYIVGFPWHPHRGIETVTLLYEGKVEHEDSEGNKGVIYPGQVQWMTAGSGIFHQEMPKPLEGVEIAKYNQNPLSVKGLQLWINLPSYKKMTEPTYRNIKSLPKERFDFGEVSILVGEYKGIEGPIRVKSDVDPLYLDVNLDGEFHLNVKNGYTVLAFVVDGKAKFSPNVPEIDKGNLVIFNREGDEIVVKGKARFIILSGKPLEEPVAWYGPIVMNTEDQILEALADLRRGTFVRHKQVNIEDY

SEQ ID NO: 11079 - protein, 310 aa, Sulfolobus tokodaii
MGSNFINYDFYIHSIIYLLMYDVKKFKYFTVSSIAFGTWRIGGGYWYASHDRDNEWVSAIKRAIELGITLIDTAEMYGNGHAEELVGQAIKSFDREQLFIVSKVWPSRADYDNVLKSANNSSKRLGTYIDLYLLHAPSRVPICQTMKAFEKLVDDGIIRFFGLSNFDVKGIENARQCLSKYELVAIQNHYSLLYRKDEESVLGYAERNGLMYMAYTPLENGILSKNEFLANIGRKYNKTATQVALNWYISHNNLVPIVKASKINHVEENAGVMGWRLSEEDWKAIDTHFRERNYLLDKFISTLKSMRPWK

SEQ ID NO: 11080 - protein, 253 aa, Sulfolobus tokodaii
MEISLKGKTCLITGGTHGIGLATAKLFAELGAKVIALGRNIESVEKENNSIQFVKVDLTSREQLLSFIELYKKEIGIIDCLINNASTNSRYSILNVTLEEWDKMISLVLTAPMLLSKMAAELMIKNGIKGKIINIAAIQAHYPLPESLPYVTVKGGLIAMTKSLAVDLGKYGIQVIAVVPGPIYTKGEKVPENLDKNAATLLGRMGRPQEVANLLAFLASDYNTFITGTEIIIDGGRIISRKPDPEEITSGAV

SEQ ID NO: 11081 - protein, 459 aa, Sulfolobus tokodaii
MVKRLDNAEVIRLHILATIIGALGGFLFGYDTGIIGSVLVYVTPLFHLTPPEVAILTSGTSLLAGIGALAAGPITDKYGRKSLLVTDGIMYAVFALLSAIAINSFLLILWRSLVGFAIGADTAIATAYISEFSPKRWRGRLAITQQLMIFSGITASFWAGYLLSFSANWRLMLGLGVIPAVILVALRAFLPESPRWLLLNGMEEKAKNILRKFGVNIAENEHIAAPSKELSFKEMFNNKAIRTAIILVGLWLAFQQITGINVILYYGPTIYKYLGLTGPRAILNTAISESLGAIEYAISFYLIDKWGRRKLGIFGYAGLVGSLAIMLIGLRAFTSGIVFAGVALVFTAMTLFLLFFHVGVGGVGWVLQGETIPTEVRGRGAGLLAAIDWFANFVIIFIFPYWKAAFGVYSFFALELVLSILAIAIVYLFMPETKGVSLEDMLKVFERGLSVQRQKQYAK

SEQ ID NO: 11082 - protein, 290 aa, Staphylococcus aureus subsp. aureus Mu50
MNKLRDTTFLSYLFTIILWGSAFPMIKIALNDFSAESLSAFRLILATIILLPFVIIKKLPTPELRDIPVIFILGFCGFVIYHTALNFGETLISAGISGILVSTTPIFSSALAYIFLKEHFSKWNWLSSLVAFIGISIISISKDDYTTINVLGVFIILLASFSESLYFTFQKKYIEKYGFIAFTLYTIMASSPFMLIFIPEIINDIHGATFTSIVSVLYLAIFPTIIPYVLLAYIVKSVGVSDATMSLYLTPIVSLLLSYLLLDELPTTLAIIGGIITLLGVSLSNFFQNT

SEQ ID NO: 11083 - protein, 258 aa, Staphylococcus aureus subsp. aureus Mu50
MTNNKVALVTGGAQGIGFKIAERLVEDGFKVAVVDFNEEGAKAAALKLSSDGTKAIAIKADVSNRDDVFNAVRQTAAQFGDFHVMVNNAGLGPTTPIDTITEEQFKTVYGVNVAGVLWGIQAAHEQFKKFNHGGKIINATSQAGVEGNPGLSLYCSTKFAVRGLTQVAAQDLASEGITVNAFAPGIVQTPMMESIAVATAEEAGKPEAWGWEQFTSQIALGRVSQPEDVSNVVSFLAGKDSDYITGQTIIVDGGMRFR

SEQ ID NO: 11084 - protein, 381 aa, Staphylococcus aureus subsp. aureus Mu50
MLTEQEKDIIKQTVPLLKEKGTEITSIFYPKMFKAHPELLNMFNQTNQKRGMQSSALAQAVMAAAVNIDNLSVIKPVIMPVAYKHCALQVYAEHYPIVGENLLKAIQDVTGLEEHDPVIQAWAKAYGVIADVFIQIEKEIYDQMMWIGFKPFKITNIKQESEDIKSFTVETEEYDFSEFTPGQYITVDVSSDKLPYRAKRHYSIVSGEKNHLTFGVKRDVTTEHEGEVSTILHDEIKEGDMINLAAPVGGFVLENTTEPQLFLGSGIGVTPLVAMYEAASAKGLDTQMVQVAENEQHLPFKDNFNSIASHYDNAKLYTHLKDKQGYIGTEELQAFLANKPEIYICGGTKFLQSMIEALKSLNYDMDRVHYETFIPRLSVAV

SEQ ID NO: 11085 - protein, 304 aa, Staphylococcus aureus subsp. aureus Mu50
MTNKVVILGSTNVDQFLTVERYAQPGETLHVEEAQKAFGGGKGANQAIATARMQADTTFITKIGTDGVADFILEDFKAAHIDTSYIIKTTEAKTGQAFITVNAEGQNTIYVYGGANMTMTPEDVINAKDAIINADFVVAQLEVPIPAIISAFEIAKAHGVTTVLNPAPAKALPNELLSLIDIIVPNETEAELLSGIKVTNEQSMKDNANYFLSLGIKTVLITLGKQGTYFATKNQSQHIEAYKVNAIDTTAAGDTFIGAFVSRLNKSQDNLADAIDFGNKASSLTVQKHGAQASIPLLEEVNQV

SEQ ID NO: 11086 - protein, 613 aa, Staphylococcus aureus subsp. aureus Mu50
MSQFLTQLKDNVLVADGAIGTILYSEGLDTCPEAYNLSHPDKVERIHRSYIEAGADVIQTNTYGANFEKLKRFGLEDKVKAIHQAAVRIAKKAANKDTYILGTVGGFRGIKQEDISLQTILYHTEIQIDTLIEEGVDALLFETYYDLEELTNVISRTRKKYDIPIIAQLTASNTNYLVNGQAINEGLKQLVQCGANIVGLNCHHGPHHMQESFTHIELPEHAFLSCYPNASLLDIENSEFKYSDNAQYFGQVAQNLIREGVRLIGGCCGTTPEHIKFIKESIQTLKPVNDKKVIPIPTKALFNPSQNKVRQSLTSKVQERPTVIIELDTPKHLDTDRFFENIAKLDKANVDAVTLADNSLATVRISNIAAASLIKQYYNIEPLVHITCRDRNLIGLQSHLLGLSLIGVNEILAITGDPSKVGHLPGATNVYDVNSKGLTELALRFNQGINTDGDALKKRTHFNIAGAFNPNVRKLDGAVKRLEKKIESGMSYFITQPVYSKEKIIEIYHATKHLNKPFFIGIMPIASYKNALFLHNEVPGIKMSDEILQQFEAVKDDKAKTRELSLKLSKDLIDTVHEYFNGLYIITPFQNVEDSLELAAYSKSITAHKEAIL

SEQ ID NO: 11087 - protein, 488 aa, Staphylococcus aureus subsp. aureus Mu50
MWESKFAKESLTFDDVLLIPAQSDILPKDVDLSVQLSDKVKLNIPVISAGMDTVTESKMAIAMARQGGLGVIHKNMGVEEQADEVQKVKRSENGVISNPFFLTPEESVYEAEALMGKYRISGVPIVDNKEDRNLVGILTNRDLRFIEDFSIKIVDVMTQENLITAPVNTTLEEAEKILQKHKIEKLPLVKDGRLEGLITIKDIEKVIEFPNAAKDEHGRLLVAAAIGISKDTDIRAQKLVEAGVDVLVIDTAHGHSKGVIDQVKHIKKTYPEITLVAGNVATAEATKDLFEAGADIVKVGIGPGSICTTRVVAGVGVPQITAIYDCATEARKHGKAIIADGGIKFSGDIIKALAAGGHAVMLGSLLAGTEESPGATEIFQGRQYKVYRGMGSLGAMEKGSNDRYFQEDKAPKKFVPEGIEGRTAYKGALQDTIYQLMGGVRAGMGYTGSHDLRELREEAQFTRMGPAGLAESHPHNIQITKESPNYSF

SEQ ID NO: 11088 - protein, 213 aa, Staphylococcus aureus subsp. aureus Mu50
MLKRMRDDIKMVFEQDPAARSTLEVITTYAGLHAVWSHLIAHKLYNQKKYVAARAISQISRFFTGIEIHPGAKIGKRLFIDHGMGVVIGETCTIGDNVTIYQGVTLGGTGKERGKRHPDIGDNVLIAAGAKVLGNIKINSNVNIGANSVVLQSVPSYSTVVGIPGHIVKQDGVRVGKTFDHRHLPDPIYEQIKHLERQLEKTRNGEIQDDYII

SEQ ID NO: 11089 - protein, 680 aa, Staphylococcus aureus subsp. aureus Mu50
MEIFETILIFIAVVILSSFVHTFIPKVPLAFIQIFLGMLLFITPIPVQFNFDSELFMVTMIAPLLFVEGVNVSRVHLRKYIKPVMMMALGLVITTVIGVGLFIHWIWPDLPIGAAFAIAAILCPTDAVAVQAITKGKVLPKGAMTILEGESLLNDAAGIISFKIAVGVLVTGAFSLVDAVQLFLIASIGGAVVGLLIGMALVRFRLTLMRRGYENINMFTIIQLLTPFVTYLIAELFHASGIIAAVVAGLVHGFERDRIMQVRTQLQMSYNHTWNILGYVLNGFVFSILGFLVPEVIIKIIKTEPHNLIFLIGITIVVALAVYLFRFVWVYVLYPYFYLAISPFQKMMTKNDDDNPTTEKPPKRSLYALIMTLCGVHGTISLAIALTLPYFLAGHHAFTYRNDLLFIASGMVIISLVVAQVLLPLLTKPAPKTVIGNMSFKVARIYILEQVIDYLNQKSTFETSFKYGNVIKEYHDKLAFLKTVEKDDENSKELERLQKIAFNVETKTLESLVDEGQITNSVLENYMRYAERTQVYRQASLIRRMIVLLRGALLKRRVQTRVNSASSLSVTDNLMELNKINKLVHYNVVSRLSKETTKDNTLEIGMVCDGYLMRIENLTPSNFFNSASEDTITKIKLNALREQRRILRELIDTDEVSEGTALKLREAINYDEMVIVDSMT

SEQ ID NO: 11090 - protein, 279 aa, Staphylococcus aureus subsp. aureus Mu50
MLNEIQILNNGYPMPSVGLGVYKISDEDMTKVVNAAIDAGYRAFDTAYFYDNEASLGRALKDNGVDREDLFITTKLWNDYQGYEKTFEYFNKSIENLQTDYLDLFLIHWPCEADGLFLETYKAMEELYEQGKVKAIGVCNFNVHHLEKLMAQSSIKPMVNQIEVHPYFNQQELQEFCDRHDIKVTAWMPLMRNRGLLDNPVIVKIAEKYHKTPAQVVLRWHLAHNRIIIPKSQTPKRIQENIDILDFNLELTEVAEIDALDRNARQGKNPDDVKIGDLK

SEQ ID NO: 11091 - protein, 434 aa, Staphylococcus aureus subsp. aureus Mu50 [sequence omitted]

SEQ ID NO: 11092 - protein, 572 aa, Staphylococcus aureus subsp. aureus Mu50
MSKLIKGIAASDGVAIAKAYLLVEPDLTFDKNEKVTDVEGEVAKFNSAIEASKVELTKIRNNAEVQLGADKAAIFDAHLLVLDDPELIQPIQDKIKNENANAATALTDVTTQFVTIFESMDNEYMKERAADIRDVSKRVLSHILGVELPNPSMIDESVVIVGNDLTPSDTAQLNKEFVQGFATNIGGRTSHSAIMSRSLEIPAIVGTKSITQEVKQGDIIIVDGLNGDVIVNPTEDELIAYQDKRECYFADKKELQKLRDADTVTVDGVHAELAANIGTPNDLPGVIENGAQGIGLYRTEFLYMGRDQMPTEEEQFEAYKEVLEAMDGKRVVVRTLDIGGDKELSYLNLPEEMNPFLGYRAIRLCLAQQDIFRPQLRALLRASVYGKLNIMFPMVATINEFREAKAILLEEKENLKNEGHDISDDIELGIMVEIPATAALADVFAKEVDFFSIGTNDLIQYTLAADRMSERVSYLYQPYNPSILRLVKQVIEASHKEGKWTGMCGEMAGDETAIPLLLGLGLDEFSMSATSILKARRQINGLSKNEMTELANRAVDCATQEEVIELVNNYVK

SEQ ID NO: 11093 - protein, 325 aa, Staphylococcus aureus subsp. aureus Mu50
MAQMTMVQAINDALKTELKNDQDVLIFGEDVGVNGGVFRVTEGLQKEFGEDRVFDTPLAESGIGGLAMGLAVEGFRPVMEVQFLGFVFEVFDAIAGQIARTRFRSGGTKTAPVTIRSPFGGGVHTPELHADNLEGILAQSPGLKVVIPSGPYDAKGLLISSIRSNDPVVYLEHMKLYRSFREEVPEEEYTIDIGKANVKKEGNDISIITYGAMVQESMKAAEELEKDGYSVEVIDLRTVQPIDVDTIVASVEKTGRAVVVQEAQRQAGVGAAVVAELSERAILSLEAPIGRVAAADTIYPFTQAENVWLPNKNDIIEKAKETLEF

SEQ ID NO: 11094 - protein, 246 aa, Staphylococcus aureus subsp. aureus Mu50
MKMTKSALVTGASRGIGRSIALQLAEEGYNVAVNYAGSKEKAEAVVEEIKAKGVDSFAIQANVADADEVKAMIKEVVSQFGSLDVLVNNAGITRDNLLMRMKEQEWDDVIDTNLKGVFNCIQKATPQMLRQRSGAIINLSSVVGAVGNPGQANYVATKAGVIGLTKSAARELASRGITVNAVAPGFIVSDMTDALSDELKEQMLTQIPLARFGQDTDIANTVAFLASDKAKYITGQTIHVNGGMYM

SEQ ID NO: 11095 - protein, 325 aa, Staphylococcus aureus subsp. aureus Mu50
MKIFDYEDIQLIPNKCIVESRSECDTTIQFGPKKFKLPVVPANMQTVMNEKLAKWFAENDYFYIMHRFDEEARIPFIKHMQNSGLFASISVGVKKAEFDFIEKLAQEKLIPEYITIDIAHGHSDSVINMIKHIKNHIPDSFVIAGNVGTPEGVRELENAGADATKVGIGPGRVCITKIKTGFGTGGWQLAALNICSKAARKPLIADGGIRTHGDIAKSIRFGASMVMIGSLFAAHEESPGETVELDGKQYKEYFGSASEFQKGEHKNVEGKKMFVEHKGSLMDTLKEMQQDLQSSISYAGGKDLKSLRTVDYVIVRNSIFNGDRD

SEQ ID NO: 11096 - protein, 182 aa, Staphylococcus aureus subsp. aureus Mu50
MMNSSSPENPNGKKYSPVFIYSAIVVAIVVLLGAFLPEQFNYVTNNIKMWITEKLGWYYLILTTIIVFFCIFLIFSPIGKLKLGKPNDKPEFNTISWFAMLFSAGMGIGLVFYGAAEPMAHFATPPTADPKTTEAYTEALRSTFFHWGFHAWAVYGVVALALAYSQFRKGDQVYYLELYVLF

SEQ ID NO: 11097 - protein, 359 aa, Staphylococcus aureus subsp. aureus Mu50
MGIFIDVLSVFATIVGVAVSLGMGALQINGGLHYLFNVPNNTFVQAIIIIVVTILFIASAWSGLSKGIQYLSNLNIGLGTILMVAALIVGPTVLILNMLTSSTGSLLNTFLFNSFDTAALNPQKREWMSSWTLYYWGWWLSWSPFVGVFIARVSKGRSIREFISGVLLVPAIVSFVWFSVFGVLGIETGKKHKEIFDMTPETQLFGVFNHVPFGIVLSLIALLLIASFFITSADSATFVLGMQTTFGSLNPSSMVKVVWGISQALIAFVLLLAGGGNGAEALNAIQSAAIISAFPFSFVVILMMVSFYKDANQERKFLGLTLTPNKHRLQEYIKSQQEDYESDILEKRQSRRNIEKKDN

SEQ ID NO: 11098 - protein, 239 aa, Staphylococcus aureus subsp. aureus Mu50
MVQHLTAEEIIQYISDAKKSTPIKVYLNGNFEGITYPESFKVFGSEQSKVIFCEADDWKPFYEAYGSQFEDIEIEMDRRNSAIPLKDLTNTNARIEPGAFIREQAIIEDGAVVMMGATINIGAVVGEGTMIDMNATLGGRATTGKNVHVGAGAVLAGVIEPPSASPVIIEDDVLIGANAVILEGVRVGKGAIVAAGAIVTQDVPAGAVVAGTPAKVIKQASEVQDTKKEIVAALRKLND

SEQ ID NO: 11099 - protein, 421 aa, Staphylococcus aureus subsp. aureus Mu50
MTVKYNQNGELTMDGISLKTIAQSFGTPTIVYDELQIREQMRRYHRAFKDSGLKYNISYASKAFTCIQMVKLVAEEDLQLDVVSEGELYTALEAGFEPSRIHFHGNNKTKHEIRYALENNIGYFVIDSLEEIELIDRYANDTVQVVLRVNPGVEAHTHEFIQTGQEDSKFGLSIQYGLAKKAIDKVQQSKHLKLKGVHCHIGSQIEGTEAFIETAKIVLRWLKEQGIQVELLNLGGGFGIKYVEGDESFPIESGIKDITDAIKSEIKVLGIDAPEIGIEPGRSIVGEAGVTLYEVGTIKEIPEINKYVSIDGGMSDHIRTALYDAKYQALLVNRNEEADDSVTIAGKLCESGDIIIKDAKLPSSVKRGDYLAILSTGAYHYSMASNYNQMQKPSVFFLKDGKAREVIKRQSLRQLIINDTK

SEQ ID NO: 11100 - protein, 327 aa, Staphylococcus aureus subsp. aureus Mu50
MAKLSYLEAIRQAQDLALQQNKDVFILGEDVGKKGGVFGTTQGLQQQYGEDRVIDTPLAESNIVGTAIGAAMVGKRPIAEIQFADFILPATNQIISEAAKMRYRSNNDWQCPLTIRAPFGGGVHGGLYHSQSIESIFASSPGLTIVIPSTPYDAKGLLLSSIESNDPVLYFEHKKAYRFLKEEVPEEYYTVPLGKADVKREGEDLTVFCYGLMVNYCLQAADILAADGINVEVVDLRTVYPLDKETIIDRAKNTGKVLLVTEDNLEGSIMSEVSAIIAEHCLFDLDAPIMRLAAPDVPSMPFSPVLENEIMMNPEKILNKMRELAEF

SEQ ID NO: 11101 - protein, 368 aa, Staphylococcus aureus subsp. aureus Mu50
MSDNTVKIKKQTIDPTLTLEDVKKQLIEKGKKEGHLSHEEIAEKLQNFDIDSDQMDDFFDQLNDNDISLVNEKDSSDTDEKLNPSDLSAPPGVKINDPVRMYLKEIGRVNLLSAQEEIELAKRIEQGDEVAKSRLAEANLRLVVSIAKRYVGRGMLFLDLIQEGNMGLIKAVEKFDFNKGFKFSTYATWWIRQAITRAIADQARTIRIPVHMVETINKLIRVQRQLLQDLGRDPAPEEIGEEMDLPAEKVREILKIAQEPVSLETPIGEEDDSHLGDFIEDQEAQSPSDHAAYELLKEQLEDVLDTLTDREENVLRLRFGLDDGRTRTLEEVGKVFGVTRERIRQIEAKALRKLRHPSRSKRLKDFMD

SEQ ID NO: 11102 - protein, 277 aa, Staphylococcus aureus subsp. aureus Mu50
MEVKTFYNGNTMPQIGLGTFRVENDENCMESVKYAIEQGYRSIDTAKVYGNEEQVGAGIRAGLESTGIAREDLFITSKLYFEDFGRENVAAAYEASLSRLGLKYLDLYLVHWPGTNEAVMVDTWKGMEDLYKNNKAKNIGVSNFEPEHLEALLAQVSIKPVINQVEYHPYLTQHKLKLYLAAQHIVMESWSPLMNAQILNDETIKDIAQELGKSPAQVVLRWNVQHGVVIIPKSVTPNRISENFQIFDFELSDEQMTRIDGLNQDKRIGPDPKTFEG

SEQ ID NO: 11103 - protein, 354 aa, Staphylococcus aureus subsp. aureus Mu50
MLTVDQVKELVGEIKDPIIDVPLKETEGIVEVSIKEEKEHVSVKLAMAQLGGAPQLDLQMAVVNALKENGAKTVGIRFETLPEEKVNQFKPKEENKPKTIEGLLSQNNPVEFIAIASGKGGVGKSTVAVNLAVALAREGKKVGLVDADIYGFSVPDMMGIDEKPGIKGKEVIPVERHGVKVISMAFFVEENAPVIWRGPMLGKMLTNFFTEVKWGDIEYLILDLPPGTGDVALDVHTMLPSSKEIIVTTPHPTAAFVAARAGAMAKHTDHSILGVIENMSYFESKETGNKEYVFGKGGGTKLADELNTQLLGELPLEQPSWNPKDFAPSIYQSDDRLGKIYSSIAQKVIAATNK

SEQ ID NO: 11104 - protein, 520 aa, Staphylococcus aureus subsp. aureus Mu50
MKNKTVSLVFWVSLVICTIFVAFGAIFPKQLEKLTQNITTFIALHFSWYYLLLVLVILFVCVYILFSRYANITLGEEGEDPEFSLPSWFAMLFSAGMGIGLVFWTTAEPISHAFKLTPIHKAGTQSAINDAMQFSFFHWGIHAWAVYGIVALVFAYFSFHKGYPGLVSATLTPLLGEKAMRGPLGGAIDVLAVIATVTGVAATLGFGALQINEGLHFLFNVPSNFTMQVILIVIATILFTWSAWSGIDKGIKTLSNINMLLAFVVLIGLFIVGPTLYILNTFTNGLGNYIANFFSMSLRIPSGGQKFQWLQNWTIFYWAWWISWAPFVGIFIARVSKGRTIKEFILGVLFVPALVCFIFFAVFGASAIYLQDNHIADIAKAATETATFATLQHYPLGFVLSLITLLVIMIFFVTSADSATYVLGMLSSRGDINPKSFVKVSWGIIMALFAIIMIYTGGTQAIQNLLIIAALPFSVVIIAMIWSLLKSLSEEKPRNSNKVLIKHRDPDILEYRSSKHIDEN

SEQ ID NO: 11105 - protein, 282 aa, Staphylococcus aureus subsp. aureus Mu50
MNHIEISKDVKIPVLGFGVFQIPQEQTAEAVKEAIKAGYRHIDTAQSYLNETEVGQGIEASGIDRSELFITTKVWIENVNYEDTIKSIERSLQRLNLDYLDLVLIHQPYNDVYGSWRALEELKENGKIKAIGVSNFGVDRIVDLGIHNQIQPQVNQIEINPFHQQEEQVAALQQENVVVEAWAPFAEGKNQLFQNQLLQAIADKYNKSIAQVILRWLVERDIVVLAKSVNPERMAQNLDIFDFELTEEDKQQIATLEESNSQFFSHADPEMIKALTSRELDV

SEQ ID NO: 11106 - protein, 389 aa, Staphylococcus aureus subsp. aureus Mu50
MYKTKGGFQLTLQTLSLVVGFMAWSIIAPLMPFIKQDVNVTEGQISIILAIPVILGSVLRVPFGYLTNIVGAKWVFFTSFIVLLFPIFFLSQAQTPGMLMASGFFLGVGGAIFSVGVTSVPKYFPKEKVGLANGIYGMGNIGTAVSSFLAPPIAGIIGWQTTVRSYLIIIALFALIMFIFGDTQERKIKVPLMAQMKTLSKNYKLYYLSYWYFITFGAFVAFGIFLPNYLVNHFGIDKVDAGIRSGVFIALATFLRPIGGILGDKFNAVKVLMIDFVIMIIGAVILGISDHIALFTVGCLTISICAGIGNGLIFKLVPSYFSNEAGSANGIVSMMGGLGGFFPPLVITYVANLTGSSHLAFIFLAVFGCIALFTMRHLYQKEYGSLKHS

SEQ ID NO: 11107 - protein, 272 aa, Staphylococcus aureus subsp. aureus Mu50
MKRLENKVAVVTGASTGIGQASAIALAQEGAYVLAVDIAEAVSETVDKIKSNGDNAKAYNVDISDEQQVVDFVSDIKEQFGRIDVLFNNAGVDNAAGRIHEYPIDVYDKIMNVDMRGTILMTKMMLPLMMNQGGSIVNTSSFSGQAEDLYRSGYNAAKGAVINFTKSIAIEYGRDGIRSNAIAPGTIETPLVDKLTGTSEDDAGKTFRENQKWMTPLGRLGKPEEVAKLVVFLASDDSSFITGETIRIDGGVMAYTWPGEMLSDDSWKRTLE

SEQ ID NO: 11108 - protein, 199 aa, Staphylococcus aureus subsp. aureus Mu50
MTEKEKMLAEKWYDANFDQDLINERARAKDICFELNHTKPSDTNKRKELIDQLFQTTTDNVSISIPFDTDYGWNVKLGKNVYVNTNCYFMDGGQITIGDNVFIGPNCGFYTATHPLNFYHRNEGYEKAGPIHIGSNTWFGGHVAVLPGVTIGEGSVIGAGSVVTKDIPPHSLAVGNPCKVVRKIDNDLPSETLNDETIK

SEQ ID NO: 11109 - protein, 496 aa, Staphylococcus aureus subsp. aureus Mu50
MELLKHLSQRQYIDGEWVESTNKNTRDIINPYNQEVIFTVSEGTKEDAERAILAARRAFESGEWSQETAEKRGKKVRAIADKIKEHREALARLETLDTGKTLEESYADMDDIHNVFMYFAGLADKDGGEMIDSPIPDTESKIVKEPVGVVTQITPWNYPLLQASWKIAPALATGCSLVMKPSEITPLTTIRVFELMEEVGFPKGTINLILGAGSEVGDVMSGHKEVDLVSFTGGIETGKHIMKNAANNVTNIALELGGKNPNIIFDDADFELAVDQALNGGYFHAGQVCSAGSRILVQNSIKDKFEQALIDRVKKIKLGNGFDADTEMGPVISTEHRNKIESYMDVAKAEGATIAVGGKRPDRDDLKDGLFFEPTVITNCDTSMRIVQEEVFGPVVTVEGFETEQEAIQLANDSIYGLAGAVFSKDIGKAQRVANKLKLGTVWINDFHPYFAQAPWGGYKQSGIGRELGKEGLEEYLVSKHILTNTNPQLVNWFSK

SEQ ID NO: 11110 - protein, 540 aa, Staphylococcus aureus subsp. aureus Mu50
MKKEKVMDWTTFIGTVAVLLFAVIPMMAFPKASEDIITGINSAISDSIGSIYLFMGLAIFCFVMYIAFGKYGNVTLGKASDKPEFNTFTWAAMLFCAGIGSDILYWGVIEWAFYYQVPPNGAKSMSDEALQYATQYGMFHWGPIAWAIYVLPALPIGYLVFVKKQPVYKISQACRPILKGQTDKFVGKVVDILFIFGLLGGAATSLALGVPLISAGIERLTGLDGKNMILRSAILLTITVIFAISSYTGLKKGIQKLSDINVWLSFVLLAFIFIIGPTVFIMETTVTGFGNMLRDFFHMATWLEPFGGIKGRKETNFPQDWTIFYWSWWLVYAPFIGLFIARISKGRRLKEVVLGTIIYGTLGCVLFFGIFGNYAVYLQISGQFNVTQYLNTHGTEATIIEVVHHLPFPSLMIVLFLVSAFLFLATTFDSGSYILAAASQKKVVGEPLRANRLFWAFALCLLPFSLMLVGGERALEVLKTASILASVPLIVIFIFMMISFLIILGRDRIKLETRAEKLKEVERRSLRIVQVSEEEQDDNL

SEQ ID NO: 11111 - protein, 572 aa, Staphylococcus aureus subsp. aureus N315
MSKLIKGIAASDGVAIAKAYLLVEPDLTFDKNEKVTDVEGEVAKFNSAIEASKVELTKIRNNAEVQLGADKAAIFDAHLLVLDDPELIQPIQDKIKNENANAATALTDVTTQFVTIFESMDNEYMKERAADIRDVSKRVLSHILGVELPNPSMIDESVVIVGNDLTPSDTAQLNKEFVQGFATNIGGRTSHSAIMSRSLEIPAIVGTKSITQEVKQGDMIIVDGLNGDVIVNPTEDELIAYQDKRECYFADKKELQKLRDADTVTVDGVHAELAANIGTPNDLPGVIENGAQGIGLYRTEFLYMGRDQMPTEEEQFEAYKEVLEAMDGKRVVVRTLDIGGDKELSYLNLPEEMNPFLGYRAIRLCLAQQDIFRPQLRALLRASVYGKLNIMFPMVATINEFREAKAILLEEKENLKNEGHDISDDIELGIMVEIPATAALADVFAKEVDFFSIGTNDLIQYTLAADRMSERVSYLYQPYNPSILRLVKQVIEASHKEGKWTGMCGEMAGDETAIPLLLGLGLDEFSMSATSILKARRQINGLSKNEMTELANRAVDCATQEEVIELVNNYVK

SEQ ID NO: 11112 - protein, 225 aa, Arabidopsis thaliana
MASNQQSYKAGETRGKAQEKTGQAMGTMRDKAEEGRDKTSQTAQTAQQKAHETAQSAKDKTSQTAQAAQQKAHETAQSAKEKTSQTAQTAQQKAHKTMQAAKEKTSQAGDNVREGKDKAGSYLSETGEAIKNKAQDAAQYTKETAQGAAQYTKEAAEAGRDKTGGFLSQTGEHVKQMAMGAADAVKHTFGMATEEEDKEHYPGSTTTTTATTRTTDPTHQTYQRK

SEQ ID NO: 11113 - protein, 548 aa, Staphylococcus aureus subsp. aureus N315
MNSSSPENPNGKKYSPVFIYSAIVVAIVVLLGAFLPEQFNYVTNNIKMWITEKLGWYYLILTTIIVFFCIFLIFSPIGKLKLGKPNDKPEFNTISWFAMLFSAGMGIGLVFYGAAEPMAHFATPPTADPKTTEAYTEALRSTFFHWGFHAWAVYGVVALALAYSQFRKGEPGLLSRTLRPLLGDKVEGPIGIFIDVLSVFATIVGVAVSLGMGALQINGGLHYLFNVPNNTFVQAIIIIVVTILFIASAWSGLSKGIQYLSNLNIGLGTILMVAALIVGPTVLILNMLTSSTGSLLNTFLFNSFDTAALNPQKREWMSSWTLYYWGWWLSWSPFVGVFIARVSKGRSIREFISGVLLVPAIVSFVWFSVFGVLGIETGKKHKEIFDMTPETQLFGVFNHVPFGIVLSLIALLLIASFFITSADSATFVLGMQTTFGSLNPSSMVKVVWGISQALIAFVLLLAGGGNGAEALNAIQSAAIISAFPFSFVVILMMVSFYKDANQERKFLGLTLTPNKHRLQEYIKSQQEDYESDILEKRQSRRNIEKKDN

SEQ ID NO: 11114 - protein, 368 aa, Staphylococcus aureus subsp. aureus N315
MSDNTVKIKKQTIDPTLTLEDVKKQLIEKGKKEGHLSHEEIAEKLQNFDIDSDQMDDFFDQLNDNDISLVNEKDSSDTDEKLNPSDLSAPPGVKINDPVRMYLKEIGRVNLLSAQEEIELAKRIEQGDEVAKSRLAEANLRLVVSIAKRYVGRGMLFLDLIQEGNMGLIKAVEKFDFNKGFKFSTYATWWIRQAITRAIADQARTIRIPVHMVETINKLIRVQRQLLQDLGRDPAPEEIGEEMDLPAEKVREVLKIAQEPVSLETPIGEEDDSHLGDFIEDQEAQSPSDHAAYELLKEQLEDVLDTLTDREENVLRLRFGLDDGRTRTLEEVGKVFGVTRERIRQIEAKALRKLRHPSRSKRLKDFMD

SEQ ID NO: 11115 - protein, 520 aa, Staphylococcus aureus subsp. aureus N315
MKNKSVSLVFWVSLVICTIFVAFGAIFPKQLEKLTQNITTFIALHFSWYYLLLVLVILFVCVYILFSRYANITLGEEGEDPEFSLPSWFAMLFSAGMGIGLVFWTTAEPISHAFKLTPIHKAGTQSAINDAMQFSFFHWGIHAWAVYGIVALVFAYFSFHKGYPGLVSATLTPLLGEKAMRGPLGGAIDVLAVIATVTGVAATLGFGALQINEGLHFLFNVPSNFTMQVILIVIATILFTWSAWSGIDKGIKTLSNINMLLAFVVLIGLFIVGPTLYILNTFTNGLGNYIANFFSMSLRIPSGGQKFQWLQNWTIFYWAWWISWAPFVGIFIARVSKGRTIKEFILGVLFVPALVCFIFFAVFGASAIYLQDNHIADIAKAATETATFATLQHYPLGFVLSLITLLVIMIFFVTSADSATYVLGMLSSRGDINPKSFVKVSWGIIMALFAIIMIYTGGTQAIQNLLIIAALPFSVVIIAMIWSLLKSLSEEKPRNSNKVLIKHRDPDILEYRSSKHIDEN

SEQ ID NO: 11116 - protein, 192 aa, Mus musculus
MASKGPSASASTENSNAGGPSGSSNGTGESGGQDSTFECNICLDTAKDAVISLCGHLFCWPCLHQWLETRPNRQVCPVCKAGISRDKVIPLYGRGSTGQQDPREKTPPRPQGQRPEPENRGGFQGFGFGDGGFQMSFGIGAFPFGIFATAFNINDGRPPPAVPGTPQYVDEQFLSRLFLFVALVIMFWLLIA

SEQ ID NO: 11117 - protein, 248 aa, Homo sapiens [sequence omitted]

SEQ ID NO: 11118 - protein, 117 aa, Homo sapiens
CIENVSRQNCPICLEDIHTSRVVAHVLPCGHLLHRGYRCPLCMHSALDMTRYWRQLDDEVAQTPMPSEYQNMTVDILCNDCNGRSTVQFHILGMKCKICESYNTAQAGGRRISLDQQ

SEQ ID NO: 11119 - protein, 521 aa, Aphanothece halophytica
MTIEAAMGEEAIKENLEQFLIVLSVSLGVATLSQISSFFRQIPYTLLLVIVGLGLAFVDIRLVNLSPELILEIFLPPLLFEAAWNIRWRNLKKNLFPVVLLAIIGVVISVVGIGFSLNYFSGLSLPIALLVGAILAATDPVSVIALFRELGVGERLTVLMEGESLFNDGVAVVAFSLLVGIPLGTQEFSVTNTLIQFVTLQGIGIGCGGVIGFGISYLTQRFDLPLVEQSLTLVSAYGTYLITEELGGSGVIGVVTVGLILGNFGSRIGMNPRTRLLVSEFWEFIAFFVNSIVFLLIGDQINIRGLADNGQLILITIIALVIIRAISIYGLGTISNLITKQDISWQEETVLWWGGLRGSVSIALALSVPVMLDGRQDIIEAVFGVVLFTLLVQGLTMQTVIEKLGLIGDRAQRRTYSELIARRSALERVLAHLNAVPPSPSIRMKSLKTTKEASKGQLESRQTKKLRSYNNSYPQLRSLEQEQLRELTFKVEADTYAELIRAGKLNNNLSPLLQEVLAKPE

SEQ ID NO: 11120 - protein, 627 aa, Caenorhabditis elegans
MSYVGAECEEEEKEYPSRYPIAYFEWENVKIPMTICLWLIGASIAKIIFNLIPHLNELFPDSALLIMIGLIIGIIFKLIGVNKNAFFLESEVFMLYLLPPLVFDAGYFMPARQFFDNFGSILCFAMIGTSFNIVAIALSLWAISLTGLFSVETPLMHMLLFGSVAADVDPVAVIVIFEELKVNEVLFIAVFGESLLNDGVAVVLYRMFLTFSEIGTENLITSDYINGGVSFLVVAFGGIGIGLLFAFLTSLVTRFARDEEVKVLNSVFILILPYTCYLCGELFGLSSIMAIVFCGAAMRQYCRENVDPDTVKATESFIKVLSLASETVIFVFLGLSTVSSNHHWDTSFIVLTVVFCLIYRTLGVVVMCYFLNKYRLNKYTKVDQFIMAYGGLRGAIAYGLVVAIPDFIPGKNMFVTSCIIVIYFTVFLQGITLKPIAEFLQVEKKNVHSKNMIEHIYSELIDTTMAGMEDIAGFKGHHWIRDSWNALNNNYLRPILVNKNNMKEMDKTKLVRKYKHLVDEDAKKIARGDLNSNMVFTKALIEHTRSRTNTMIDGVSSTSKIDFTKHMKENFGVTVYDDHSTVPMTPTHLFQETTEVEYSVRSEINDNDGFENDGYESDESGSFHERV

SEQ ID NO: 11121 - protein, 466 aa, Sinorhizobium meliloti
MSATQDYIVADIGLADFGRKEIAIAETEMPGLMACREEFGASKPLKGARITGSLHMTIQTAVLIETLVALGAEVRWASCNIFSTQDHAAAAIAASGVPVFAVKGETLEEYWTYTDKIFQWADGGVSNMILDDGGDATMYILLGARAEAGENILTNPGSEEEEILFAQIKKRLAATPGWFTRQRDAIKGVTEETTTGVNRLYQLQAKGLLPFPAINVNDSVTKSKFDNKYGCKESLVDGIRRGTDVMMAGKVAVVCGYGDVGKGSAASLSGAGARVKVTEVDPICALQAAMDGYEVVQLEDVVSSADIFITTTGNKDVIRIEHMRAMKDMAIVGNIGHFDNEIQVSALRNLKWTNVKPQVDLIEFPKGNRIILLSEGRLLNLGNATGHPSFVMSASFSNQVLAQIELFTKGEQYKNEVYVLPKQLDEKVARLHLAKLGAKLTELSEEQASYIGVKQQGPFKAEHYRY

SEQ ID NO: 11122 - protein, 330 aa, Sinorhizobium meliloti
MAKYDVLTIGNAIVDIIARCDDSFLEENGIIKGAMNLINADRAELLYSRMGPAVEASGGSAGNTAAGVASLGGRAAYFGKVADDQLGEIFTHDIRAQGVHFQTKPLDGHPPTARSMIFVTEDGERSMNTYLGACVELGPEDVEDDVVAQSKVTYFEGYLWDPPRAKDAIREAARIAHAHGRETAMTLSDSFCVHRYRSEFLELMRSGTVDIVFANRQEALALYETEDFDRALELLARDCKLAAVTLSEEGSVVVRGAERVRVGASVLEQVVDTTGAGDLYAAGFLFGYTSGRSLEECSKLGNLAAGIVIGQIGPRPLVSLATAARQAALV

SEQ ID NO: 11123 - protein, 256 aa, Sinorhizobium meliloti
MSRLEGKIAIVTGASSGIGRAAALLFAREGAKVVVTARNGNALAELTDEIAGGGGEAAALAGDVGDEALHEALVELAVRRFGGLDTAFNNAGALGAMGEISSLSVEGWRETLDTNLTSAFLAAKYQVPAIAALGGGSLTFTSSFVGHTAGFAGVAPYAASKAGLIGLVQALAVELGARGIRVNALLPGGTDTPANFANLPGAAPETRGFVEGLHALKRIARPEEIAEAALYLASDGASFVTGAALLADGGASVTKA

SEQ ID NO: 11124 - protein, 196 aa, Sinorhizobium meliloti
MHILMVLAHPLEESFAASVARIARETLEARGHTVDLLDLYREGFDPRLTVAERGSYFDKDYDASGVSPWIERLRAADGLVLVFPQWWFNFPAILKGFFDRVFAPGVAFDHDAAGGRIVPRLRNIRLFWALTSTGSPWWVVHLYMGNPVRRLLKRGIAAFCGKGLDFRMVTLHDMDRVTEAKRKRHIERVRALVSRI

SEQ ID NO: 11125 - protein, 290 aa, Sinorhizobium meliloti
MGTRSTEILLTAIAPAIWGSTYLVTTEFLPAGYPVTVAMLRALPAGLLLLLVVRQMPTGVWLARSFVLGALNFSFFQTMLFVSAYRLPGGVAATVGAIQPLIVIVLSRIVLGSPARALSVVAGIAGMAGVALLVLTPKAALDPVGVAAGLAGAVSMAFGTVLSRHWTPPVSPLTFTAWQLAAGGLLLVPVTFLLEPSLPPLTAANIMGFTYLGLIGTAFTYLLWFRGLSRLEPSQVSPLGFLSPVVAILIGWGVLDQQLTAVQVLGIATVFASVWMSQYAQTARRAAAAP

SEQ ID NO: 11126 - protein, 401 aa, Sinorhizobium meliloti
MTLSGKRILLIISGGIAAYKSLDLIRRLRERGADVRPVMTAAAQRFVTPLTVGAISASHVFTELFAREDEQDVGHIRLARHCDLVVVAPATADLMAKMAHGHADDLASTVLLATDRPVLLAPAMNPRMWSHPATLRNRATLAGDGVRFVGPATGEMAESGEAGEGRMAEPLEIVAAVEELFSEARPLAGRKAIVTSGPTHEPIDPVRYIANRSSGKQGHAIAAALARLGAEVTLVSGPVTIADPAGVRVVRVERAEEMRDAVLAALPADVAVMVAAVADWRVASTAGNKIKKRPGEAPPPLQLAENPDILKTVGHYASRPRLVIGFAAETENVAENGRAKLQKKGADYILANDVSPATGIMGGDRNRVKLIGRDGTEEWPEMGKDDVAAKLAALIVAKLSS

SEQ ID NO: 11127 - protein, 730 aa, Sinorhizobium meliloti
MNLGAAVIRQRRPLGDPSAGGARVAYALAGIVAAMLLLAVGAGAGLHLLPAIIAAGGLVGAFLLLSGRDEASGKRVAGAGETAQDPARHGIETAALLATIHDAMGDLAIVRDLDGKIMQANGAFHELCGCADARGLTCAELGLRFEPKTGPDRYFVHIYTPSGTRLYDWHDVLVRDPARGRPMRHSIARDVTEEMLAASQREEARRRAEEASRAKSRLLATVSHEIRTPLSGILGMSRLLAETRLSEEQKNYLAGMQQSGHTLVQLVEDLIDFSSLAVGRFQLRPSQEDLRQTVENVVEMLSPRAHEKNIEIGATVAIEVPERMLFDAARLRQVLFNVVGNAVKFTEKGGVFVSVDIENGSVRIRIDDSGPGMSADELARVFEEFEQAGDDAQRAKGTGLGLAISRRIMEAFGGSLTATSMSGKGSRFEIRFPMAGAGLSGVPVRRGILAGAQVLVMAPEGPSSAALAATIETLGGTCHRASTLAVAGRVVAGALGNRLPLTDVIVDHRHAAQFRELLALEPAIAGLRLRRTYLISPEERTSHPVSRLGGYEAWLIRPLRERSLVEVLLGRLRGMEKRDAINDNRPVLREEPTATVMTSDVRGILLAEDDPVNALVLRSLLSRAGRAVDHVGDFKALEAALRSAGSAPPPLIVTDLNMPGGDGLDVLRRLREAEAAGGRRRVPVLVLTADARGDLDERLRAAGADAVLAKPADPQRLLAEVTRLMDPVAK

SEQ ID NO: 11128 - protein, 449 aa, Sinorhizobium meliloti
MFNRRQLLGASAALVSTAAWAKTSNMGLPEAAIMETAETQAPVRPASGPDYNPVVTVNGWTAPHRMNSGVKEFHLVAEPVEREMAEGMTAYLWGYNGQSPGPTIEAVEGDRVRIFVTNKLPEPTTIHWHGMILPSGMDGVGGLSQPHIPPGKTFVYEFDLVKSGTFMYHPHSDEMVQMAMGMMGFFVIHPKDPKFMPVDRDFVFLLNAYDIEPGSYVPRVMEMTNFNMWCWNSRIFPDISPLVVSKNDRVRVRVGNLTMTNHPIHMHGYDFEVTCTDGGWVRPEARWPEVSIDIPVGAMRAYEFDAKYAGAWAIHCHKSHHTMNAMGHDIPTFIGVDKKEVAQKIRKVRPEYMPMGTAGMSDMGKMEMELPENTIPMMTGWGPHGPIEMGGMFSVVKVREGISADDYSDPGWYENPPGTQAWEWTGELPDWTRADNAKTQITPKHSKHG

SEQ ID NO: 11129 - protein, 1134 aa, Sinorhizobium meliloti
MPERQYPFIDIAVHARVREHFARGDASVLFSKNVARVLWANDQGAKLFGTTSVYDFIDTDLDPSDLSLRQLRAAAAQLAAVGDRRQLLIRMASGFRRLPLNAAVELIRIGPGEEAILFTVPNNGKALSTEARAEAMIAGLDGPDTHMAVLDADGTVIAGSPGFESLGLSADIRRTLVAAAASDKDRLIKRPVATEKGRLPAAVGKISDHPALHLLFAVEAILEKSETGEAVGAAAAEQAIPAAPAAPAETREAVPSSAAPAETEQPAGRLEEAEPAPSPEAAAPAEHEASVGDGTDDEAQGELAPQDEAEAADLAEPETPLEAEPASGEPAADADRGGETADFAFAAGGRAVRFVWKIDAEGRFSEISEEFASAVGPKAADVIGVSFTDLADRYDLDPDDKINELLHRRDTWSGKTIFWPVQGTNLKVPVDLAALPTYSRSREFDGFRGFGIVRIADAVPDAKAAGLALDRPAPAQIAQASSDMSAEGAGAPQAEAGSKTGPDAGSGKDAAEAAPDVSEDPFRGEQPALRVVETPGRQASDKVIDLDERRPAGAGALTRGEQAAFREIARQLGEHFAPDQLPQEGKAEGRHEADTPPITPADTEESRQTEEAEAPGGWHDATPAGETPAAAMEPGLTARNGAAMSSEILDRLPVALLVHHGDALLHANAEFLRLTGYENLEAFEQEGGLEALFALGNEAGAAKPNGTMTLVRKDGRLIPVGAHLHSIRWEGKSALMLALTPAGASEAEKQAREDEGAAEASRLRMEIDELRSILETATDGVVVLGRDGDIRTMNRSASALFDYDEADMRGKPFAALFAHESQKAVIDYLQGLSGHGVASVLNDGREVIGREAAGGFIPLFMTIGRLSSSNGYCAVIRDITQWKRTEEELRNAKRAAETANAHKTEFLARVSHEIRTPLNAIIGFSDMMASEHFGPIGHPRYIEYAGDIGRSGRHVLDIVNDLLDISKIEAGEMDLDFGAVDLNEAVSEAVSLVQPQANSQRVIIRTSLSGSVPEVVADDRSIKQIALNILANAIRFTPSGGQIVVSTSYEANGSVILRIRDTGIGMTRNELDQAMKPFRQVTTGGRKRGDGTGLGLPLTKAMAEANRAQFAITSAPNEGTLVEISFPSQRVLAN

SEQ ID NO: 11130 - protein, 500 aa, Sinorhizobium meliloti
MARIIETATGLEALTFDDVLLQPGHSEVMPGQTNIATRIAQDIELNLPILSAAMDTVTEARLAIAMAQAGGIGVIHRNLTPAEQAEEVRQVKKFESGMVVNPVTIGPDATLADALGLMKAHGISGIPVVENGGLGGQTQGRLVGILTNRDVRFASDPSQKIYELMTRENLITVKESVDQQEAKRLLHKHRIEKLLVVDPEGRCVGLITVKDIEKSQLNPNAAKDAQGRLRAAAAVSVGDDGFERAERLIDAGVDMIVVDTAHGHSQRVLDAVARVKKLSNSVRIMAGNVATGDGTKALIDAGADAVKVGIGPGSICTTRIVAGVGVPQLAAIMAAVDAAQAAGIPIIADGGIKFSGDVAKAIAAGASAVMIGSLLAGTEESPGEVFLYQGRSFKAYRGMGSVGAMARGSADRYFQAEVRDTLKLVPEGIEGQVPYKGPVSGVLHQLAGGLRASMGYVGGATIKDYQERATFVRISGAGLRESHAHDVTITRESPNYPGGA

SEQ ID NO: 11131 - protein, 149 aa, Sinorhizobium meliloti
MAETARFMQAALQEARKAAARGEVPIGAVVVLDGKMIAAAGNRTRELNDITAHAEIEAIRHAAAAVGDERLSGADLYVTLEPCTMCAAAISFARIRRLYYGAEDPKGGAVDNGVRFYASPTCHHVPDVYSGLAEREAADILREFFAGRR

SEQ ID NO: 11132 - protein, 384 aa, Sinorhizobium meliloti
MPDVTREMVLEKLRTVRGPDMEGNIVDLGLVSDVFISDGKAYFSITVPADRAKELEPMRAAAERVVREIPGVNAAMVALTADRKAAPQKAPVERPRPAPTGHAPAQRAGGGGAPKAGIPGVGAIIAVASGKGGVGKSTTSVNLALALQANGLKVGLLDADIYGPSMPRLLKISGRPQQIEGRLIRPMENYGLKVMSMGFLVDEEVAMIWRGPMIQSALLQMLREVAWGELDVLVVDMPPGTGDAQLTMAQQVPLAGAVIVSTPQDLALVDARKGLAMFRKVEVPVLGIVENMSYFVAPDTGRRYDIFGHGGARKEAERIGVPFLGEVPLTMGIRETSDAGTPLVASEPDGEVARVYRDIAARVWGEVTAARQDKSRAMPSIVFE

SEQ ID NO: 11133 - protein, 645 aa, Sinorhizobium meliloti
MTQLPTNPMPATPLLDKVDYPDDLKKIDDRDLPQLAAELRAEMVDAVSRTGGHLGAGLGVVELTIAIHKIFDTPHDRLIFDVGHQCYPHKILTGRRDRIRTLRQEDGLSGFTRRAESEYDPFGAAHSSTSISAGLGMAVAAELDGKSRNVIAVIGDGAMSAGMAFEALNNAGALDARLIVILNDNDMSIAPPTGAMSAYLARLASGRTYMGIREVGKKLTAYLGKTVDRAITRAVEHARGYVTGGTLFEEMGFYHIGPIDGHSFDHLLPVLRNVRDNAKGPVLIHVVTQKGKGYPPAEAAADKYHGVNKFDVITGAQAKAKPNAPAYTSVFADALTQEASLDDKIVAITAAMPSGTGLDKFASVHPSRCFDVGIAEQHAVTFAAGLAAEGYKPFAALYSTFLQRAYDQVVHDVAIQGLPVRFPIDRAGFVGADGPTHAGSFDTTYLATLPGFVVMAAADEAELKHMVRTAAAYDEGPISFRYPRGEGVGVELPERGEILAIGKGRIVKQGNKVALLSFGTRLADCLLAAEDLDAAGLSTTVADARFAKPLDHDLIRQLARHHEVLITIEEGAVGGFASHVLQFLAEEGLIDGGLKVRPMVMPDIWMEQAKPEAMYARAGLDRAGIVSTVFKALGQKHGVGLGAAG

SEQ ID NO: 11134 - protein, 307 aa, Sinorhizobium meliloti
MSFFPGPDPLAGDKPACDAIEHLIIPRTSDIGGLQVRRALPTAKRRLVGPFIFFDRMGPALLRAGQAIDVRPHPHIGLSTVTYLFDGEIKHRDSLGTEMVIRPGDVNLMTAGRGIVHSERSPENQRGHERSLSGLQTWLALPDAMEEIDPVFAHTEERMLPHLADGGVRARVVIGQFEGAASPVSTFTDTIYVDLMIEPGKSAPFAANWEERALYILSGEAIIAGDHFDNNQLLVFRPGDEITITAGPAGCHVMLFGGAALGSPRHIWWNFVSSSKERIDKAKEEWRTGRFDIVPGDEEEFIPLPAS

SEQ ID NO: 11135 - protein, 898 aa, Sinorhizobium meliloti
MAKWVYTFGAGQAEGSAEDRDRLGGKGANLAEMCNLGLPVPPGLTIVTAACNSYLEKGRSMPEGLREQVREGITRMEKITGRVFGDTNRPLLLSVRSGARASMPGMMDTVLNLGLNDQSVHALGHDAGDARFAWDSYRRFIQMYGDVVMGVDHEVFEEVLEDEKARLGHEQDTELSAVEWQHVISRYKEAIEEVLGLPFPQDPEVQLWGAIGAVFSSWMNPRAITYRHLHGIPAGWGTAVNVQAMVFGNLGNSSATGVAFTRNPSTGEKELYGEFLVNAQGEDVVAGIRTPQNITEAARIASGSDKPSLEKLMPEAFAEFEKICNALERHYRDMQDIEFTIERGKLWMLQTRSGKRTAKSALKIAVDMAEEGLISKEEAVARIDPASLDQLLHPTIDPHARRDIIGSGLPASPGAATGEIVFSSDEAVQAVKEGRKVILVRVETSPEDIHGMHAAEGILTTRGGMTSHAAVVARGMGTPCVSGAGSIRVDQRNELLIAASVTLRKGDVITIDGSSGQVLKGEIPMLQPELSGDFGKIMQWADASRRMTVRTNAETPADARAARSFGAEGIGLCRTEHMFFEDDRINVMREMILAEDEAGRRTALAKLLPMQRSDFVELFSIMHGLPVTIRLLDPPLHEFLPKTDEEIAEVARVLTIDPAELRQRVDALHEFNPMLGHRGCRLAISYPEIAEMQARAIFEAAVQAAHDTGAAVVPEIMVPLVGLRAELDYVKARIEAVAKEVIGEAGVNIDYLIGTMIELPRAALRADTIAESADFFSFGTNDLTQTTFGISRDDAALFLATYQQKGIIEQDPFVSLDFEGVGELIQIAAERGRRTKNGLKLGICGEHGGDPASIRFCEEAGLDYVSCSPFRVPIARLAAAQATINGREVAEVQALAAS

SEQ ID NO: 11136 - protein, 487 aa, Sinorhizobium meliloti
MRAQPKASHFIDGEYVEDAAGTVIESIYPATGEIIARLHAATPGIVEKAIAAAKRAQPEWAAMSPTARGRILKRAAELMRQRNRELSELETLDTGKPIQETIVADPTSGADSFEFFGGVAPAALNGDYIPLGGDFAYTKRVPLGVCVGIGAWNYPQQIACWKGAPALVAGNAMVFKPSENTPLGALKIAEILIEAGLPKGLFNVIQGDRATGPLLVNHPDVAKVSLTGSVPTGKKVAGAAAAELKHVTMELGGKSPLIVFDDADLESAIGGAMLGNFYSTGQVCSNGTRVFVQRKIKEPFLARLKERTEAIVIGDPLDEATQLGPMVSAAQRDKVFSYIGKGKAEGARLVTGGGIPNNVSGEGTYIQPTVFADVTDGMTIAREEIFGPVMCVLDFDDEVEVIARANATEFGLSAGVFTADLTRAHRVADRLEAGTLWINTYNLCPVEIPFGGSKQSGFGRENSVAALNHYTELKTVYVGMGPVEAPY

SEQ ID NO: 11137 - protein, 275 aa, Sinorhizobium meliloti
MHAVSSNGANIPALGFGTFRMSGAEVLRILPQALKLGFRHVDTAQIYGNEAEVGEAIQKSGIPRADVFLTTKVWVDNYRHDAFIASVDESLRKLRTDHVDLLLLHWPGSDVPMAERIGALNEVRNAGKVRHIGISNFNTTQMEEAARLSDAPIATNQVEYHPYLDQTKVLQTARRLGMSLTSYYAMANGKVPADPLLTEIGGRHGKTAAQVALRWLVQQQDVIVLSKTATEARLKENFAIFDFALTREEMAAVRELARPNGRIVNPQGLAPEWDA

SEQ ID NO: 11138 - protein, 525 aa, Sinorhizobium meliloti
MAGRWTSLVDEAAAPWLPRGGLGSAIARHDFRRLRAVAAVSLTALPIVPLALTLALPVSAALPAGAALWASASLLAAAAAIAGGREFPTDGEVEFAPAPELPDLNAAYDLFAGLVTVHDTRGHVLSVHGRDASEYLKLMRDPHGRGFIEQIHVSDRIAFLRAIDSLRLDSERSAVDIRLERTSADGPQFAHIYCEMTPLRDAEGNLLAIVAQSRDVSEEARLQAEAAAKAAHAESANDAKTRFLAAVSHELRTPLNAILGFSDVLAGEYFGKLENDRQREYVSLIHQSGTHLLSVVNTMLDMSKIEAGRYELLLEPFRVAEAIAACEAMLSHQAREKGVRLTSRVTRSVGEINADQRAFQQILINLIGNAIKFTDRGGLVTVDAALEGNMLKLTVSDTGIGIAADKLQMLGQPFVQIQNDYTRRYEGTGLGLSLVKGLAELHGGDVSIRSAEGEGTVIVVTIPSDASGAAERQCADAPVTVEFPPRLKQHADGKREAGVPALSEALHTGEIGREGGHGAAQAKTA

SEQ ID NO: 11139 - protein, 772 aa, Sinorhizobium meliloti
MADARRGSAAEGRLRLKFPGFSGLEREFIEQAKIFAEPASQKLAMAEPMLKRSIPVLIIAFLLIVAISRMSGIMDEHARMEASSRRTVSLAAAAAAGVFQTGGSELFAEGRRWEVERRLTEFLPAEILDAGIFLLTVRRDGRVFAGTQDGVHLIGRTLSAIAPEVATLQYYGEGASVVRASIDGTEHFIALRQLPDSGGAVLAATSIARFEAAWRDEISLNVTLFAGVSAILMVVLYAYYIQAKRTRDADAVFAESNLRVETALSRGRCGLWDFDLDNRRLFWSRSMYEMLGMQGDASVLSFGDAARLMHVEDRGIYRVARAIAKGNERQIDQVFRMRHADGHYVWLRARAQVIRTVSGRTHLIGIAMDVTEQHRLAQRYAEADQRLADAIECTSEAFVLWDKHDRLVMCNTHYQQAWQLPDHVLVPGTERTIVHAAAARPVVERRIADPDRSNHSQTSEVQLADERWLQINERRTRDGGLVSVGTDITLLKRHQVRLRESERRLMATIGDLSASRVTLEQQKAELSIANANYQAEKERAEAANRAKSEFLANMSHELRTPLNAILGFSEILQDQMFGPLGSEKYHEYSRDIFESGKHLLNVINDILDMSKIEAGHMRITRERIDLAPLIEETLRFTTIPAERKNIRVVQQISSGLTMFADRRAMKQVLLNLLSNAVKFTNEGGRISLRARKVRGAVTLTIADSGIGIPKGALQKIGQPFEQVQSQYAKSKGGSGLGLAISRSLTRLHGGTMKIHSAENVGTIISVRIPDRG

SEQ ID NO: 11140 - protein, 245 aa, Sinorhizobium meliloti
MFDLSGRKALVTGASGGIGEEIARMLHAQGAVVGLHGTRVEKLETLANTLGERVQIFPANLSDRAEVKALGEKAEADLGGVDILVNNAGITKDGLFVRMSDEDWDNVIEVNLTAVFRLTRELTHPMMRRRFGRIVNITSVVGVTGNPGQANYCASKAGMIGFSKSLAQEIATRNVTVNCVAPGFIESAMTGKLNDKQKEGIMSAIPMRRMGSGAEVASAVAYLASNEAGYVTGQTIHVNGGMAMI

SEQ ID NO: 11141 - protein, 464 aa, Sinorhizobium meliloti
MLNRRMFLQGSAALGGAFTLGAGLAARAGAAPDPQILTARFAEAQIAAGGVTPRVMTYDPGDPASTAMPPVLRMRKGEPFAARLVNRLDEPTTVHWHGLRIANAMDGVPEMTQPYVYPGDGFDYLFTPPDAGTFWYHPHCNTLMQMGSGLTGVIVVENPEDPSFDSEIVLNLRDWRLGASGEFIAPFKPRDAARGGTYGTVRTANWQREPVYDAPAGGLVRVRIAATDVTRIYTIGLEGAEARVIALDGNPVEIPFALDRLDLGPGQRVDLALRMPQSEGQHARLGNFRGSSPWTIAAFRAVGTSLKRELGDIAPLPPNPVAEADISTAKRIPIDLTATAEHEPAASICGSLGYTFWAINKVPWPGDTPDPVAPIEELKFGKSYVLEIANRTPHAHPIHLHGLSFRILASNRRSVLPPPTDTILLLPDEQAQLALVADNPGDWVFHCHIIEHQKTGMSAYFRVA

SEQ ID NO: 11142 - protein, 375 aa, Sinorhizobium meliloti
MDVRAAVALEAGKPLEVMTVQLEGPRAGEVLVEVKATGICHTDDFTLSGADPEGLFPAILGHEGAGIVVDVGPGVTSVKKGDHVIPLYTPECRSCPSCLSRKTNLCTAIRATQGQGLMPDGSSRFSINGDKIHHYMGCSTFSNFTVLPEIALAKVNPDAPFDKICYIGCGVTTGIGAVINTAKVEIGATAIVFGLGGIGLNVIQGLRLAGADMIIGVDLNNDKKPWGEKFGMTHFVNPKEVGDDIVPYLVNLTKRGADQIGGADYTFDCTGNTKVMRQALEASHRGWGKSVIIGVAGAGQEISTRPFQLVTGRTWMGTAFGGARGRTDVPKIVDWYMEGKIEIDPMITHTMPLEDINKGFELMHSGESIRSVVLY

SEQ ID NO: 11143 - protein, 424 aa, Sinorhizobium meliloti
MTAIIDIIGREILDSRGNPTVEVDVHLEDGSFGRAAVPSGASTGAHEAVELRDGGTRYLGKGVERAVDAVNGEIFEAIGGLDAENQIQIDRTMIELDGTPNKSRLGANAILGVSLAVAKAAAEASGLPLYRYVGGPNAHLLPVPMMNIINGGAHADNPIDFQEFMIMPVGAETLKDAVRMGSEVFHTLKKQLAADGHNTNVGDEGGFAPGLASAPAALDFIMKSIEKAGYKPGEDMYVALDCASTEFFKDGKYVLEGEGRTLEPGAMAEYLAELAGKYPIISIEDGMAEDDWDGWKSLTDLVGNKCQLVGDDLFVTNSARLRDGIKMGVANSILVKVNQIGSLSETLDAVETAHKARYTAVMSHRSGETEDSTIADLAVATNCGQIKTGSLARSDRLAKYNQLIRIEEQLGPQAQYAGRSVLRG

SEQ ID NO: 11144 - protein, 460 aa, Sinorhizobium meliloti
MPVEILMPALSPTMEEGTLSKWLKNEGDKVSSGDVIAEIETDKATMEVEAVDEGTIGKLLIAAGTEGVKVNTPIAVLLQDGEAASDIDSMKTEAPKAETPKPAAAEAPAASAAPVAAQPKADVPSDPAIPAGTEMATMTVREALRDAMAEEMRANEDVFVMGEEVAEYQGAYKVTQGLLQEFGARRVVDTPITEHGFAGVGVGAAMTGLRPIVEFMTFNFAMQAIDQIINSAAKTLYMSGGQMGAPIVFRGPSGAAARVAAQHSQCYAAWYSHIPGLKVVMPYTAADAKGLLKAAIRDPNPVIFLENEILYGQSFEVPKLDDFVLPIGKARIHRTGKDATLVSFGIGMTYAIKAAAELEAQGIDVEIIDLRTIRPMDLPTVIESVKKTGRLVTVEEGYPQSSVGTEIATRVMQQAFDYLDAPILTIAGKDVPMPYAANLEKLALPNVAEVVDAVKAVCYK

SEQ ID NO: 11145 - protein, 275 aa, Sinorhizobium meliloti
MVAKTELRHTESLEAIDPIWDSLREEARLAAERDPMLAAFLYSTVVNQHSLEDCVIYRICERLDHPDLQASLLHQTFAEMLEDWPEWGAVLRVDIQAVYDRDPACTRFMEPVLYFKGFHAIQTHRLAHWLWNRGRKDFALYLQSRSSSVFQTDINPAARIGRGIFLDHATGLVVGETAVIGDNVSILHGVTLGGTGKEGSDRHPKIGNGVLIGAGAKILGNIHIGHCSRVAAGSVVLKAVPPKSTVAGVPAKVVGEAGCSEPSRQMDQILASFDI

SEQ ID NO: 11146 - protein, 212 aa, Sinorhizobium meliloti
MTGRPRLFGAEYSVYVRIVRLALAEKGTDYELVPVDIFASDGPPQDYLERHPFGRIPAFEYEGFRLYETGAITRYVDDVFDGRRLQPLDPRERARCSQLMSIADNYAYPTLVWGVYVERVSKPASGAAADENAIAAALPKARTCLKAISEIMGTAPWLAGETMSLADLYAAPIFDYFLRAPEGQEMLREHEMLAAWWARMSVRRSMMETRPA

SEQ ID NO: 11147 - protein, 467 aa, Sinorhizobium meliloti
MLTATKDLVLAQSDNSWPTHFRASLYLGVPFIGAQLAQLAINTTDVLMVGQLGATQLAAIILATQVFFTIFIFGSGFANAVVPMVAQAQGRGDQVSVRRSVRMGMWVVLLYGVLTAPVLWMAEPILLFAGQKPEVAALAGEYLHIAQWAIFPSLIFMVLRAFLSGLERAGVILYVTLVTLVLNAALCYVLIFGHFGFPELGIFGAAVAALGVALLGAALTIGYIRRQPELHRFELFVRFWRPDWPAFGEVVHLGIPISVTILAEVSLFTVASLLMGTIGTIELAAHGIALQFASIAFMIPLGLAQAGTVRIGLAYGSGDMVGVKRAAIAVLTLGVGFAAVGSTIFALFPHELAGLYLDTRRPDAAEVLAFAGPLIVIAGAFQLVDGLQAIAAGMLRGLKDTTIPMILAMIAYWPIGFFCAWAFAFPLGFGGVGVWFGFVLGLASAALLLNWRFFRLLRRVSAAPAAS

SEQ ID NO: 11148 - protein, 251 aa, Sinorhizobium meliloti
MKLGLEGKIAIVTGAGSGIGAAVSRQLGGEGAEVIVADRDADAARSVAAEIRSAGGRARDFTVDVTDAGAVEQMVAFTVRECGGLHLAVNNAGIEGPRQATADYPLEDWRRLIEVNLNGVFYCMKYEIAAMLGKGGGAIVNMSSILGAVALPTASAYTAAKHGVVGLTKAAGIEYARMGIRINAVGPGWIETPLLSGHSELAKTRRLEALQPLGRRGKPEEVAALVCFLLSEQASFITGSYHPVDGAFTAH

SEQ ID NO: 11149 - protein, 112 aa, Sinorhizobium meliloti
MKKIEAIIKPFKLDEVKEALQEVGLQGITVTEAKGFGRQKGHTELYRGAEYVVDFLPKVKVEVVLADENAEAVIEAIRNAAQTGRIGDGKIFVSNVEEVIRIRTGETGLDAI

SEQ ID NO: 11150 - protein, 254 aa, Sinorhizobium meliloti
MSDGMKSVLITGGASGIGLEIARLLHERGWRVYLMDRNADALADACRAIPIDPAQAIACSVTDEKEVESAIATAAAAGAPLRAVINSAGIAMDRPAVETSVDDFRRILDVNLTGTFIVCREAARHWLATATPGAIVNISSVSGLVGNKGRAAYGASKGAVNLLTYILATELGQDGIRVNAIAPGAIDTPLSRAVHTDDVRAQWHERIPQRRYGSSREIAASAAFLISEEASYINGQILAVDGGFVNAGLALKGR

SEQ ID NO: 11151 - protein, 348 aa, Sinorhizobium meliloti
MSVNRNYDPHRKWEPRPPPKSGEGGRTSAMIASLAAEGYETVSAPFGHALVAEARRNDRIVGLTADLAKYTDLHVFAEAFPERFYQMGMAEQVMISAAAGLAREGFMPFATTYAVFASRRAYDFIAMAIAEEYLPVKIVCALPGLTTGYGPSHQATEDMAIFRGLPNLTIVDPCDAIDVAEAIPAIAAHEGPVYMRLLRGKVPSVIRRHCPDYKFELGKAKLLRDGTDALIIASGFMTMRALDAAVELDEQGISAAVLHCPTIKPLDTGTILAEARRAGRLVVTAENHTCVGGLGEAVAATLLSNGATPAFRMISLPDQFLDAGALPTLHERYGISTKSMVQKIRSWL

SEQ ID NO: 11152 - protein, 511 aa, Sinorhizobium meliloti
MSIAASTSTDKIIVDKSRSHRNKAVSKTVRATRQRLQTGSSAPSGFEREMLLLHIESVLHGAMALPLLVILIAVSGIYLSGDPHILAWALLALSAHAVTIFLARKAKREDVVTEKVSVWRRRFLAGQMLTGLCWAIFTLPDCASCGEIASGLFEGTVLFIALAVTAMGTFLLRNALYYTFLPVLAALGFSSLRTGDAVDIGLTGILALSLVFLAFMTDRMNRANVHILSVQSEKDDLIAELEVAKSMSDEARRRAEEANLAKSRFLASMSHELRTPLNAILGFSEVMSTEVLGPLSNPTYKEYTLDIHRSGEHLLNLINEILDLSRIEAGKYELSEDAVNLAEIVEDCIGMVQLRARGKNITIGHQFEQAMPSVWADEKAMRQVTLNLLSNAVKFTPSGGEVSVKVGWTAGGGQYLSIRDNGPGIPEEEIPIVLSAFGQGSIAIKSAEQGTGLGLPIVQAILAKHGGQFILRSKLREGTEAIAILPPRRVLQSLPPVEDVPSLTRRRRSFA

SEQ ID NO: 11153 - protein, 337 aa, Sinorhizobium meliloti
MSVAAHALSDLLAQKGVLLADGATGTSLFAMGLEAGEAPEIWNETKPDNITKLHQDFVDAGADIILTNSFGGTRHRLKLHQAEDRVHQLNKRAAEIARAVADKAPRKVITAGSVGPTGELLIPLGALSYEDAVAAFVEQIEGLKAGGAEVAWIETMSSPDEIRAAAEAAAKVGLPYVYTGSFDTAGKTMMGLHPKDIHGVAADIGEGPVAVGANCGVGASDILSSLLDMTAASPEATIVVKGNCGIPEFRGSEIHYSGTPPLMAEYARLAVDAGAKIIGGCCGTSCNHLAAMRLAIDNHTRGERPTLETIVEKIGPLRNKSANEGPAAPARERRRRA

SEQ ID NO: 11154 - protein, 482 aa, Sinorhizobium meliloti
MVPTGGSSPVIRQLESAFTKIGVTGAHKQILALVLIGCLFDSFEQNTIGVAGPILKEHWGLTGTDIGFLNTITFGSAAIGRLLSGILGDRYGRRVMLTINLLLFTIGSAACAMAPNFTMLCFARAIVGFGVGGEISTAVTMLSEFCSPKFRGTAAGLVNVGAGGFGNFLAPAFGLLIFTLFPGENSWRWLFASLALPALLVVFYRRFVPETPRFLASKNKIGEANKVLSILASGSLKPRNLVVHEYLTTDHMTDEAPEKSDWRELFRAPFIGRTIPVAIAILMSYGAQLSVLTLMPVIFVSMGYTLSGSLLYSMIIQSGSVLGAIAASMFGYYLPRKKVLTVGAALACLAAVSIVTLGTNIYLVLLFGAIFQFFVLLLNTSIWIYAPELFPTRIRAFGVALILATGSAAGSFVPTISGMLFDSYGMVGVFGLAAGMYAVFAFCIQLGPETYGRSMEDLSQPAEADQPKVAQQQGPVAVELRT

SEQ ID NO: 11155 - protein, 281 aa, Sinorhizobium meliloti
MHDPIPTIAFPDGRKVPALGQGTWRMGENRAKTADEVRSLQTGLDLGMTLIDTAEMYGDGAAERIVGEAIKGRRDEAFVVSKVLPSNASRAGTVAACERSLRNLGIDCVDLYLLHWRGGYPLAETVAAFEELKKAGKIRAWGVSNFDVDDMEELSAVPDGGNVAANQVLYNLARRGIEFDLLPRCRAQGVPVMAYSPLDEGRLLHDADLIHIAKAHQATPAQVALAFLKTCSGVISIPKTGSPERARENRDAMDIHLTTENLAELDRHFPPPRRKTRLEVI

SEQ ID NO: 11156 - protein, 314 aa, Sinorhizobium meliloti
MASSANSISTHMTMRLWALLGLLGLIWGGSFFFARVAVAHVPPFTLVLLRLGLAALALHLYLRGRHGIYPALAGRWREFLLMGLINNAIPHAFIFLGQTHIGAGLAAILNATTPVWTVLIANVATEDEKLSTAKFSGCLLGLAGTVVLIGPSALAGLFGTAGDVPLWALVLPVLAAVSYGFSATYGKRFRDLAPPVTAAGQLTASTLIMLPVAVLVDMPWTMPMPPLTTVLAILGLALVSTAYAYILFFRIMAEAGATNTSLVTLLVPPSAILLGYLFLGEMLQATDVGGMLLIAAGLAILDGRVLKLGYSAGR

SEQ ID NO: 11157 - protein, 515 aa, Sinorhizobium meliloti
MSDYTEVDKKQDMQILHSMGYAQELERRMSQFSNFAVSFSIICILSGGINSLAQATSGAGGAAIGIGWPLGCFISFVFAVAMAQISSAYPTAGGLYHWGSILGNRFTGWLTAWFNLLGLVTVLGAINVGTYYFFMGSFGTPYFGLEDTTMTRIVFLAIITGAQALVNHMGIGLTAKLTDFSGYLIFVTAILLALVCLAAADTYEISRLFTFSNYSGETGGNVWPQTSGTWVFLLGLLLPIYTITGYDASAHTSEETVKAAHSVPRGMISSVLWAALFGYIMLCSFVLMIPDMDEAAKQGWNVFFWAMDAQVNPIIKDVLYLAIFVSQWLCGLATVTSVSRMIFAFSRDGGLPASKALSKVSPTYRTPVAAIWTGSILAVLFVWGSSLVSIGDTPVYTIVVSCTVIFLFFSFAIPITLGLFAWGTSKWDKMGPWNLGEGMFKLFAILSIVAMVLIFVLGIQPPNDWALYITVGFLIVTGIIWFAFENRRFRGPPIGDEVARRQAEIAAAEKAVGEA

SEQ ID NO: 11158 - protein, 253 aa, Sinorhizobium meliloti
MILNNRIAIVTGAGSGIGRAGAAIMAREGAHVVVVDRSVEAAGDTVAAIAAGGGSAEALAVDVTDDDALADGIADILYRHGRIDILHNHAGAQVAGDLEEVEVAGFDRSWNLNVRAHFMAARLVMPSMKKAGRGVIVNTSSSSGVLYDREMIAYTTTKHAVIAMTRQMAGDYAKYGVRVNALCPGWVDTPFNEPFIDQMGGREAIEAYIRERVPLGRWASVDEIAESILFLVSDRSSYMTGQILVVDGGETVV

SEQ ID NO: 11159 - protein, 684 aa, Sinorhizobium meliloti
MATKVKENEEADVEREGAPDGPLLDLSDDAVKKMIKAAKKRGYVTMDELNSVLPSEEVTSEQIEDTMSMLSDMGINVIEDEEAEEAAASDDDDGADEGESEGGELAPASGTALAASKKKEPTDRTDDPVRMYLREMGSVELLSREGEIAIAKRIEAGRETMIAGLCESPLTFQALIIWRDELNEGQTLLREIIDLETTYSGPEAKAAPQFQSPEKIEADRKAAEEKEKVRRTRTAANDDDITNVGGEGQAPEEEEEDDDESNLSLAAMEAELRPQVMETLDVIAETYKKLRKLQDQQVEARLAATGTLSPAQERRYKELKDELIKAVKSLSLNQNRIDALVEQLYDISKRLTQNEGRLLRLAESYGVKREAFLEQYSGAELDPNWMKSISNLAGKGWKEFARAENQTIRDIRQEIQNLATETGISIAEFRRIVSMVQKGEREARIAKKEMVEANLRLVISIAKKYTNRGLQFLDLIQEGNIGLMKAVDKFEYRRGYKFSTYATWWIRQAITRSIADQARTIRIPVHMIETINKIVRTSRQMLHEIGREPTPEELAEKLAMPLEKVRKVLKIAKEPISLETPVGDEEDSHLGDFIEDKNALLPIDAAIQANLRETTTRVLASLTPREERVLRMRFGIGMNTDHTLEEVGQQFSVTRERIRQIEAKALRKLKHPSRSRKLRSFLDS

SEQ ID NO: 11160 - protein, 300 aa, Sinorhizobium meliloti
MTRIQANLFLLFSGAIWGAGFVAQSTAMDAIGPLWFIGLRFAIATLVALPLALLEKKQAATPLPRNAMRNFVFVGLALFGGAVTQQYGLLTTTVTNSGFLTGLYVVFVPVLTVVFLRRRPHWVIWPAALLAAFGIFLLSGGALSALTGGDMLTIVCALFWAVQLMLVGLFAPATGRPMLLSMTQFAVCAVAGCVLAGLFEPLSLDAINGALPQILYAGIFSSGIAFICQVVGQRYTTAPQAAIFLSSEALFAALFGVLLLGETITPVGYVGCAVIFLAMLAVELVPELTKKRREAAQAAV

SEQ ID NO: 11161 - protein, 502 aa, Sinorhizobium meliloti
MLHQKIVENPYKQKYGNFIGGEWREPVAGRYFDNTTPITGGTLCEVARSDAADIEIALDAAHAAREKWGRTSTTERSNILMKIAARMEDNLELLARAETWDNGKPIRETMAADIPLAIDHFRYFAACIRAQEGSIGEIDHDTVAYHFHEPLGVVGQIIPWNFPILMAAWKLAPALAAGNCVVLKPAEQTPGSILVWAELIGDLLPPGVLNIVNGFGLEAGKPLATSPRIAKIAFTGETTTGRLIMQYASQNLIPVTLELGGKSPNIFFADVASEDDDFFDKALEGFAMFALNQGEVCTCPSRALVQESIYDRFMERAVKRVEAIRQGNPLDEATMIGAQASSEQLEKILAYIEIGKEEGAEVLTGGGRNVLEGDLSGGYYVKPTVFHGHNRMRIFQEEIFGPVVSVTTFKTEAEALEIANDTLYGLGAGVWSRDANRCYRFGRAIEAGRVWTNCYHAYPAHAAFGGYKQSGIGRETHKMMLDHYQQTKNMLVSYSPKALGFF

SEQ ID NO: 11162 - protein, 224 aa, Sinorhizobium meliloti
MTMVGHASRLVIFDCDGVLVDSEPISLGVLVDALAAAGVSMTAEEASERFLGRSLKTMSTILHEEHGLATDEVFLEGMRTRLYARFREELRPIARIREAVEGLGTAHCVASSSQPERIRLSLTVTGLIDLFEPNIFSASMVARGKPAPDLFLHASAEMGYHPSDCIVIEDSPAGIEAAKSAGMRVFAFAGGSHARNDRHRRTLASLEPDVLFDDMGELIQFVRQ

SEQ ID NO: 11163 - protein, 477 aa, Sinorhizobium meliloti
MLDKRKFYIDGKWVEPATQNDLLVLNPATEKPIAVISLGTAVDVDRAVAAAKKAFASYSRTSVEERLALLEKLLAIYKRRYDEMADTITAELGAPRTMSHEQQADVGVGHLQGFIDALKRLKLREKLPNGDTLLREPIGVCGLITPWNWPVNQIALKVVPALATGCTCVLKPSEFTPLNAMLYAEMIEEAGFPAGVFNLVNGDGIHAGAALSKHKDIDMMSFTGSTRAGIAVSKDAADTVKRVTLELGGKSPNIVFADADIEERVTASILECFNNSGQSCDAPTRMLVERSAYDEVVEIARRVGMEARVGDPTKVGSHIGPLVSHIQFERVQALIEAGVAEGATLLAGGPGKPEGFETGYFVQPTIFADVDNSMRIAREEVFGPVLSIIPFDTEEEAIAIANDTNYGLAAYVQTRDRERAERVASRLRAGMVHINGGPHRYGSPFGGYKQSGNGREGGMFGLEDFLEVKTVHLPDAA

SEQ ID NO: 11164 - protein, 241 aa, Sinorhizobium meliloti
MEFSGKSVIVTGGGKGIGRATVALLAARGAQVVALSRTQSDLDELSSQTGCHGIVADLADAAAARAAMVEAGTCDILVNCAGTNVLESLIDMTDDGYDVVMNTNLRAALICAQEFARARMAAGGGGAIVNVTSIAGHRGFQNHVCYAASKAGLEGATRVMAKELGPYGIRVVAIAPTITMTELAAAAWADPQKSEPMMVRHPAGRFATVDDVARSIAMLLSSDAEMVSGAVLPVDGGFLAV

SEQ ID NO: 11165 - protein, 332 aa, Sinorhizobium meliloti
MSDAVQPEKPNTGGWAPPKPVETPPVFVWPPKPMELFKWLFGKEGYLLPLNIPIMLISTFIWWYFIPDLERMKTFEFGWIAQVYAVNLVSLVVWTTIWHARFYVQRAQDTEYKYNRRWPKDTETFMFGSQLLDNMFWTLVSGVTIWTAYLVVTLWAMANGWLPYLDMAEHPFYFALFMFLIALFREFHFYSVHRLLHFGPLYKWVHSIHHKNSNPIPWSGMAMHPVEHLFYMSGVLIHWIIPSNPLLVVYHLQHLAFMPAPDHSGFAKLVVNGKAQMDVATYMHYLHHRYFEVNYGGDGSVPLDRLFGTWHNGSAEAHERMNRRFKEKKLQR

SEQ ID NO: 11166 - protein, 257 aa, Sinorhizobium meliloti
MYLRKFDLSGRVAVVTGAGQGIGLACAEALCEAGAAVVLTDISAERCEAGRAALAAKGYVVETDLIDIGDSASVNAVADRLAVSGRAADILVANAGIAHAGVPAEELSDADWERMIGINLSGAFRSCRAFGRHMLAKGRGSIVTIGSMSGTIVNRPQQQVHYNAAKAGVHHLTRSLAAEWAARGVRVNSVAPTYIDTPLLTFAKEDKPMYEQWLDMTPMHRLGQPDEIASVVLFLASDASSLMTGSIVAADAGYTCW

SEQ ID NO: 11167 - protein, 256 aa, Sinorhizobium meliloti
MYAELFRLNGRAAFVTGGSRGIGFACAEALGEAGARVAISARSRDEGEKAVRQLRQKGIEAIYLPADISNESAAQQVVRQAAAELGGLDILVNNAGIARHCDSLKLEPETWDEVINTNLTGLFWCCRAAIETMSAAGRGSIVNIGSISGYISNLPQNQVAYNASKAGVHMLTKSLAGEFAKSNIRINAVAPGYIETAMTQGGLDDPEWSKIWLGMTPLGRAGKASEVAAAVLFLASDAASYITGSVLTIDGGYTIH

SEQ ID NO: 11168 - protein, 254 aa, Sinorhizobium meliloti
MTEIPSFDDLLDFSGKTVVVTGAATGIGRAVAEAFATKRARVALLDRDAAVSDVAVSLGTGHIAHVADVTDEQGVERAVKSVTEAFGRIDILINNAGIGPLAPAESYPTAEWDRTLAVNLKGAFLMARAIAPGMLEQGSGRIVNMASQAAIIGIEGHVAYCASKAGIIGMTNCMALEWGPRGVTVNAVSPTVVETELGLTGWAGEKGERARAAIPTRRFAKPWEIAASVLYLAGGAAAMVNGANLMIDGGYTIT

SEQ ID NO: 11169 - protein, 252 aa, Sinorhizobium meliloti
MKDIIDTFRPDLFAGKDILVTGGSSGIGLAIAQGFARLGGSVIALGSSETKLKAAAADPENTAIRFERVDVRDPEAINAFARTLRKLDVLVNGAGIARPEAEFEDATYMEVMDVNLNSQMRFAMAVLPLLKASRGVILNTASMLSYVSDPLVPAYGASKSGVLGLTRHLAHAFGPDGIRVNAISPGYHKTDMTKGLWTDPVPAEKIAQRSALKRWGTVDDLVGTALFLASPAAKFITGADLPVDGGFVVGGF

SEQ ID NO: 11170 - protein, 256 aa, Sinorhizobium meliloti
MYLERFRLDGELAVVTGGGRGIGLASADALGEAGARLAIIERDPALLEEAHAILQAKGYDVSVHEGDVTDPARMQAIADELTVKGGASILVNNAGIALSDIPAEDMEDERWLKVIDVNLNGVYWCSRAFGRHMLSAGRGSIVNVGSMSGFIVNRPQPQAHYNASKAAVHHLTKSLAAEWAPRGVRVNAVAPTYIETPLNALVENDRPMLDRWLDSTPMARMGKDHEVASVILFLSSRAASLMTGSIVLADGGYTLW

SEQ ID NO: 11171 - protein, 422 aa, Sinorhizobium meliloti
MNHFQYRDGILYAEDVPLTEIARAVGTPFYCYSTATLERHYKVFSQAFADVDAMVCYAMKANSNQAVLKTLGRLGAGLDVVSEGELRRALAAGIPAGRIMFSGVGKTAREMDFALEAGIYCFNVESEPELEVLNQRAVRAGRRAPVSFRINPDVDARTHAKISTGKKENKFGISWERARGVYAHAAELPGIEVTGIDMHIGSQITELQPFDDAFKLLRELVDTLRSDGHVIEHVDIGGGLGIPYREDNNPPPLPDAYADIVKNQLKGLDCKIVTEPGRLIVGNAGILVTEVVYVKDGGDKTFVIVDGAMNDLIRPTLYEAYHEIRPVKISAASAPRIKADVVGPVCETGDYLALDREMAMPKPGDLFAIGSAGAYGAVQAGTYNSRLLVPEVLVKGDRFHVIRPRRDYDELIGLDSVPDWLD

SEQ ID NO: 11172 - protein, 301 aa, Sinorhizobium meliloti
MARNTLPTIAAGEGGLNRYLDEIRKFPMLEPQEEYMLAKRYQEHDDRKAAHKLVTSHLRLVAKIAMGYRGYGLPIGEVISEGNVGLMQAVKKFEPDRGFRLATYAMWWIKAAIQEYILRSWSLVKMGTTANQKRLFFNLRRLKGRIQALDEGDLKPEQVKEIATTLKVSEEEVVSMNRRLSGDASLNAPIKASEGDSGQWQDWLVDDHDNQEQILIEQDELESRRALLANAMKVLNDRERRIFEARRLTEEPITLEDLSTEFDISRERVRQIEVRAFEKVQEAVRKAALERASALRVVEGA

SEQ ID NO: 11173 - protein, 296 aa, Sinorhizobium meliloti
MNARAYFYLGITALFWGGNSVAGKMAVGHVSPMMLTTLRWLLALAVILVLMTPQIRRDWQKIRQHWLQLLAYGAVGFTMFNAFLYSAVQYTSAINAVILQAGIPMLIFIFNFALFKMKASLAQVIGFTVTLVGVLITAAHGDLASLMRLSFNFGDALMILACIVYAAYTVALRWKPAMHWQSFIAAPAFGALLSAIPLLLWEMGKGTAIMPDATGWAIVIYAAIFPSLMSQVLYVRGVEMIGANRAGLFINAIPVFGTLLSVLLVGEIFHPFHLAALALVLGGIAIAERGRPKLPR

SEQ ID NO: 11174 - protein, 391 aa, Sinorhizobium meliloti
MAKFCRSNRDSETGGASLKTPAAVLRKSPVERPYAHTRPLSIETIDLAPPGPDELLVKIGAAGLCHSDLSVINGDRPRPVPMALGHEAAGTVEAVGSGVRDISPGDRVVMSFMPSCGHCLPCAEGRPALCVPGAEANGKGTLLSGERRLSCGEVPVNHHLGVSGFADYAVVSRHSAVRIEADLPMVEAALFGCAVLTGVGAVVNTCRVRPGESIAVVGLGGVGLAALLGAIAAGAERIVAIDLAEDKLKLARALGATDTFLAADPDAAENIRQATRGGVDHAIEAAGSVRAFDLAYRITQRGGLTVSAGLAHPSSQISIPAVSLVAEERSVRGSYMGSCVPARDIPRFIALYERGRLPVDRLLSSTGPLEEINEAFDLLDQGRVIRHVITF

SEQ ID NO: 11175 - protein, 379 aa, Sinorhizobium meliloti
MAMTTARIIDFLNTRRPEGPCLVVDLDVVRDNFKAFRHALPDSAIYYAVKANPAPEILRLLAGLGSNFDCASVAEIEMALDAGATPNRISYGNTIKKERDVARAHALGISLFAVDSHEEVEKIARAAPGARVFCRVLTDGEGAEWPLSRKFGCVPQMAVDVLVYAHQLGLVSYGVSFHVGSQMTKLDAWDAALADAKRVFVQLAKQGIELKMVNMGGGFPTKYLRDVPSAEAYGQAIFGALKKHFGNNIPETIIEPGRGMVGNAGVIKAEVVLVSKKSDNDSHRWVFLDIGKFGGLAETMDEAIRYPIRTARDADAMEPCVLAGPTCDSADVLYEKNMYPLPISLTIGDEVLIEGTGAYTTTYSAVAFNGFEPLKAYVI

SEQ ID NO: 11176 - protein, 270 aa, Sinorhizobium meliloti
MKILLVFAHPESRSLNGALRDVAIEELTAQGHEVRVSDLYADGWKSEVGHADFPLLPPDARLVPVAASKTAFEAGALTEDVKAEIEKLLWADVLILQFPLWWFSMPAILKGWVDRVFAYGFAYGVGEHSDKRWGDRYGEGSLAGKRAMLIVTAGGWEEHYSARGVNGPIDDLLFPINHGILYYPGYDVLPPFVAYRADRLDEAGFTEVAEGLRERMRTIGTVSPIPYRQQNGGDYLIPSMQLRPGLGDPAAPSFALHLNETREALRQAGE

SEQ ID NO: 11177 - protein, 337 aa, Sinorhizobium meliloti
MARMTMIEAVRSAMDVSMARDDNVVVFGEDVGYFGGVFRCTQGLQAKYGKTRCFDTPISESGIVGTAIGMAAYGLKPCVEIQFADYMYPAYDQLTQEAARIRYRSNGDFTCPIVVRMPTGGGIFGGQTHSQSPEALFTHVCGLKVVVPSNPYDAKGLLISAIEDPDPVMFLEPKRLYNGPFDGHHERPVTAWSKHELGDVPDGHYTIPIGKAEIRRKGSGVTVIAYGTMVHVALAAAEETGIDAEVIDLRSLLPLDLETIVQSAKKTGRCVVVHEATLTSGFGAELAALVQEHCFYHLESPVVRLTGWDTPYPHAQEWDYFPGPARVGRALAEAMEG

SEQ ID NO: 11178 - protein, 1257 aa, Sinorhizobium meliloti
MSAADALFGNVSPKPDGSEVFRQLAQAAAERILIMDGAMGTEIQQLGFVEDHFRGERFGGCACHQQGNNDLLTLTQPKAIEDIHYHYAIAGADILETNTFSSTRIAQADYGMEDMVYDLNRDGARLARRAAKRAEAEDGRRRFVAGALGPTNRTASISPDVNNPGYRAVSFDDLRLAYAEQVRGLIDGGADIILIETIFDTLNAKAAIFATQEVFAEKGVRLPVMISGTITDLSGRTLSGQTPTAFWYSVRHADPFTIGLNCALGANAMRAHIDELSAVADTLVCAYPNAGLPNEFGRYDESPEQMAAQVEGFARDGLVNIVGGCCGSTPAHIRAIAEAVAKYPPRRVPEIDRRMRLSGLEPFTLTDEIPFVNVGERTNVTGSAKFRKLITAGDYAAALDVARDQVANGAQIIDVNMDEGLIDSKQVMVEFLNLVASEPDIARVPVMIDSSKWEVIEAGLKCVQGKALVNSISLKEGEAAFLHHARLVRAYGAAVVVMAFDEKGQADTKTRKVEICRRAYRLLTEEVGFPPEDIIFDPNIFAVATGIEEHNNYGVDFIEATHEIIAALPHVHVSGGVSNLSFSFRGNEPVREAMHAIFLYHAIQAGMDMGIVNAGQLAVYDAIDPELRETCEDVVLNRRADSTERLLEIAERYRGKGGSQGKEKDLAWREWPVEKRLEHALVNGITEFIEADTEEARLAAERPLHVIEGPLMAGMNVVGDLFGSGKMFLPQVVKSARVMKQAVAVLLPHMEEEKRANGGGEARESAGKILMATVKGDVHDIGKNIVGVVLACNNYEIIDLGVMVPSAKILEVAREQKVDIVGLSGLITPSLDEMAHVASELEREGFDVPLLIGGATTSRVHTAVKINPRYSLGQTVYVTDASRAVGVVSSLLSPEVRDSYKKTVRAEYLKVADAHARNEAEKRRLPLSQARANAFRIDWDAHQPKVPSFLGTRVFEGWDLAELARYIDWTPFFQTWELKGVFPKILDDERQGAAARQLFEDAQAMVEKIVAEAWFAPKAVIGFWPAASMGDDVRLFADEVREAELATFFTLRQQMVKRDGRPNVALADFVAPAASGKRDYVGGFVVTAGIEEVAIAERFERANDDYSSIMVKALADRFAEAFAERMHEYVRKELWGYAPDEAFTPQELIAEPYAGIRPAPGYPAQPDHTEKETLFRLLDAEAAIGVRLTESYAMWPGSSVSGLYVGHPDSYYFGVAKIERDQVEDYADRKRMSVREVERWLSPILNYVPMPETEAAE

SEQ ID NO: 11179 - protein, 391 aa, Sinorhizobium meliloti
MASGDDLKRRLTILGSTGSIGTSTLDVIERLGGRDRFEIAALTGNGNIPLLAEQARRIGAELAVTADEDRYGELKDALSGSGIEVAAGRSGLTEAAERDAGWVMAAIVGNAGLGPTLAAARRGADIALANKECLVSAGSLFIDAVAEGGGRLLPVDSEHNAIFQVLENDQRHAVERIVLTASGGPFRTKTLDEMRHVTADVARAHPNWSMGLKISIDSASMFNKALEMIEARHLFRLRPEQIEVIVHPQSVVHSMVGYTDGSVLAQLGCPDMRTAIGYALSYPKRCDLPVERLDFARLARLDFEAPDEVRFPAIKLARRAMEEGGVQGAVLNGAKETALDAFIKGRIGFLAMAEIVEKVMDGLAGLPAATSMDDVFAADERARRAAAEMIR

SEQ ID NO: 11180 - protein, 301 aa, Sinorhizobium meliloti
MDRPRLALELLLLVALATLWGASYTFIKIGVETIPPVTLIAARTLIAGTVLLALIAWRGLTLPRDGAMWRRFLFQACLNSVVPFTLIAWSERTTDAGVAAILNSTTPIFAFLLTALITRHEPVTARKFLGVLAGIAGIGLIIGLEAFRGIGDQLIPQLAVVLATVCYAGAAIFGKGFRGLDPMMPACGSLLAGAALLIPASLVVDRPWTLDPSPESLIALLCLSVFSTALAFVIYFRLIHTLGSVGATAQAYVRVPIGVAIGVVFLGETLSTTAWLGLGCVIAGVAAMTMPTRPRVATVGG

SEQ ID NO: 11181 - protein, 112 aa, Sinorhizobium meliloti
MKIVMAIIKPFKLDEVREALTAVGIQGLTVTEVKGYGRQKGHTEIYRGTEYAVSFLPKLKVEIAVATEIVDRAVEAIASAAKTGQIGDGKIFVYSIDHAVRIRTGETDSEAL

SEQ ID NO: 11182 - protein, 279 aa, Sinorhizobium meliloti
MIKIAMEAPYLERDEEHALAQAWRNDNDQEARNKIAMSHMRLVISMAAKFRSFGLPMGDLVQEGHIGLLEAAARFEPSREVRFSTYATWWIRASMQDYVLRNWSIVRGGTSSAQKALFFNLRRLRARLAQGDRQLTSQAMHEEIAAALGVSLADVQTMDARLSGNDASLQAPIGSGDPDAGARLDFLASEAPLPDEQVSDLIDGERARRWLQVALGELSEREMKIIRARRLTEDGATLEELGVALGISKERVRQIETRALEKLRAALTAKAPALTASMH

SEQ ID NO: 11183 - protein, 241 aa, Sinorhizobium meliloti
MSRVALVTGGSRGIGAAICVALKAAGYKVAANYAGNDERAKAFEQESGIPVYKWDVSSYQACVDGIARVEADLGPVDILVNNAGITRDAMFHKMTPEQWGEVIGTNLTGVFNMTHPLWSGMRDRGFGRIVNISSINGQKGQMGQVNYSAAKAGDLGLTKALAQEGAAKGITVNAICPGYIGTEMVRAVPEKVLNERIIPQIPVGRLGEPEEVARCVVFLASDDAGFITGSTISANGGQYFA

SEQ ID NO: 11184 - protein, 504 aa, Sinorhizobium meliloti
MVMTVVVRPKALGDYDTREFRMLIDGQWVDGAEGRTIERVAPGHGVVVSRYQAAAKADAERAIAAARRAFDEGPWPRMTASERSLILLRAADMIAARADELAFLDAVESGKPISQAKGELAGAADIWRYAAALARELSGESYNTLGEGTLGVVLREPIGVVSIITPWNFPFLIVSQKLPFALAAGCTTVVKPSELTSASTLVLGEILEAAGVPQGVVNIIVGTGPEAGAPLTTHPHVDMVSFTGSTGIGQLTMANAAQTLKKVSLELGGKNPQIVFPDANLDEFIDAAVFGAYFNAGECCNAGSRLILHRDIAEEVTARIASLSAKVKVGDPLDPETQVGAIITPQHLQKIAGYVSSASNEGARIAHGGTTLDLGMGQFMAPTILSAVRPEMAVAREEVFGPVLSVLTFEKTEEAIRIANSIDYGLSAGVWSRDFDTCLTIGRRVRAGTVWMNTFMDGASELPFGGYRQSGLGRELGRHAVEDYTETKTLNMHIGRRSNWWMPR

SEQ ID NO: 11185 - protein, 534 aa, Lycopersicon esculentum
MGLDAVARLGVSILSDGDQVSVDSITLFVALLCGCIVIGHLLEESRWINDSITTLVIGLSTGGIILLTTKGKSSHLLEFDEQLFFIYVLPPIIFNAGFQVKKKQFFRNFVTIMLFGAVGTLISFSIISFGAKELLGKLDIGFLELRDYLAIGAIFSATDSVCTLQALNQDETPRLYSLVFGEGVVNDATSVVLFNAIQKLDLSHINSRAALVFTGNFLYLFLASTFLGVLIGLLSAYLIKKIYLGRHSTDREVALMILMAYLSYVMAELFDLSGILTVFICGIVMSHYTWHNVTFNSKVTTRHAFATLSFIAEIFIFLYVGMDALDIEKWRFVKDSPGKSVGVSAALLGLVLVGRACFVFPLSLFSNCLKRSEHDKFGLKLQVTIWWAGLMRGSVSMALAYNQFTRFGHTQQPGNAVMITSTITIVLFSTVVFGLITKPLVRFLLPSSQGFNNLISSEQSFARPLLTNEQELELEMGNVDPVRPSGLSILLKEPSYTIHNHWRRFDDAFMRPLFGGRGFVPDAPELSKGGCDQY

SEQ ID NO: 11186 - protein, 619 aa, Botryotinia fuckeliana
WKHQKANEAFQKALREIGEIVTAVARGDLSKKVQIHSVEMDPEITTFKRVINTMMDQLQIFSSEVSRVAREVGTEGILGGQAKISGVDGTWKELTDNVNVMAQNLTDQVREIASVTTAVAHGDLTQKIERPAQGEILQLQQTINTMVDQLRTFAAEVTRVARDVGTEGILGGQAEIEGVQGMWNTLIVNVNAMANNLTTQVRDIAIVTTAVAKGDLTQKVQAECKGEIKQLKETINSMVDQLQQFAREVTKIAREVGTEGRLGGQATVHDVEGTWRDLTENVNGMAMNLTTQVREIAKVTTAVARGDLTKKIEVEVQGEIASLKDTINTMVDRLSTFAFEVSKVAREVGTDGTLGGQAQVDNVEGKWKDLTENVNTMARNLTTQVRGISTVTQAIANGDMSQKIEVAAAGEILILKETINNMVDRLSIFSNEVQRVAKDVGVDGKMGGQADVAGIGGRWKEITTDVNTMANNLTTQVRAFGDITNAATDGDFTKLITVEASGEMDELKRKINQMVYNLRDSIQRNTLAREAAEFANRTKSEFLANMSHEIRTPMNGIIGMTQLTLDTDLTQYQREMLNIVHNLANSLLTIIDDILDLSKIEANRMIMEEIPYTLIGTVF

SEQ ID NO: 11187 - protein, 148 aa, Arabidopsis thaliana
MSEDPEYRCFIGGLAWTTSDRGLRDAFEKYGHLVEAKVVLDKFSGRSRGFGFITFDEKKAMDEAIAAMNGMDLDGRTITVDKAQPHQGGAGRDNDGDRGRDRGYDRDRSRPSGGRGGGDCFKCGKPGHFARECPSESSRWWWKVQLKG

SEQ ID NO: 11188 - protein, 767 aa, Prunus persica
MAVLLSTLATEIVIPVAAVIGIVFSLVQWFIVSRVKVTLERHAPPAGPNSNKNGFNDYLIEEEEGLHDQNVVAKCAEIQNAISEGATSFLFTEYQYVGVFMVVFAILIFLFLGSVEGFSTKSQPCTYDAQRTCKPALATAIFSTVAFVLGGVTSILSGFLGMKIATYANARTTLEARKGVGKAFIVAFRSGAVMGFLLAANGLLVLYITINVFKVYYGDDWEGLFESITGYGLGGSAMALFGRVGGGIYTKAADVGADLVGKVERNIPEDDPRNPAVIADNVGDNVGDIAGMGSDLFGSYAESSCAALVVASISSFGINHEFTSMLYPLLISSMGILICLITTLFATDFFEIKAVKEIEPALKKQLIISTVLMTVGIAIISWIALPSSFTIYNFGVQKVVKNWQLFLCVAVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPTGFSAMTMKSVGSAALKMVEEVRRQFNTIPGLMEGTAKPSYATCVKISTDASIKEMIPPGALVILTPLIVGTLFGVETLSGVLAGSLVSGVQVAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 11189 - protein, 759 aa, Prunus persica
MGLLSEGLTQLLIPLAALVGLAFALLQWFLVSRVKVSGSYGEGNGYKDKLIGEAEEGVDSLEVTIKVAEIQNAISIGATSFLFTQYRYLSIFVGVFSAIIFLFLGSVKGFSTKSEPCTYNTGNTCKPALANALFTTIAFLLGALTSVLSGFFGMKIATYANARTTLEARRGVGKAFITAFRSGAVMGFLLAANGLLVLYITINLFKLYYGDDWEGLYESITGYGLGGSSMALFGRVGGGIYTKAADVGADLVGKVERNIPEDDPRNPAVIADNVGDNVGDIAGMGSDLFGSYAESSCAALFVASISSFGISHDYTAMSYPLIISSMGIVVCLITTLFATDLFEIKKVNEIEPSLKRQLLISTVLMTAGIAAVTFVALPSEFTLFQFGTNKAVKNWYLFFCVAIGLWAGLVIGYTTEYHTSNAYSPVQDVADSCRTGAATNVIFGLALGYKSVIIPVFAIAFAIYVSFSLAAMYGIAVAALGMLSTISTGLAIDAYGPISDNAGGIAEMAGMSHEIRERTDALDAAGNTTAAIGKGFAIGSAALVSLALFGAYVSRAGIETVDVLTPKVFIGLLVGAMLPYWFSAMTMKSVGSAALKMVEEVRRQFNTIPGLMEGTAKPDYATCVKISTDASLKEMIPPGALVMLTPLIAGTFFGVETLAGILAGSLVSGVQIAISASNTGGAWDNAKKYIEAGASEHAKSLGPKGSDPHKAAVIGDTIGDPLKDTSGPSLNILIKLMAVESLVFAPFFAAHGGVLFKWL

SEQ ID NO: 11190 - protein, 203 aa, Ananas comosus
ACENWGFFEILNHGITREMMDEVERLTKDHYRRSREQRFEEFANKALEDGTNGVDVSSNLDWESTFFVRHLPVSNISELSDLNDHYRNVMKEFAVELEKLAERLLDLLCENLGLEKGYLKKAFCGSNGPTFGTKVSSYPPCPRPDLIKGLRAHTDAGGIILLFQDDRVSGLQLLKDGEWVDVPPTPYSIVVNLGDQLEVITNG

SEQ ID NO: 11191 - protein, 249 aa, Schistosoma mansoni
MDELRERNIVLAKLCEQAERYDEMVKAMIEIATNTETELTVEERNLLSVAYKNVIGARRSSWRIINSKESQDEAKGSDEIHITKRFRKEVEKELDEICTSILNLLDNCLLPKAVSDESKVFLNKMRGDYHRYRAEYSVGNQRKDAAENSLCAYKKAAEDAEKLPVTHPIRLGLALNFSVFYYEILNNSEQACKCARVAFDSAIAELDTLSEESYKDSTIIMQLLRDNLTLWTSNSEGEKDTASPKGDKK

SEQ ID NO: 11192 - protein, 92 aa, Kluyveromyces lactis
  unsure (1)..(92): unsure at all Xaa locations
ARPAFVNKLWSXVNDKSNEKFIHWSTSGESIVVPNRERFVQEVLPKYFKHSNFASFVRQLNXYGWHKVQDVKSGSXLSNNDSRWEFENERHA

SEQ ID NO: 11193 - protein, 102 aa, Saccharomyces cerevisiae
SGRGKGGKGLGKGGAKRHRKILRDNIQGITKPAIRRLARRGGVKRISGLIYEEVRAVLKSFLESVIRDSVTYTEHAKRKTVTSLDVVYALKRQGRTLYGFGG

SEQ ID NO: 11194 - protein, 131 aa, Saccharomyces cerevisiae
SGGKGGKAGSAAKASQSRSAKAGLTFPVGRVHRLLRRGNYAQRIGSGAPVYLTAVLEYLAAEILELAGNAARDNKKTRIIPRHLQLAIRNDDELNKLLGNVTIAQGGVLPNIHQNLLPKKSAKATKASQEL

SEQ ID NO: 11195 - protein, 374 aa, Equus caballus
STAGKVIKCKAAVLWEEKKPFSIEEVEVAPPKAHEVRIKMVATGICRSDDHVVSGTLVTPLPVIAGHEAAGIVESIGEGVTTVRPGDKVIPLFTPQCGKCRVCKHPEGNFCLKNDLSMPRGTMQDGTSRFTCRGKPIHHFLGTSTFSQYTVVDEISVAKIDAASPLEKVCLIGCGFSTGYGSAVKVAKVTQGSTCAVFGLGGVGLSVIMGCKAAGAARIIGVDINKDKFAKAKEVGATECVNPQDYKKPIQEVLTEMSNGGVDFSFEVIGRLDTMVTALSCCQEAYGVSVISGVPPDSQNLSMNPMLLLSGRTWKGAIFGGFKSKDSVPKLVADFMAKKFALDPLITHVLPFEKINEGFDLLRSGESIRTILTF

SEQ ID NO: 11196 - protein, 757 aa, Homo sapiens
KTSDANETEDHLESLICKVGEKSACSLESNLEGLAGVLEADLPNYKSKILRLLCTVARLLPEKLTIYTTLVGLLNARNYNFGGEFVEAMIRQLKESLKANNYNEAVYLVRFLSDLVNCHVIAAPSMVAMFENFVSVTQEEDVPQVRRDWYVYAFLSSLPWVGKELYEKKDAEMDRIFANTESYLKRRQKTHVPMLQVWTADKPHPQEEYLDCLWAQIQKLKKDRWQERHILRPYLAFDSILCEALQHNLPPFTPPPHTEDSVYPMPRVIFRMFDYTDDPEGPVMPGSHSVERFVIEENLHCIIKSHWKERKTCAAQLVSYPGKNKIPLNYHIVEVIFAELFQLPAPPHIDVMYTTLLIELCKLQPGSLPQVLAQATEMLYMRLDTMNTTCVDRFINWFSHHLSNFQFRWSWEDWSDCLSQDPESPKPKFVREVLEKCMRLSYHQRILDIVPPTFSALCPSNPTCIYKYGDESSNSLPGHSVALCLAVAFKSKATNDEIFSILKDVPNPNQDDDDDEGFSFNPLKIEVFVQTLLHLAAKSFSHSFSALAKFHEVFKTLAESDEGKLHVLRVMFEVWRNHPQMIAVLVDKMIRTQIVDCAAVANWIFSSELSRDFTRLFVWEILHSTIRKMNKHVLKIQKELEEAKEKLARQHDGVLEEQIERLQEKVESAQSEQKNLFLVIFQRFIMILTEHLVRCETDGTSVLTPWYKNCIERLQQIFLQHHQIIQQYMVTLENLLFTAELDPHILAVFQQFCALQA

SEQ ID NO: 11197 - protein, 98 aa, Homo sapiens
DQHFRGDNEEQEKLLKKSCTLYVGNLSFYTTEEQIYELFSKSGDIKKIIMGLDKMKTACGFCFVEYYSRADAENAMRYINGTRLDDRIIRTDWDAGFK

SEQ ID NO: 11198 - protein, 273 aa, Homo sapiens
AGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQFPLQWFGVPAILKGWFERVFIGEFAYTYAAMYDKGPFRSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 11199 - protein, 507 aa, Triticum aestivum
MEVESSAHGDAAASKFTLPVDSEHKAKSFRLFSFANPHMRTFHLSWISFFTCFVSTFAAAPLVPIIRDNLNLAKADIGNAGVASVSGSIFSRLAMGAVCDLLGPRYGCAFLVMLSAPTVFCMAVIDDASGYIAVRFLIGFSLAAFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTDNVIAEYYYDHFHLHLRAAGTIAACFGMANIVARPMGGYLSDLGARYFGMRARLWNIWILQTAGGAFCIWLGRASALPASVTAMVLFSICAQAACGAVFGVAPFVSRRSLGIISGLTGAGGNVGAGLTQLLFFTSSQYSTGRGLEYMGIMIMACTLPITLVHFPQWGSMFFPASADATEEEYYASEWSEEEKGKGLHIAGQKFAENSRSERGRRNVILATSATPPNNTPQHV

SEQ ID NO: 11200 - protein, 359 aa, Fusarium oxysporum
MNSQGNSDVSPEAMQSRIQQARREAETLKDRIKRKKDDLADTTLRAVAQQAHEPIPKNQLMKAKRTLKGHLAKIYAMHWSTDRRHLVSASQDGKLIIWDAYTTNKVHAIPLRSSWVMTCAYAPSGNFVACGGLDNICSIYNLNQQRDGPTRVARELSGHAGYLSCCRFINDRSILTSSGDMTCMKWDIETGQKVTEFADHLGDVMSISLNPTNQNTFISGACDAFAKLWDIRAGKAVQTFAGHESDINAIQFFPDGHSFVTGSDDATCRLFDIRADRELNLYGSESILCGITSVATSVSGRLLFAGYDDFECKVWDITRGEKVGSLVGHENRVSCLGVSNDGTSLCTGSWDSLLKIWAY

SEQ ID NO: 11201 - protein, 165 aa, Physarum polycephalum
MAAEASAGTLKLESSDNKVFTVPTVVAQQSVTIKNMLEDIGDGADAPIPLPNVTGYILEKVIDYLVHHHEHPEPTPDEKAEKRTDNISGWDKDFCNVDQPTLFELILAANYLDIKPLLDVTCKTVANMIKGKTPEEIRKTFNIKNDFTPEEEEAIRKENEWCEEK

SEQ ID NO: 11202 - protein, 221 aa, Papio anubis
MEAGGFLDSLIYGACVVFTLGMFSAGLSDLRHMRMTRSVDNVQFLPFLTTEVNNLGWLSYGALKGDRILIVVNTVGAALQTLYILAYLHYCPRKRVVLLQTATLLGVLLLGYGYFWLLVPNPEARLQLLGLFCSVFTISMYLSPLADLAKVIQTKSTQCLSYPLTIATVLTSASWCLYGFRLRVPYIMVSNFPGIVTSFIRFWLFWKYPQEQDRNYWFLQT

SEQ ID NO: 11203 - protein, 209 aa, Naegleria fowleri
MAGKKGGKKSKKDSNAPKKPKTAYFLFCDEHREEAKKKAGEGKSASEVSKILGEMWGKLTEEQKKPYNDRYKIEMEKHKKVMDEYKKNKPESEEESEEESEEEGKKKRKRTKKDKDAPKRPLSSYMLFSQDKRKELLEKDPTLKVTEVAKQVGALWQKMSDEEKKPYNDKAAKLKKEYEGVKAKYDETHGKKSGSSSAKKKKKEEESEE

SEQ ID NO: 11204 - protein, 816 aa, Brassica rapa
MKGVQNIYNNAYSVSSLLVFFVLILFRPALSISAANRLSSSESLTISSNRTLVSPGGAFELGFFKPSALPRWYLGIRYKKVSEKTYAWVANRNNPLFTSIGTLKISGNNLHLLDQSNNTVWWTSSPSGDVTAPVIAELLSNGNFVLRHSDNNDDPSSFLWQSFDFPTDTLLPEMKLGIDHKKERNWILTSWRAADDPASGNFTFNLETQWGLPEFILRSDGRVAARSGPWDGIEFSGIPEMQRSDNIISNFTVNSGEAAYSFRMTNHSIYSILTARDWMLVRVTWTSTSLEWKRSEDNLFTDICDVYHVCYGPNTYCDINTSPRCNCIRGFVPQNATEWAERDEVLGRSISGCVRKTQLNCEEYHDFVLLNNTKLPDTKTATVDQGIIDEKICKERCLSDCNCTSFAFGKNGLGCVTWTGDLVDIRTYFEGGYALFVKVSADDPDFSSGEKRDRTGKTIGWSIGGVSVLLLLSVILFCFWKRRQKQAKADATPIEGNQVQLNEMVLRNINSSREDEIEDLDLPLMDFEAVVAATERFSHSNQVGKGGFGAVYKGRLSDGQEIAVKRLSAMSAQGTDEFLNEVRLIARLQHVNLVRLLGCCVQANEKILIYEYLENLSLDSHIFDKTRSSMLNWQMRFDIINGIARGLLYLHQDSRFRIIHRDLKASNVLLDKDMAPKISDFGLARMFGRDETEANTRKVVGTYGYMSPEYAMNGTFSMKSDVFSFGVLLLEIISGKRNKGFCDSDSNLNLLGHVWRNWNEGQGLEIVDTAVIVDSSSPTCRPREILRCLQIGLLCVQEHVEDRPMIDVVSSFDARK

SEQ ID NO: 11205 - protein, 518 aa, Pycnoporus coccineus
MSRFQSLLSFVLVSLAAVANAAIGPVADLTLTNAAVSPDGFSREAVVVNGQTPGPLIAGQKGDRFQLNVIDNLTNHTMLKTTSIHWHGFFQHGTNWADGPAFINQCPIASGHSFLYDFQVPDQAGTFWYHSHLSTQYCDGLRGPFVVYDPNDPQASLYDIDNDDTVITLVDWYHVAAKLGPRFPLGADATLINGLGRSPGTTAADLAVIKVTQGKRYRFRLVSLSCDPNHTFSIDGHTMTIIEADSVNTQPLEVDSIQIFAAQRYSFVLDASQPVDNYWIRANPSFGNTGFAGGINSAILRYDGAPEVEPTTTQTTSTKPLNEVDLHPLTPMAVPGRPEPGGVDTPLNMVFNFNGTNFFINDHSFVPPSVPVLLQILSGAQAAQDLAPSGSVYVLPSNSSIEISFPATANAPGAPHPFHLHGHTFAVVRSAGSSEYNYDNPIFRDVVSTGTPGDNVTIRFQTNNPGPWFLHCHIDFHLDAGFAVVMAEDTPDTAAANPVPQSWSDLCPIYDALDPSDL

SEQ ID NO: 11206 - protein, 518 aa, Pycnoporus coccineus
MSRFQSLLSFVLVSLAAVANAAIGPMADLTLTNAAVSPDGFSREAVVVNGQTPGPLIAGQKGDRFQLNVIDNLTNHTMLKTTSIHWHGFFQHGTNWADGPAFINQCPIASGHSFLYDFQVPDQAGTFWYHSHLSTQYCDGLRGPFVVYDPNDPQASLYDIDNDDTVITLVDWYHVAAKLGPRFPLGADATLINGLGRSPGTTAADLAVIKVTQGKRYRFRLVSLSCDPNHTFSIDGHTMTIIEADSVNTQPLEVDSIQIFAAQRYSFVLDASQPVDNYWIRANPSFGNTGFAGGINSAILRYDGAPEVEPTTTQTTSTKPLNEVDLHPLTPMAVPGRPEPGGVDTPLNMVFNFNGTNFFINDHSFVPPSVPVLLQILSGAQAAQDLAPSGSVYVLPSNSSIEISFPATANAPGAPHPFHLHGHTFAVVRSAGSSEYNYDNPIFRDVVSTGTPGDNVTIRFQTNNPGPWFLHCHIDFHLDAGFAVVMAEDTPDTAAANPVPQSWSDLCPIYDALDPSDL

SEQ ID NO: 11207 - protein, 234 aa, Acetabularia mediterranea
MAAKIFCFLMLLGLSASVATATIFPQCSQAPIASLLPPYLSPAVSSMCENPIVQPYRIQQAIATGILPLSPLFLQQPSALLQQLPLVHLVAQNIRAQQLQQLVLANLAAYSQQHQFLPFNQLAALNSAAYLQQQLPFSQLVAAYPRQFLPFNQLAALNSAAYLQQQQLLPFSQLADVSPAAFLTQQQLLPFYLHAMPNAGTLLQLQQLLPFNQLALTNSTVFYQQPIIGGALFQ

SEQ ID NO: 11208 - protein, 262 aa, Cynodon dactylon
MLAVVAVVLASMVGGALCAMGDKPGPNITATYGDKWLDAKATFYGSDPRGAAPDDHGGACGYKDVDKAPFDSMTGCGNEPIFKDGLGCGSCYEIKCKEPAECSGEPVLIKITDKNYEHIAAYHFDLSGKAFGAMAKKGEEDKLRKAGELMLQFRRVKCEYPSDTKIAFHVEKGSNPNYLALLVKYAAGDGNIVSVDIKSKGSDEFLPMKQSWGAIWRIDPPKPLKGPFTIRLTSESGGHVEQEDVIPEDWKPDTVYKSKIQF

SEQ ID NO: 11209 - protein, 488 aa, Bacillus subtilis subsp. subtilis str. 168
MWESKFSKEGLTFDDVLLVPAKSEVLPRDVDLSVELTKTLKLNIPVISAGMDTVTESAMAIAMARQGGLGIIHKNMSIEQQAEQVDKVKRSERGVITNPFFLTPDHQVFDAEHLMGKYRISGVPIVNNEEDQKLVGIITNRDLRFISDYSMKISDVMTKEELVTASVGTTLDEAEKILQKHKIEKLPLVDDQNKLKGLITIKDIEKVIEFPNSSKDIHGRLIVGAAVGVTGDTMTRVKKLVEANVDVIVIDTAHGHSQGVLNTVTKIRETYPELNIIAGNVATAEATRALIEAGADVVKVGIGPGSICTTRVVAGVGVPQITAIYDCATEARKHGKTIIADGGIKFSGDITKALAAGGHAVMLGSLLAGTSESPGETEIYQGRRFKVYRGMGSVAAMEKGSKDRYFQEENKKFVPEGIEGRTPYKGPVEETVYQLVGGLRSGMGYCGSKDLRALREEAQFIRMTGAGLRESHPHDVQITKESPNYTIS

SEQ ID NO: 11210 - protein, 161 aa, Bacillus subtilis subsp. subtilis str. 168
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 11211 - protein, 217 aa, Bacillus subtilis subsp. subtilis str. 168
MFFRMLKEDIDTVFDQDPAARSYFEVILTYSGLHAIWAHRIAHALYKRKFYFLARLISQVSRFFTGIEIHPGATIGRRFFIDHGMGVVIGETCEIGNNVTVFQGVTLGGTGKEKGKRHPTIKDDALIATGAKVLGSITVGEGSKIGAGSVVLHDVPDFSTVVGIPGRVVVQNGKKVRRDLNHQDLPDPVADRFKSLEQQILELKAELEDRKERINQK

SEQ ID NO: 11212 - protein, 352 aa, Bacillus subtilis subsp. subtilis str. 168
MIREDEVRKLVGEMREPFLQRPLGELDAVKEIKIKPEKRHISVKVALAKTGTAEQMQIQQEIVNVLKGAGAETVGLRFEELPEETVAKFRAPSAEKKTLLNMDNPPVFLAVASGKGGVGKSTVSVNLAISLARLGKKVGLIDADIYGFSVPDMMGITVRPTIEGEKLLPVERFGVKVMSMGFFVEENAPVVWRGPMLGKMLNNFFHEVEWGEVDYIVLDLPPGTGDVALDVHTMLPSCKEIIVSTPHPTAAFVAARAGSMAIKTDHEVVGVIENMAYYESAKTGEREYVFGKGGGDKLAEELNVPLLGRIPLKQPDWDKDQFAPSVYDENHPIGEIYQDIAKKIDAKMSVQV

SEQ ID NO: 11213 - protein, 315 aa, Bacillus subtilis subsp. subtilis str. 168
MNPIQHILDTYPLIVLDGAMATELERKGCNLNDSLWSAKILMEEPELIKQVHTDYFAAGADCAITASYQSTFEGFAARGLSEAEARRLIELSVSIAAEARDEFWSLEENRLNRPKPIIAASIGPYGAYLADGSEYRGNYAISEDELIEFHRPRMKALIEAGADVLACETIPCLTEAKAIVRLLKEFPETYAWISFSAKDGLHISDGTPAADCASWLDEHRQIAALGINCTPLQHIPSLIEELKKNTSKPIIVYPNSGEQYDPETKTWNGAACAESYGASARTWHEKGARLIGGCCRTKPENIQEIAAWARSLKTT

SEQ ID NO: 11214 - protein, 258 aa, Bacillus subtilis subsp. subtilis str. 168
MYKDLTGKTAIVTGSSKGIGKAIAERFGKEKMNVVVNYHSDPSGADETLEIIKQNGGKAVSVEADVSKEEGIQALLDTALEHFGTLDVMVNNSGFNGVEAMPHEMSLEDWQRVIDVNVTGTFLGAKAALNHMMKNNIKGNVLNISSVHQQIPRPVNVQYSTSKGGIKMMTETLALNYADKGIRVNAIAPGTIATESNVDTKKEESRQKQLKKIPMKAFGKPEEVAAAAAWLVSEEASYVTGATLFVDGGMTLYPSQLE

SEQ ID NO: 11215 - protein, 306 aa, Bacillus subtilis subsp. subtilis str. 168
MRKKTVQIMISHSLMIGLWASAFPGIRAGLEGYTPEHLALFRLLIGSMALLLFAVLTQMRLPDLKDIPAIFLLGFLGFAFYHILLNIGEKTVSAGVASLLVTTAPIFSAMLSRLFYKEHFGFTKWLGSMISLLGVLLIAFGAGDFTYSMSGILVILLAAFSESIYFVFQARYIKKYGFIPFVTFTIWGGTIPMLVFLPGLGEEMMNASISATLSIVYLGLLPTVIPYFALAYVTSFVGASEATLSLYVTPALALIISWLWIGEIPTLLSLLGGVVTVGGVCFTYLKVNKMNKIFITHFSAKRVKKL

SEQ ID NO: 11216 - protein, 140 aa, Bacillus subtilis subsp. subtilis str. 168
MSSVKDTMTTQVATVSPNQTIQEAASLMKQHNVGAIPVVEQGVLKGMLTDRDIALRTTAQGRDGQTPVSEVMSTELVSGNPNMSLEDASQLMAQHQIRRLPIVDQNNLVGIVALGDLAVNQMSNESAGSALTNISHQNIH

SEQ ID NO: 11217 - protein, 220 aa, Bacillus subtilis subsp. subtilis str. 168
MIKALIFDFDGLILDTETHEYEVLQEIFEEHGSVLPLSVWGKVIGTAAGFRPFEYLEEQIGKKLNHEELTQLRRERFAKRMESEKARPGVEAYLNAAKDLGLKIGLASSSDYKWVSGHLKQIGLFDDFEVIQTADDVEEVKPNPELYLLAAKNLGVSPAECLAFEDSVNGSIAAKRAGMKCVIVPNKVTGTLMFEDYDHRLESMAEMELALLLDHLNSQN

SEQ ID NO: 11218 - protein, 285 aa, Bacillus subtilis subsp. subtilis str. 168
MANQKKKTLPPQHQNQQPGFEYLMDPRPVFDKPKKAKKLEGKTAIITGGDSGIGRAVSVLFAKEGANVVIVYLNEHQDAEETKQYVEKEGVKCLLIAGDVGDEAFCNDVVGQASQVFPSIDILVNNAAEQHVQPSIEKITSHQLIRTFQTNIFSMFYLTKAVLPHLKKGSSIINTASITAYKGNKTLIDYSATKGAIVTFTRSLSQSLVQQGIRVNAVAPGPIWTPLIPASFAAKDVEVFGSDVPMERPGQPVEVAPSYLYLASDDSTYVTGQTIHVNGGTIVNG

SEQ ID NO: 11219 - protein, 612 aa, Bacillus subtilis subsp. subtilis str. 168
MGLLEDLQRQVLIGDGAMGTLLYSYGIDRCFEELNISKPEEIQRIHKAYVEAGANIIQTNTYGANYIKLSRHGLEDDIKKMNQEAVKIARASAGDAYVLGTMGGIRTFNKNAYSLDEIKRSFREQLYLLLHEEPDGLLLETYYDLEEAREVLKIARKETDLPIMLNVSMHEQGVLQDGTPLSDALRSIADLGADIVGINCRLGPYHMIEALSEVPIFDDVFLSVYPNSSLPSLEEGRLVYETDDTYFQNSASEFRKQGARIIGGCCGTTPNHIRAMAEAVGGLAPITEKEVKTRAKEFISVHHERTEPGLDEIAAKKRSIIVELDPPKKLSFDKFLSAAAELKEAGIDALTLADNSLATPRISNVACGALVKQQLDMRSLVHITCRDRNIIGLQSHLMGLDTLGLNDVLAITGDPSKIGDFPGATSVYDLTSFDLIRLIKQFNEGLSLSGKPLGKKTNFSVAAAFNPNVRHLDKAVKRLEKKIDCGADYFVSQPVYSEQQLVDIHNETKHLKTPIYIGIMPLTSSRNAEFIHNEIPGIKLSDTIREKMAHAGEDKEKQKAEGLAIARSLLDTACELFNGIYLITPFLRSDLTAELTSYIQQKDEQRQNIFLH

SEQ ID NO: 11220 - protein, 399 aa, Bacillus subtilis subsp. subtilis str. 168
MLDNKTIEIIKSTVPVLQQHGETITGRFYDRMFQDHPELLNIFNQTNQKKKTQRTALANAVIAAAANIDQLGNIIPVVKQIGHKHRSIGIKPEHYPIVGKYLLIAIKDVLGDAATPDIMQAWEKAYGVIADAFIGIEKDMYEQAEEQAGGWKEYKPFVIAKKERESKEITSFYLKPEDSKPLPEFQAGQYISIKVRIPDSEYTHIRQYSLSDMPGKDYYRISVKKDGVVSSYLHDGLQEGDSIEISAPAGDFVLDHASQKDLVLISAGVGITPMISMLKTSVSKQPERQILFIHAAKNSEYHALRHEVEEAAKHSAVKTAFVYREPTEEDRAGDLHFHEGQIDQQFLKELIANTDADYYICGSPSFITAMHKLVSELGSAPESIHYELFGPQLSLAQSV

SEQ ID NO: 11221 - protein, 248 aa, Bacillus subtilis subsp. subtilis str. 168
MGKFEGKIALVTGGTSGIGLATAQKFVNEGAYVYITGRRQNELDKAVNQIGKNVTGVQGDISKLEDLDKLYDIIKQEKGKLDILFANAGIGNFLPLGEITEEQVDRTFDINVKGTIFTVQKALSLFPDKVGSIIVTGSTAGSIGNPAFSVYGASKAALRALVRNWILDLKGTEIRVNVVSPGGILTPAYDELFGDALEEVLENSRNTVPAGKVGTPEEVANAVSFLASDESSYLTGVELFVDGGLAQV

SEQ ID NO: 11222 - protein, 550 aa, Bacillus subtilis subsp. subtilis str. 168
MQELKGIGASAGIAIAKAYRLEEPDLTVEKKNISDSEAEVSRFDEAIARSKEELEKIKEHALKELGQPVKEKISTDSVNAEFALKETSSMFVTMFESMDNEYMKERAADIRDVTKRVTGHLLGVEIPNPSMISEEVIIVAEDLTPSDTAQLNREFVKGFTTDIGGRTSHSAIMARSLEIPAVVGTKAATGTIQNGVTVIVDGINGDVIIDPSAETVKEYEEKHNAYLAQKAEWAKLVNEPTVSKDGHHVELAANIGTPDDVKGVLENGGEAVGLYRTEFLYMGRDQLPTEDEQFDAYKTVLERMEGKSVVVRTLDIGGDKELPYLQLPKEMNPFLGYRAIRLCLEEQEIFRTQLRALLRASTYGNLKIMFPMIATVNEFKEAKAILLEEKEKLVKAGQAVSDDIEVGMMVEIPSTAVIADQFAKEVDFFSIGTNDLIQYTMAADRMNERVSYLYQPYNPAILRLITLVIEAAHKEGKWVGMCGEMAGDEIAIPILLGLGLDEFSMSATSILPARTQISKLSKQEAESFKEKILSMSTTEEVVAFVKETFK

SEQ ID NO: 11223 - protein, 254 aa, Bacillus subtilis subsp. subtilis str. 168
MEKKAVIITGGSSGMGKAMAKKQAELGWHVMVTGRNHEALEETKKEIQTFEGQVACFQMDVRSDSAASDMIKEAVKAFGRLDALINNAAGNFICPAEKLTPNGWKAVIEIVLNGTFFCSQAAARHWIDQKQQGVILNMAATYAWGAGAGVVHSAAAKAGVLSLTRTLAVEWGSKYGIRTNAIAPGPIERTGGAEKLFESEKAMARTMNSVPLGRLGTPEEIAALAAFLLSDEASYINGDCITMDGGQWLNPYPF

SEQ ID NO: 11224 - protein, 325 aa, Bacillus subtilis subsp. subtilis str. 168
MAQMTMIQAITDALRTELKNDENVLVFGEDVGVNGGVFRATEGLQKEFGEDRVFDTPLAESGIGGLALGLGLNGFRPVMEIQFFGFVYEVMDSVSGQMARMRYRSGGRWTSPVTIRSPFGGGVHTPELHADSLEGLVAQQPGIKVVIPSTPYDAKGLLISAIRDNDPVVFLEHMKLYRSFRQEVPEEEYTIELGKADVKREGTDLSIITYGAMVHESLKAADELEKDGISAEVVDLRTVSPLDIDTIIASVEKTGRAIVVQEAQKQAGIAANVVAEINDRAILSLEAPVLRVAAPDTVFPFSQAESVWLPNHKDVLETARKVLEF

SEQ ID NO: 11225 - protein, 260 aa, Bacillus subtilis subsp. subtilis str. 168
MSRNKVEICGVDTSKLPVLKNEEMRKLFRQLQDEGDDSAREKLVNGNLRLVLSVIQRFNNRGEYVDDLFQVGCIGLMKSIDNFDLSHNVKFSTYAVPMIIGEIRRYLRDNNPIRVSRSLRDIAYKALQVRERLISETSKEPTAEDIAKVLEVPHEEIVFALDAIQDPVSLFEPIYNDGGDPIYVMDQISDERNTDSQWIEELALKEGMRRLNDREKMILRKRFFQGKTQMEVAEEIGISQAQVSRLEKAAIKQMNKNIHQ

SEQ ID NO: 11226 - protein, 406 aa, Bacillus subtilis subsp. subtilis str. 168
MLNNRNVLLCVSGGIAVYKACALTSKLVQAGANVKVIMTESACRFVSPLTFQALSRHEVYTDTFKEQNPSVISHIDAADWADLIIVAPATANVIGKLANGIADDMLTTTLLAATAPVWIAPAMNVHMYDHPAVKRNISVLYQDGYCFIEPSEGYLACGYVGKGRLEEPENIVKLAEKHFAEETSAPLEGKHVVITAGPTREAIDPVRFFTNKSTGKMGYALAEAAVQLGARVILISGPVSLDQPKGLAEFIPVQSAADMREAVLSVYDASDIVIKTAAVADFTPKTVFDHKMKKQDGGMTLELKRTVDILKELGEKKKEQILVGFAAETQDIEHYARKKLAAKNLDLIVANDVKANGAGFGADTNIVTIFFKDGHKRELPIMSKLDVSFEILQEIAALSKQTGERS

SEQ ID NO: 11227 - protein, 246 aa, Bacillus subtilis subsp. subtilis str. 168
MLNDKTAIVTGASRGIGRSIALDLAKSGANVVVNYSGNEAKANEVVDEIKSMGRKAIAVKADVSNPEDVQNMIKETLSVFSTIDILVNNAGITRDNLIMRMKEDEWDDVININLKGVFNCTKAVTRQMMKQRSGRIINVSSIVGVSGNPGQANYVAAKAGVIGLTKSSAKELASRNITVNAIAPGFISTDMTDKLAKDVQDEMLKQIPLARFGEPSDVSSVVTFLASEGARYMTGQTLHIDGGMVM

SEQ ID NO: 11228 - protein, 388 aa, Bacillus subtilis subsp. subtilis str. 168
MKNICLLGATGSIGEQTLDVLRAHQDQFQLVSMSFGRNIDKAVPMIEVFQPKFVSVGDLDTYHKLKQMSFSFECQIGLGEEGLIEAAVMEEVDIVVNALLGSVGLIPTLKAIEQKKTIALANKETLVTAGHIVKEHAKKYDVPLLPVDSEHSAIFQALQGEQAKNIERLIITASGGSFRDKTREELESVTVEDALKHPNWSMGAKITIDSATMMNKGLEVIEAHWLFDIPYEQIDVVLHKESIIHSMVEFHDKSVIAQLGTPDMRVPIQYALTYPDRLPLPDAKRLELWEIGSLHFEKADFDRFRCLQFAFESGKIGGTMPTVLNAANEVAVAAFLAGKIPFLAIEDCIEKALTRHQLLKKPSWRTFKKWTKIPGDTSIQYSHKVVCS

SEQ ID NO: 11229 - protein, 292 aa, Bacillus subtilis subsp. subtilis str. 168
MVKVMLGIISVTLIWGYTWVAMKVGIHDIPPLLFSGLRLFIGAVPLFLILFIQRKKLSIQKEHLKSYIIMSLLMGLGYMGILTYGMQFVDSGKTSVLVYTMPIFVTVISHFSLNEKMNVYKTMGLVCGLFGLLFIFGKEMLNIDQSALFGELCVLVAALSWGIANVFSKLQFKHIDIIHMNAWHLMMGAVMLLVFSFIFEAVPSAEWTYQAVWSLLFNGLLSTGFTFVVWFWVLNQIQASKASMALMFVPVLALFFGWLQLHEQITINIILGALLICCGIFMNTFTFSRRKV

SEQ ID NO: 11230 - protein, 452 aa, Bacillus subtilis subsp. subtilis str. 168
MKETQNAREKIKQLLHILIPIFITQAGLSLITFLDTVMSGKVSPADLAGVAIGSSLWTPVYTGLAGILMAVTPIVAQLLGAEKKQKIPFTVLQAVYVAALLSIAVLVIGYAAVDLILGRLNLDIHVHQIAKHFLGFLSLGIFPLFVYTVLRSFIDSLGKTRVTMMITLSSLPINFVLNYVFIFGKFGMPALGGVGAGLASALTYWCICIISFFIIHKNAPFSEYGIFLTMYKFSWKACKNLLKIGLPIGFAVFFETSIFAAVTLLMSHFHTVTIASHQAAMNFASLLYMLPLSVSMALTIVVGFEAGAARFKDARSYSLIGIMMAIGFSLFTAACILLFREQIAGMYTSDPDVLRLTQHFLIYALFFQLSDAVAAPIQGALRGYKDVNYTLAAAFVSYWVIGLPVGYMVGTFTSLGAFGYWIGLIAGLAAGAVGLFFRLAKLQKRYSQKQHI

SEQ ID NO: 11231 - protein, 254 aa, Bacillus subtilis subsp. subtilis str. 168
MGYLHDAFSLKGKTALVTGPGTGIGQGIAKALAGAGADIIGTSHTSSLSETQQLVEQEGRIFTSFTLDMSKPEAIKDSAAELFENRQIDILVNNAGIIHREKAEDFPEENWQHVLNVNLNSLFILTQLAGRHMLKRGHGKIINIASLLSFQGGILVPAYTASKHAVAGLTKSFANEWAASGIQVNAIAPGYISTANTKPIRDDEKRNEDILKRIPAGRWGQADDIGGTAVFLASRASDYVNGHILAVDGGWLSR

SEQ ID NO: 11232 - protein, 377 aa, Bacillus subtilis subsp. subtilis str. 168
MRKLKIGITCYPSVGGSGIIATELGKQLAEKGHEIHFITSSIPFRLNTYHPNIHFHEVEVNQYAVFKYPPYDLTLASKIAEVAERENLDIIHAHYALPHAVCAYLAKQMLKRNIGIVTTLHGTDITVLGYDPSLKDLIRFAIESSDRVTAVSSALAAETYDLIKPEKKIETIYNFIDERVYLKKNTAAIKEKHGILPDEKVVIHVSNFRKVKRVQDVIRVFRNIAGKTKAKLLLVGDGPEKSTACELIRKYGLEDQVLMLGNQDRVEDLYSISDLKLLLSEKESFGLVLLEAMACGVPCIGTNIGGIPEVIKNNVSGFLVDVGDVTAATARAMSILEDEQLSNRFTKAAIEMLENEFSSKKIVSQYEQIYADLAEPE

SEQ ID NO: 11233 - protein, 589 aa, Bacillus subtilis subsp. subtilis str. 168
MKFWKSVVGKLWFTILSLVLIVLFILTVLLLEFIENYHVEEAENDLTQLANKVAVILENHEDQALARSITWELADNLTSIAIIQDEKNHWYSPNDKNRLSSITVEQIQHDKDLNKALKDHKKVSKRTGLSDTDTDNERLIVGVPYEKDGKKGMVFLSQSLLAVKDTTKHTTRYIFLAAGIAIVLTTFFAFFLSSRVTYPLRKMREGAQDLAKGKFDTKIPILTQDEIGELATAFNQMGRQLNFHINALNQEKEQLSNILSSMADGVITINIDGTILVTNPPAERFLQAWYYEQNMNIKEGDNLPPEAKELFQNAVSTEKEQMIEMTLQGRSWVLLMSPLYAESHVRGAVAVLRDMTEERRLDKLREDFIANVSHELRTPISMLQGYSEAIVDDIASSEEDRKEIAQIIYDESLRMGRLVNDLLDLARMESGHTGLHYEKINVNEFLEKIIRKFSGVAKEKNIALDHDISLTEEEFMFDEDKMEQVFTNLIDNALRHTSAGGSVSISVHSVKDGLKIDIKDSGSGIPEEDLPFIFERFYKADKARTRGRAGTGLGLAIVKNIVEAHNGSITVHSRIDKGTTFSFYIPTKR

SEQ ID NO: 11234 - protein, 439 aa, Bacillus subtilis subsp. subtilis str. 168
MFLHGTSRQNQHGHLEIGGVDALYLAEKYGTPLYVYDVALIRERAKSFKQAFISAGLKAQVAYASKAFSSVAMIQLAEEEGLSLDVVSGGELYTAVAAGFPAERIHFHGNNKSREELRMALEHRIGCIVVDNFYEIALLEDLCKETGHSIDVLLRITPGVEAHTHDYITTGQEDSKFGFDLHNGQTERAIEQVLQSEHIQLLGVHCHIGSQIFDTAGFVLAAEKIFKKLDEWRDSYSFVSKVLNLGGGFGIRYTEDDEPLHATEYVEKIIEAVKENASRYGFDIPEIWIEPGRSLVGDAGTTLYTVGSQKEVPGVRQYVAVDGGMNDNIRPALYQAKYEAAAANRIGEAHDKTVSIAGKCCESGDMLIWDIDLPEVKEGDLLAVFCTGAYGYSMANNYNRIPRPAVVFVENGEAHLVVKRETYEDIVKLDLPFKTGVKQ

SEQ ID NO: 11235 - protein, 255 aa, Bacillus subtilis subsp. subtilis str. 168
MDVEVKKNGKNAQLKDHEVKELIKQSQNGDQQARDLLIEKNMRLVWSVVQRFLNRGYEPDDLFQIGCIGLLKSVDKFDLTYDVRFSTYAVPMIIGEIQRFIRDDGTVKVSRSLKELGNKIRRAKDELSKTLGRVPTVQEIADHLEIEAEDVVLAQEAVRAPSSIHETVYENDGDPITLLDQIADNSEEKWFDKIALKEAISDLEEREKLIVYLRYYKDQTQSEVAERLGISQVQVSRLEKKILKQIKVQMDHTDG

SEQ ID NO: 11236 - protein, 327 aa, Bacillus subtilis subsp. subtilis str. 168
MSVMSYIDAINLAMKEEMERDSRVFVLGEDVGRKGGVFKATAGLYEQFGEERVMDTPLAESAIAGVGIGAAMYGMRPIAEMQFADFIMPAVNQIISEAAKIRYRSNNDWSCPIVVRAPYGGGVHGALYHSQSVEAIFANQPGLKIVMPSTPYDAKGLLKAAVRDEDPVLFFEHKRAYRLIKGEVPADDYVLPIGKADVKREGDDITVITYGLCVHFALQAAERLEKDGISAHVVDLRTVYPLDKEAIIEAASKTGKVLLVTEDTKEGSIMSEVAAIISEHCLFDLDAPIKRLAGPDIPAMPYAPTMEKYFMVNPDKVEAAMRELAEF

SEQ ID NO: 11237 - protein, 633 aa, Bacillus subtilis subsp. subtilis str. 168
MDLLSIQDPSFLKNMSIDELEKLSDEIRQFLITSLSASGGHIGPNLGVVELTVALHKEFNSPKDKFLWDVGHQSYVHKLLTGRGKEFATLRQYKGLCGFPKRSESEHDVWETGHSSTSLSGAMGMAAARDIKGTDEYIIPIIGDGALTGGMALEALNHIGDEKKDMIVILNDNEMSIAPNVGAIHSMLGRLRTAGKYQWVKDELEYLFKKIPAVGGKLAATAERVKDSLKYMLVSGMFFEELGFTYLGPVDGHSYHELIENLQYAKKTKGPVLLHVITKKGKGYKPAETDTIGTWHGTGPYKINTGDFVKPKAAAPSWSGLVSGTVQRMAREDGRIVAITPAMPVGSKLEGFAKEFPDRMFDVGIAEQHAATMAAAMAMQGMKPFLAIYSTFLQRAYDQVVHDICRQNANVFIGIDRAGLVGADGETHQGVFDIAFMRHIPNMVLMMPKDENEGQHMVHTALSYDEGPIAMRFPRGNGLGVKMDEQLKTIPIGTWEVLRPGNDAVILTFGTTIEMAIEAAEELQKEGLSVRVVNARFIKPIDEKMMKSILKEGLPILTIEEAVLEGGFGSSILEFAHDQGEYHTPIDRMGIPDRFIEHGSVTALLEEIGLTKQQVANRIRLLMPPKTHKGIGS

SEQ ID NO: 11238 - protein, 359 aa, Bacillus subtilis subsp. subtilis str. 168
MNILMLSPEHPDEPKSGLGVHLNRLISYLNPHINITVFTPSGQLFSYAKFEDYIADANFTMVRHVLSHNKRFDLIHAHDDTTAPAAQYLKQRLGLPLAATIHGLESERKKVCREAPHPYRLMTERLLIESADALIVLSTFMKRSLDKAAHKKITVIPSPASMEEEKGKIPRSMNRRFLFSYGRFVPEKGLSQLLKVFAILKQRQPDLYLVLAGEGPSLSCYEKLAAAYNLKDRIMFLPFLNRKDIRTLLSHCEMAVFPSSYEPFGLAAQESMEQGVLTVVSQSGGFCDYAVHDKTAIIADFTLVQEAADLLDSFLKDREKARRIKEAGRQQVFKLHHPRLIMSSYLQLYERIFNNSAIH

SEQ ID NO: 11239 - protein, 371 aa, Bacillus subtilis subsp. subtilis str. 168
MADKQTHETELTFDQVKEQLTESGKKRGVLTYEEIAERMSSFEIESDQMDEYYEFLGEQGVELISENEETEDPNIQQLAKAEEEFDLNDLSVPPGVKINDPVRMYLKEIGRVNLLSAKEEIAYAQKIEEGDEESKRRLAEANLRLVVSIAKRYVGRGMLFLDLIHEGNMGLMKAVEKFDYRKGYKFSTYATWWIRQAITRAIADQARTIRIPVHMVETINKLIRVQRQLLQDLGREPTPEEIAEDMDLTPEKVREILKIAQEPVSLETPIGEEDDSHLGDFIEDQEATSPSDHAAYELLKEQLEDVLDTLTDREENVLRLRFGLDDGRTRTLEEVGKVFGVTRERIRQIEAKALRKLRHPSRSKRLKDFLE

SEQ ID NO: 11240 - protein, 280 aa, Bacillus subtilis subsp. subtilis str. 168
MTTHLQAKATLHNGVEMPWFGLGVFQVEEGSELVNAVKTAIVHGYRSIDTAAIYGNEAGVGEGIREGIEEAGISREDLFITSKVWNADLGYEETLAAFETSLSKLGLDYLDLYLIHWPVEGKYKEAWRALETLYKEGRIKAIGVSNFQIHHLEDLMTAAEIKPMINQVEFHPRLTQKELIRYCQNQGIQMEAWSPLMQGQLLDHPVLADIAQTYNKSVAQIILRWDLQHGIITIPKSTKEHRIKENASVFDFELTQDDMNRIDALNENLRVGPDPDNFDF

SEQ ID NO: 11241 - protein, 579 aa, Bacillus subtilis subsp. subtilis str. 168
MNKYRVRLFSVFVVCMILVFCVLGLFLQQLFETSDQRKAEEHIEKEAKYLASLLDAGNLNNQANEKIIKDAGGALDVSASVIDTDGKVLYGSNGRSADSQKVQALVSGHEGILSTTDNKLYYGLSLRSEGEKTGYVLLSASEKSDGLKGELWGMLTASLCTAFIVIVYFYSSMTSRYKRSIESATNVATELSKGNYDARTYGGYIRRSDKLGHAMNSLAIDLMEMTRTQEMQRDRLLTVIENIGSGLIMIDGRGFINLVNRSYAKQFHINPNHMLRRLYHDAFEHEEVIQLVEDIFMTETKKCKLLRLPIKIERRYFEVDGVPIMGPDDEWKGIVLVFHDMTETKKLEQMRKDFVANVSHELKTPITSIKGFTETLLDGAMEDKEALSEFLSIILKESERLQSLVQDLLDLSKIEQQNFTLSIETFEPAKMLGEIETLLKHKADEKGISLHLNVPKDPQYVSGDPYRLKQVFLNLVNNALTYTPEGGSVAINVKPREKDIQIEVADSGIGIQKEEIPRIFERFYRVDKDRSRNSGGTGLGLAIVKHLIEAHEGKIDVTSELGRGTVFTVTLKRAAEKSA

SEQ ID NO: 11242 - protein, 512 aa, Bacillus subtilis subsp. subtilis str. 168
MLKHISSVFWIVIAITAAAVLWGVISPDSLQNVSQSAQAFITDSFGWYYLLVVSLFVGFCLFLIFSPIGKIKLGKPDEKPEFGLLSWFAMLFSAGMGIGLVFYGAAEPISHYAISSPSGETETPQAFRDALRYTFFHWGLHAWAIYAIVALCIAYFQFRKGAPGLISSTLSPILGDKVNGPIGKAIDCIAVFATVVGVSTSLGLGATQINGGLNYLFGIPNAFIVQLVLIIIVTVLFLLSAWSGLGKGIKYLSNTNMVLAGLLMLFMLVVGPTVLIMNSFTDSIGQYIQNIVQMSFRLTPNDPEKREWINSWTIFYWAWWISWSPFVGIFIARVSRGRTIREFLIGVLVTPCILTFLWFSIFGVSAMDLQQKGAFNVAKLSTETMLFGTLDHYPLTMVTSILALILIAVFFITSADSATFVLGMQTSYGSLNPANSVKLSWGIIQSAMAAVLLYSGGLAALQNTAILAALPFSIVILLMIASLYQSLSKERREIKKAEKLDKPRSPRVKKAY

SEQ ID NO: 11243 - protein, 261 aa, Bacillus subtilis subsp. subtilis str. 168
MASFQSFGIPGQLEVIKKALDHVRVGVVITDPALEDNPIVYVNQGFVQMTGYETEEILGKNCRFLQGKHTDPAEVDNIRTALQNKEPVTVQIQNYKKDGTMFWNELNIDPMEIEDKTYFVGIQNDITKQKEYEKLLEDSLTEITALSTPIVPIRNGISALPLVGNLTEERFNSIVCTLTNILSTSKDDYLIIDLSGLAQVNEQTADQIFKLSHLLKLTGTELIITGIKPELAMKMNKLDANFSSLKTYSNVKDAVKVLPIM

SEQ ID NO: 11244 - protein, 407 aa, Bacillus subtilis subsp. subtilis str. 168
MKLAFICTEKLPAPAVRGGAIQMMIDGVTPYFSSRYDLTIFSIEDPSLPKRETKDGVHYIHLPKEHYREAVAEELRASSFDLIHVFNRPLNVSLYKKASPNSKIVLSLHNEMFSEKKMTFAQGKEVLDNVSMITTVSEFIKQTVIERFPEAEDITKVVYSGVDLNSYPPVWTMKGSAVRKTYRKKYGIEDKKVILFAGRLSPTKGPHLLIHSMRRILQQHPDAVLVIAGGKWFSDDSENQYVTYLRTLALPYRDHIIFTKFIPADDIPNLFLMADVFVCSSQWNEPLARVNYEAMAAGTPLITTNRGGNGEVVKHEVTGLVIDSYNKPSSFAKAIDRAFTDQELMNKMTKNARKHVEALFTFTHAAKRLNTVYQSVLTPKNKQFPPPFLTQNFDLSSINQLFVKAKT

SEQ ID NO: 11245 - protein, 490 aa, Bacillus subtilis subsp. subtilis str. 168
MSQTLFIDGEWISAEKEQIRSIINPFNQEEIATVSEGGREDAIKAIAAARRAFDKGEWSSLSGLERGKIVLKIAELIRRDLEELAELESLDTGKTLEESKADMDDIANVFQYYAGLADKDGGEIISSPIPDSESKIIREPIGVCGQITPWNYPLLQASWKIAPALAAGNTIVMKPSEITPLTTIKVFKLMEEAGVPKGVANLVLGPGATVGDELAVNKDVDLISFTGGIETGKKIMRAASGNVKKIALELGGKNPNIVFKDADLEVAVDQALNAVFFHAGQVCSAGSRLLVEDAIHDQFLAELVKRAKRIKLGNGFHAETESGPLISAEHRAKVEKYVEIGIEEGAKLETGGKRPEDPELQNGFFYEPTIFSNCNSDMRIVQEEVFGPVLTVETFSSEEEVIELANDTIYGLAGAVWSKDIEKCERVAARLRMGTVWINDFHPYFAQAPWGGYKQSGFGRELGKIGLEEYTEVKHVYRNTKPAAVNWFNS

SEQ ID NO: 11246 - protein, 326 aa, Bacillus subtilis subsp. subtilis str. 168
MENVFDYEDIQLIPAKCIVNSRSECDTSVRLGGHTFKLPVVPANMQTIIDEKLAISLAENGYFYVMHRFEPETRIDFIKDMNARGLFSSISVGVKDEEYEFVRQLAEENLTPEYVTIDIAHGHSNAVIEMIQHLKKHLPDSFVIAGNVGTPEAVRELENAGADATKVGIGPGKVCITKIKTGFGTGGWQLAALRWCAKAASKPIIADGGIRTHGDIAKSIRFGATMVMIGSLFAGHEESPGQTIEKDGKLYKEYFGSASEFPKGEKKNVEGKKMHVAHKGSIKDTLIEMEQDLQSSISYAGGTKLNAIRNVDYVIVKNSIFNGDKY

SEQ ID NO: 11247 - protein, 263 aa, Bacillus subtilis subsp. subtilis str. 168
MDLQLKEKLVLITGSTSGIGKAAAKSFLQEGAAVIVNGRKQETVDRTIEELSGYGTVHGAAADLSKTDEAAAFIEKVNEIGDIDILVNNLGFFEVKDFADVTDEEWNQYFEVNVMSAVRTSRHFLPKMLAKNSGRILNIASEAGVKPLPTMIPYSMTKTALISLSRGMAEMTKGTNVTVNSVLPGPTWTEGVASYMEGAAQAAGQDTDTFIKDYFKVNEPTSLIQRYATAEEVANTIVFLASDAASAINGTAQRVEGGIIRSL

SEQ ID NO: 11248 - protein, 276 aa, Bacillus subtilis subsp. subtilis str. 168
MPTSLKDTVKLHNGVEMPWFGLGVFKVENGNEATESVKAAIKNGYRSIDTAAIYKNEEGVGIGIKESGVAREELFITSKVWNEDQGYETTLAAFEKSLERLQLDYLDLYLIHWPGKDKYKDTWRALEKLYKDGKIRAIGVSNFQVHHLEELLKDAEIKPMVNQVEFHPRLTQKELRDYCKGQGIQLEAWSPLMQGQLLDNEVLTQIAEKHNKSVAQVILRWDLQHGVVTIPKSIKEHRIIENADIFDFELSQEDMDKIDALNKDERVGPNPDELLF

SEQ ID NO: 11249 - protein, 670 aa, Bacillus subtilis subsp. subtilis str. 168
MDIFLVVLVLLTIIAISNIVNRFIPFIPVPLIQVALGILAASFPQGLHFELNTELFFVLFIAPLLFNDGKRTPRAELWNLRAPILLLALGLVFATVIVGGYTIHWMIPAIPLAAAFGLAAILSPTDVVAVSALSGRVKMPKGILRLLEGEGLMNDASGLVAFKFAIAAAVTGAFSLAQAAVSFVFISLGGLLCGVVISFLIIRFRLFLRRLGMQDVTMHMLIQILTPFVIYLAAEEIGVSGILAVVAGGITHAVEQDRLESTMIKLQIVSSSTWNIILFILNGLVFVILGTQIPDVISVIFNDTAISNMKVIGYILVITFTLMLLRFLWVLFFWNGKWFFNKDQNIYKPGLRSTLLISISGVRGAVTLAGSFSIPYFLEDGTPFPERNLILFLAAGVILCTLVIATVVLPILTEKEEEDEERNKKLLTARRKLIKTALQTIKEDMNETNKTASLAVIAEYNEKMKNLRFQQYTSSNRIKKHERKVRAQGVKAEQEALMKMLERGDIPEETANVLQERFNELEILYANPFKVGLSKTRLKRLMYWIFFGEHKKPEMSILNEAGLIRATRVKTAKAAIEYLEKHKTDEHKEVFLSVITFYKQLIFRLEHSHHELKSSAHFENQKLEVKLKAVQAIRNEIQTLFEEREISRDISHELRQYINDVEAAMLEGGE

SEQ ID NO: 11250 - protein, 430 aa, Bacillus subtilis subsp. subtilis str. 168
MPYIVDVYAREVLDSRGNPTVEVEVYTETGAFGRALVPSGASTGEYEAVELRDGDKDRYLGKGVLTAVNNVNEIIAPELLGFDVTEQNAIDQLLIELDGTENKGKLGANAILGVSMACARAAADFLQIPLYQYLGGFNSKTLPVPMMNIVNGGEHADNNVDIQEFMIMPVGAPNFREALRMGAQIFHSLKSVLSAKGLNTAVGDEGGFAPNLGSNEEALQTIVEAIEKAGFKPGEEVKLAMDAASSEFYNKEDGKYHLSGEGVVKTSAEMVDWYEELVSKYPIISIEDGLDENDWEGHKLLTERLGKKVQLVGDDLFVTNTKKLSEGIKNGVGNSILIKVNQIGTLTETFDAIEMAKRAGYTAVISHRSGETEDSTIADIAVATNAGQIKTGAPSRTDRVAKYNQLLRIEDQLAETAQYHGINSFYNLNK

SEQ ID NO: 11251 - protein, 305 aa, Bacillus subtilis subsp. subtilis str. 168
MKQLPKTRTALLLAFLVIMWGVNWPLSKAALAYSPPLLFAGIRTLIGGLLLVIVALPRIHKLRLKETWPIYLVSALLNITLFYGLQTIGLNYLPAGLFSAIVFFQPVLMGVFSWLWLGESMFVMKVIGLILGFAGVAVISAAGFGGHISVIGVLLALGSAVSWALGTVYMKKTGSRVDSIWMVALQLTIGSVFLLISGFWTESFSAIQWTAPFITSLLFISVFVIALGWLVFFTLVGSGEASKVASYTFLIPLISIVASSIFLHEPLTLSLLAGLLLIVTSICLVNTKSKAQKAAAIGINEKAAQ

SEQ ID NO: 11252 - protein, 226 aa, Bacillus subtilis subsp. subtilis str. 168
MKAVIFDLDGVITDTAEYHFLAWKHIAEQIDIPFDRDMNERLKGISREESLESILIFGGAETKYTNAEKQELMHRKNRDYQMLISKLTPEDLLPGIGRLLCQLKNENIKIGLASSSRNAPKILRRLAIIDDFHAIVDPTTLAKGKPDPDIFLTAAAMLDVSPADCAAIEDAEAGISAIKSAGMFAVGVGQGQPMLGADLVVRQTSDLTLELLHEEWEQYRIRESIP

SEQ ID NO: 11253 - protein, 116 aa, Bacillus subtilis subsp. subtilis str. 168
MSGQMFKVEIVTRPANFEKLKQELGKIGVTSLTFSNVHGCGLQKAHTELYRGVKIESNVYERLKIEIVVSKVPVDQVTETAKRVLKTGSPGDGKIFVYEISNTINIRTGEEGPEAL

SEQ ID NO: 11254 - protein, 321 aa, Bacillus subtilis subsp. subtilis str. 168
MERSLSMELVRVTEAAALASARWMGRGKKDEADEAATSAMRDVFDTVPMKGTVVIGEGEMDEAPMLYIGEKLGNGYGPRVDVAVDPLEGTNILASGGWNALTVIAVADHGTLLNAPDMYMQKIAVGPEAVGCIDIEAPVIDNLKAVAKAKNKDVEDVVATILNRERHAKIISELREAGARIKLINDGDVAGAINTAFDHTGVDILFGSGGAPEGVLSAVALKALGGEIIGKLLPQSEEEITRCHKMGLDLSKVLRMEDLVKGDDAIFAATGVTDGELLKGVQFKGSVGTTESLVIRAKSGTVRFVDGRHSLKKKPNLVIRP

SEQ ID NO: 11255 - protein, 395 aa, Bacillus subtilis subsp. subtilis str. 168
MINRQHIQLSLQSLSLVAGFMVWVLISSLISQITLDIHLSKGEISLVTAIPVILGSLLRIPLGYLTNRFGARLMFMVSFILLLFPVFWISIADSLFDLIAGGFFLGIGGAVFSIGVTSLPKYYPKEKHGVVNGIYGAGNIGTAVTTFAAPVIAQAVGWKSTVQMYLILLAVFALLHVLFGDRHEKKVKVSVKTQIKAVYRNHVLWFLSLFYFITFGAFVAFTIYLPNFLVEHFGLNPADAGLRTAGFIAVSTLLRPAGGFLADKMSPLRILMFVFTGLTLSGIILSFSPTIGLYTFGSLTVAVCSGIGNGTVFKLVPFYFSKQAGIANGIVSAMGGLGGFFPPLILASVFQATGQYAIGFMALSEVALASFVLVIWMYWQERMKTHTERNSQSIN

SEQ ID NO: 11256 - protein, 259 aa, Bacillus subtilis subsp. subtilis str. 168
MSKRTAFVMGASQGIGKAIALKLADQHFSLVINSRNLDNIESVKEDILAKHPEASVIVLAGDMSDQHTRAGIFQKIESQCGRLDVLINNIPGGAPDTFDNCNIEDMTATFTQKTVAYIDAIKRASSLMKQNEFGRIINIVGNLWKEPGANMFTNSMMNAALINASKNISIQLAPHNITVNCLNPGFIATDRYHQFVENVMKKNSISKQKAEEQIASGIPMKRVGSAEETAALAAFLASEEASYITGQQISADGGSMKSI

SEQ ID NO: 11257 - protein, 255 aa, Bacillus subtilis subsp. subtilis str. 168
MIMNLTDKTVLITGGASGIGYAAVQAFLGQQANVVVADIDEAQGEAMVRKENNDRLHFVQTDITDEAACQHAVESAVHTFGGLDVLINNAGIEIVAPIHEMELSDWNKVLQVNLTGMFLMSKHALKHMLAAGKGNIINTCSVGGLVAWPDIPAYNASKGGVLQLTKSMAVDYAKHQIRVNCVCPGIIDTPLNEKSFLENNEGTLEEIKKEKAKVNPLLRLGKPEEIANVMLFLASDLSSYMTGSAITADGGYTAQ

SEQ ID NO: 11258 - protein, 284 aa, Thermoplasma acidophilum
MNGMQTAEFDGTGRKVSVIGVGTWSLEGSRSENVRSIRYALDHGVNFIDTAEMYGTEDIVGEAIKGYRREDLFIATKVWPTHFAYHDVLKSCEESLKKLGTDYVDLYQLHWPNPSVSIKETMSAMEKLVDEGRIRYIGISNFSVKEMKEAMSALAKYRIVSNQLEYNVATREIEDEGIYDFCRKNGMAIIAYSPLSHGKIFGNEMILETLTDIGKKYGKRPAQVALNWIIRKGAFPIPKASKPIHMAENIESTDFTLSDEDMKTLDSLYQRHPIRSIASRYKGH

SEQ ID NO: 11259 - protein, 268 aa, Thermoplasma acidophilum
MDENRGSRIAINLTGKIALVTGSSSGLGAAIAKYMARAGAKVAVHYRSGKDRADAIVDEIKNDGGFAMAFYGDVSKKEDVQKLFSEIDSKLGTVDILVNNAGIDGKRELVGEDDPDDWEKVIEVNLMGPYYCAREAVKRMKPKKSGVIINITSVHEYVPWSGYTAYSSAKAGLSMFTKALAQELSDYNIRVVAIAPGAIKTPINKDVWGNPESLKDLLNKIAMPRLGEVDDIGQAAVFLASDLASYITGTTLLVDGGMALYPDFKHGG

SEQ ID NO: 11260 - protein, 485 aa, Thermoplasma acidophilum
MYREKFTKITEGFTFDDVLLIPMRTAVEPKNVVVSSRISRHIQVKVPIVSSPMDTVTEDAMAIAMARYGAIGVIHRNQPREKEVEMVKRVKREETIIIRDVYTISPETPIEVARTLMATRNIAGLPVVKDDKLVGIVTKRDLEFVKKGSSVSDVMVRDVITAPENVDIDEAIEILHKNRIEKLPLVDSSGHLVGLITAKDIITRQKFPDASRDSEGQLMVGAAVGPFDLDRAVEVEKAGADFIVVDTAHADNENVLSSLKKMRKQISVDIVAGNIATAQAAEDLISCDVDGLRVGIGPGSICTTRIVAGVGVPQLTAISDVAEAAKDSGIPVIADGGIRYSGDIVKAIAAGADAVMLGSMLAGTEESPGQEMIINGRKYKAYRGMGSIGALTTGLSDRYSKLGNGFIAEGVEGAVPYRGRVDEVLFQLVGGLRTGMGYVGAATIEDLKRNGKFVRITNNGLRESHPHDIRLISEPPNYQISNISP

SEQ ID NO: 11261 - protein, 285 aa, Thermoplasma acidophilum
MQKNGEPVLFFFMAFFWGLNYIMVKYAYVYDVSSSILLMRVLYALVFSAIIFVRQIRFPRTPMEHLKVFVLSNLNITAFFALWFFGETGVSASLTSIVIYSYPIMSLVASYALLNDRFGRGKAMGIALGFAGLIIIFFRSINVSNYIDLIMLILAALSWAMGTVFYRKFLTGYDSAGLNTLQLLYAMPAVILIAFMTGGINRNLMIPQFNLIMLYMGSLGTAVAYFIFLTLYRRYRVSDISAFFFIVPAISVILSVILLHEAVSRIMLIGFAVMSVGIYLSGRLR

SEQ ID NO: 11262 - protein, 485 aa, Thermoplasma acidophilum
MENGVRYSDLIERLDMSRVTRFYWLLTILATIGGFLFGYDTSNIGSALPLLERIYPGISGFVEGYLVAGASLGAAVGAIIAAGLTDRYGRKYLLIADAAIYAAGALLSAFTVDLVMLLLSRTLIGIAVGADSGIATAYIAEYAPKARRGSLGILQQWMITIGILAAYLIGMATLFFAPGLAYAVGWRIMLGVAAIPAIIGLAFRFMMPESPRWLLVNGKYKEASASLKRLGLNMSEEDLKSVKLSQPHKITPGVKRALLIVGLFFVFQQITGINIPFYYGPVVLENLHIVGKSTSLVYSIYYSIAASAILAIINVAATYIGFRYIDSVGRRKLALMGYAGMTFFGILGGILLYLKLDIGLFIAFAGFIIFFAFGVGGTGWMIQGEYFPTSMRGLYASLGAFIDWIANFAIIELFPVMDSAITIKNVEFVFGVLSLIALILFYYIMPETKGLSVEQIDTLFENNSLGQMKHASISMKKESVPADPK

SEQ ID NO: 11263 - protein, 314 aa, Thermoplasma acidophilum
MKEVSQQKKELVNEITQRIKASRSVAIVDTAGIRTRQIQDIRGKNRGKINLKVIKKTLLFKALENLGDEKLSKLKENSGGQIALLTSDLEPTEIYKIIESTFQKTAPRGGEIAPEDIVIQPMTTGFPPGPMMTEFQKVGLQTGVEKGKIAIKKETVFVKKGETIPKDKAKILEMLEIKPLEVGLQLLGLYSEGVVYSKEVLSLTPERIANDMAAAFSQAKAIAKSSMFFVDEVLRDLLAEAKIKADALALAGQFITEDNVKDFLVRANVNAIILNNVLNKGSTQETPEEKKEEAKKEEKSPDESISEGLGALFQ

SEQ ID NO: 11264 - protein, 295 aa, Thermoplasma acidophilum
MKIKMQDSVSFRMEFREFGKTGEKISKIGVGTYYDVGWMFLARFGRKSGSEMKIRAIRTAVENGVTLIDTAEVYGSEDLVARAIEGVDRESLFIATKVWITHLSYDSAIKACKRSLKRLNMKYIDLYQIHFPSPIGDIEGTLRAMEKLVDDGLIRYIGVSNFNLDQLKHAMEAMKKYEIVSNQVHYSLRHRDPETDMIPFAEKNGMAILAWYPLEHGDLVRDEAYPTAFLSDLRKRYPEMRASQIALSYLMEANSNVFPIPRASNPDHVLENINSVKYHLSEGEIKILKDSFRSL

SEQ ID NO: 11265 - protein, 410 aa, Thermoplasma acidophilum
MTESKGFLRLAWARDHMPVIAEIRKRFQAEKPFKGIKVAMALHVEAKTGIFALLLKEGGAEVKMASCNPLSSDDSVVQSLKEDYGMPVFARKGETSEEYYEYLHRTLDVQPDIIIDDGGDLTKIVHTERKDLAKNILGGNEETTTGVQRLRAMERSGVLLFPMFDVNDANMKHLFDNRYGTGQSTLDGIMNATNLLIAGRTVVVAGYGYCGRGIAMRLKGMGANVIVTEIDPIKANEAIMDGFQVRRMNNAIRDADMVITATGMKDVVKYEDALVAKKNIVLANAGHFNNEVAVSEIEKRSLEVNEVREFVKRYRLENGNTVDIIADGRLVNLAAGQGHPVEIMDLSFALQALTAEYLVKNHDKLERKVYPVPADIDRYVAEIRLKQFGGELDQLNEEQIKYLNSWDEGT

SEQ ID NO: 11266 - protein, 316 aa, Thermoplasma acidophilum
MKSESLRDVYGKELVKLGSFDRDIVVLDADLSSSTKTGYFANAFPDRFFNMGISEQSMVTTAAGLALSGKKPFVSTFAIFLTRTYEQIRQSVCYNNAPVRFVVTHGGITVGEDGATHQIVEDVGIMAGLPNMNVIVPADSVETRSVVDYLAGVDKPHYVRLSREKFPVINDEDYEFKIGKSKTIRDGADLTIIADGVMVSKSLEAAESLKKNGVDARVINMSSIKPTDRDAIIKAAKETGHIVTAEEHSIYNGLGSRVAEITSESYPVPVRRIGMRDTFGKSGKAWELFSYFHMDVKDIINEAMTCLEEKNYENIP

SEQ ID NO: 11267 - protein, 258 aa, Thermoplasma acidophilum
MTSAKYIFDFSGSTAVVTGAFQGIGKAIADALLDAGAEVYGIDKAFPDHGVDEGRFHGLHGSVDSLDDIASLRDRVAETSGRLDFLVNNAGIYFYKKIEDSTEDDYERITSVNLKGYFLMTREFLQLLRKSDYPSIVNIASVSGQRPEAGHPLYSMTKGGILALTRALSADLGMLGIRVNSVSPGNIKTPMNDEDILDQARKRGLDPDEVERQYAAESVLGRRGEAAEVASVVLFLLSKGASYINGADIVVDGGLLLV

SEQ ID NO: 11268 - protein, 255 aa, Thermoplasma acidophilum
MFSDLRDKVVIVTGASMGIGRAIAERFVDEGSKVIDLSIHDPGEAKYDHIECDVTNPDQVKASIDHIFKEYGSISVLVNNAGIESYGKIESMSMGEWRRIIDVNLFGYYYASKFAIPYMIRSRDPSIVNISSVQASIITKNASAYVTSKHAVIGLTKSIALDYAPLLRCNAVCPATIDTPLVRKAAELEVGSDPMRIEKKISEWGHEHPMQRIGKPQEVASAVAFLASREASFITGTCLYVDGGLSIRAPISTPE

SEQ ID NO: 11269 - protein, 474 aa, Thermoplasma acidophilum
MESNAYAKPVKVPGRSIITSLSAMGYFLDGYDLSVISVFTLVLVTYHIFRYTAFTESFVTGSALLGAFVGAVLFGHYADRIGRRYLYIFDLIFFAVFAVLTALATNIYEMIAFRFFVGLGVGADYSLSPVYTTEMYPNAKRGGGYGWVWTFWSLGAAAAFIIGYGFYLIDPLTGWRWTLGLGAIPAIVVVVMRMRMPESIRWKAADKNVSEQEIRDVADSIGIKKEEMDSIMAERNRESRIRSGSLSSLFKGEYGKRTLIVWIQWILYDIAGYGIGLYSPLILKELGVSGSYTLLYSFMFYMPIGFMGAFGAVMLNDRVGRRPLQILGFGSMALAILLFFFAASGKGQVFLAIGILAFIIDYALGNLGPGNTMGLYAIELLPTKLRSSSMGSATGITRIVSFLSAFLFPYLSKPTVLGKEGFFFVLFVVMILALIFTIFFTPETKGLSLEEITVAKYRHEGWKPVLALDDTSKK

SEQ ID NO: 11270 - protein, 493 aa, Thermoplasma acidophilum
MDTKLYIDGQWVNSSSGKTVDKYSPVTGQVIGRFEAATRDDVDRAIDAAEDAFWAWNDLGSVERSKIIYRAKELIEKNRAELENIIMEENGKPVKEAKEEVDGVIDQIQYYAEWARKLNGEVVEGTSSHRKIFQYKVPYGIVVALTPWNFPAGMVARKLAPALLTGNTVVLKPSSDTPGSAEWIVRKFVEAGVPKGVLNFITGRGSEIGDYIVEHKKVNLITMTGSTATGQRIMQKASANMAKLILELGGKAPFMVWKDADMDNALKTLLWAKYWNAGQSCIAAERLYVHEDIYDTFMSRFVELSRKLALGDPKNADMGPLINKGALQATSEIVEEAKESGAKILFGGSQPSLSGPYRNGYFFLPTIIGNADQKSKIFQEEIFAPVIGARKISSVEEMYDLANDSKYGLASYLFTKDPNIIFEASERIRFGELYVNMPGPEASQGYHTGFRMTGQAGEGSKYGISEYLKLKNIYVDYSGKPLHINTVRDDLFQ

SEQ ID NO: 11271 - protein, 401 aa, Thermoplasma acidophilum [sequence omitted]

SEQ ID NO: 11272 - protein, 886 aa, Thermoplasma acidophilum
MAQIEKFVYRFDEGGKEMVDLLGGKGAGLAEMTKIGLNVPPGFTITTKACIAFLKHGGFPEGMMDQVMQALHDLENKVGRVFGDEKNPLLVSVRSGAPVSMPGMMDTVLNVGLNDSTVEGLAFMTDNRRFAMDAYRRLIQMFGEIVYGLPHEEFREKIEEVKRMRGYDEDRFTVQDLQGLIDQYTVIYRKHGKIFPQDPETQLVESIKSVFNSWNSKRAVAYRKMNGIPDDMGTAVSIVAMVFGNMGDDSATGVAFTRDPNTGEKKVFAEYLTNAQGEDVVAGIRTPKYIDDMQNEMPQVYADLMKTCDILEHHYRDMQDIEFTVERGKLYLLQTRTGKRSAKAAIRIAIDMVDEGIISEEEALMRITPATFDRTMHPQVKTTGREIPLGKGLAASPGAASGMIVFSSERALEIGKSKKMILVRPETTADDVRGMAVCEGFLTQKGGMTSHAAVVARAMGKPAVVGVESMSVNANEKTLTIGGKKLREGDVVTIDGTSGYFYEGELPVEKPTVDDYSKRLLEIADKYRRLGVRANANTPEEAKIARENGAEGIGLARTERMFLGNDRIGIMRSMIMSETPEDRKKYLDQLLPMQIHDFVEFFRTMEGYPVIIRLLDPPLHEFLPNKEDIIRQIYDVNNGKGKIEDLPYLEKLLKTVRDLEEFNPMLGFRGCRVGLVYPEIYDMQVRAIIEAAAKVIEEGREIYPEIMIPLVGHHNELRKIRARLEETAKSVRNHEKVKYKFGTMIEIPRACVTADKIAQYADFFSFGTNDLTQMTFGYSRDDAEGKFMFFYLENGILESDPFSSVDRDGVGELMKMAVERGKRAKPDLEVGICGEQGGDPDTIEFCDEIGLDYVSASPHRIPVARLAAARSSIARNRPEMTQISKY

SEQ ID NO: 11273 - protein, 459 aa, Thermoplasma acidophilum
MISSMTESWEELKERAYGPMDKQKSKWFNYKMLLLTGGGIFVDGYNIVIISFGLAGIETLFGLQHNAFLVGLIGISVIIGNLVGALLSGYFVDKVGRRTIFIIDLILFVFFAIISGLVTNAYELVVARLLVGLGIGLDYPIATSYLSEYTPINPRGKFLVMNITFFNIAGVVAAIVGYSLLPLGATIAWRYMLMSAAVPAAITIAGRIRTPESPRWLLEHGRKKEAIQAIERVTESTLPDDTQKFIMDSNVKPPVSGYYKELLTKYTKSAIFIGLFYFFFAIAFVNASLYGPSILASFGEAGLIGSSLYWLLFVVGDIICILVIDSFGRRNSTLTGWAGMLITMIILAFAPSNLKLLSLGAFILFAMFQGIGPGSLHMVYSPELFPTRIRATAEGWKQGIGRLGGVLTGLFFPSLVIGDKLLILILTSIAGLVLSILMAPETKRKGLEEISEKDINLQI

SEQ ID NO: 11274 - protein, 285 aa, Thermoplasma acidophilum
MDRKDAIYLALLIFVTFIWGVTFPMIKDVFAYLSPVSFLAVRFAVASLIFLPFVYRKLIQTNRNTIKYGVVAGIFLFIAYYLQTVGLKYTEPALSGTITGIYVVFVPIISYLYLKRRVMRIEVYSSVFAFLGLVLMSYSGLHNLAIESGDILTFIAAIFYAMQLVYISKYASNVDPLVFSFLQIVVVGVLSLAFMPTDMYPIVFSYYALFVIVFTAIFATFLATYVYVSALSRMNVTKVGVILIGEPIFADITSIFLFNEPVGPIEILGICIMIVSIGVISYFSD

SEQ ID NO: 11275 - protein, 304 aa, Thermoplasma acidophilum
MKAKIPEYVFEGSVTYDGAGVKLRRMFGSQRTTAITDPFLLMDMFGSDNRADYDNGFPWHPHRGIETITYQIKGKTFHEDSEGHRGIIAPGEIQWMTAGSGIFHEEMPKPIYYGEENKYRERNDSNAGIQLWLNMPASSKMADPAYRSIRSDQIPQISDDYGNRIRIVAGTVNRVSGALNENFQYDLMQRIDPYYVEILMEPDTRTSLSVPEGHRAIMAIVEGSIRVNGSTFNEKNVAVLSKEGTDIFIDSQANSRLIFLAGKPLNEPIAWYGPIVMNTRDQLIQAFNELQEGKFVKNRNPVWQ

SEQ ID NO: 11276 - protein, 402 aa, Thermoplasma acidophilum
MGIYDIFDDESARSISGMSIDEMAKKYGTPVIIYSRARIVSNIRRIREAYENRVRMLYSVKANDNPRIIEIMHQESIGSDSASPMEIMMSIFSGIPPEDILYSPNNASEYDLNFALDRGIAINFNTFTQYRKMREKPERISFRINPGFGMGEFAGTTTGGARTKFGIDPDAAILAYRKAREDGIREFGIHMMIGSNNRDHVKIAEAYSNFFRIADRIGREAGVSFQFADVGGGLGIPYVQGENELDIAALGSAVLKEFDRYHFGDLVLEPGRYLVGDAGIIVGTVNDVHNGFAGTDIGMNLNIRPALYGARHTIIPVGERVEGEKITVTGQICENTDRIGDTAWRLSEGDRIMVLDAGAYVYSMSSRYNGRPRPPEIMIMEDGKDVMIRRREDFSDFIATVV

SEQ ID NO: 11277 - protein, 160 aa, Thermoplasma acidophilum
MVFKRKEAGITDYSKRLKLLKSREKRFIVRITGKGVIAQVAEYSDIGDRILFTVTDKTLAKYGVDLRGNNIQVCYLVGYIAGIESEKNGVESAVLDTGRRKFRKGGRIAACLKGFTDAGIEVPHGEDVFPDKKRIDGKHLKSPVKISEIVKNFKKMEEKA

SEQ ID NO: 11278 - protein, 517 aa, Agaricus bisporus
GLIGGILSLRSFQEYLGINTKNAVKKAILDGNIISVLQAGCFFGALGTGYLSSRFGRRPCLIASGIVYITGGLLQCTVGLGPSQAAALHVFYIGRFISGIGVGMVSTLVPLYISECVPRTIRGRCTGTLQFATNSGLMLGFWVNYSVSKNVPFGEMQWRIPLIIQMIPSLLFIIAMFFQPESPRWLVEHGKHKEAATVLARTGGKDVDHPSVVQTLEEIKQEFVASKQPSFLKQIRLVGESRAVALRCFIPPLVMFFQQWTGTNAINLYSPEVFRHLGIHGTSGALFATGVYGVVKVVSVALALTFAVERFGRKRGLIFGGIGQALMMFWLGGYSATHQDGTVSPASHVSIVALYLYGAFFSMGWGPLPWVVAGEVAPNHVRSFALSIAVGTHWLFGFVISKVTPIMLDRIKYGTFLLFGFCCMIVATWAYFCLPETSGFALEDIKYLFERDVIIRSLQDAPGGKIFLGGRRVESVASLKERRVGVAGEQGEKITGLNSELEDVSSKKSTLKETSSV

SEQ ID NO: 11279 - protein, 509 aa, Peromyscus leucopus
MWELVCLLLLILAYLFWPKPKTSDAKFPRSLPFLPLVGSLPFLPRHGHMHVNFFKLQEKYGPIYSLRLGTIPTVIIGQYQLAREVLIKKGKEFSGRPQMVTLGLLSNQGKGIAFADSDDAWQLHRKLALSSFALFRDGDQRLETIICQEASSLCDLLLTHNEESVDLSQPIFMSVTNIICAICFSTSYENRDPILTTIQTFTEGILNCLDNENLVDIFPWLTIFPNKTLEKIKRHVKVRDEVLIDMLEKCKEKFNNDSISNLTDILIQAKMNADNNNTTDHQGSFSDSHILSTVGDFFGAGIETTTSVLCWIVAFLLHNPEVKKKIQKEIDQNIGFSRTPTFNDRNHLLMLEATIREVLRIRPVAPMLIPHKANIDSSIGEFTIPKDTHVVINLWALHHNEKEWDQPDRFMPERFLDATGSHLITPSLSYLPFGAGPRACIGEVLARQVLFLYVACLLQRFDLDVPDGAPMPCLKGDPKVVFLIDPFKVKVTVRQAWKDAQAEVGTWRP

SEQ ID NO: 11280 - protein, 402 aa, Phaseolus acutifolius
MDEALGSSCSLPPFLAKTYEMVDDLSTNSIVSWSVSSKSFIVWNPPEFARDLLPRFFKHNNFSSFIRQLNTYGFKKIDPEQWEFANDDFVRGQPHLMKNIHRRKPVHSHSLQNLQAQGPLGDSERQGFTDGIEKLKRDKERLLVELQKFQHEWQTYEIQIHCSNDRLEKLEQKQHKMVSSISHVLQKPVLAVNILPLTETMDRKRRLPRSGHYYDESSIEDAIETSQMLPRENAENTTVLTLNVERLDQLESSVAFWEAIAHDIGDNFAQIQSNMDFDESTSCADSPSISCAQLDVDVRPKSSGIDMNSEPTAAAVPDPLASKDQPAGITVAATGVNDVFWEQFLTEDPGASETQEVQSERKDCDGRKNEGKPNDHSKFWWNIRNANNLSEPMGHVGQAEKT

SEQ ID NO: 11281 - protein, 259 aa, Agrobacterium tumefaciens str. C58 (Cereon)
MTRDRQSRVAVVAGGTSGIGLSVARHLLGIGHKVAVFGQTESAAKAARSSFEAEITSNQLLVGCCDVRNPGEVADFFRDVETLWSSTALLVYCAGISPKATDGVAKRFTSVDLDEWNDVLDVNLTGAMLCCQAALPGMVDKGFGRIVLIGSLAGRTRPMIAGAAYAASKAGLAGLARALVSEFSADGITINVAAPGRILTPMAGTAATSVNLEAVKRIPTRRLGEAEEVARLVGFLVSDEAAFINGAIIDINGGEYTPA

SEQ ID NO: 11282 - protein, 263 aa, Agrobacterium tumefaciens str. C58 (Cereon)
MTDIRLYMLQSGTLKCKVHNIKMNQGNGADYEIPVPFFLITHPAGHTVIDGGNAIEVATDPRGHWGGICDVYWPVLDKDQGCVDQIKALGFDPADVKYVVQSHLHLDHTGAIGRFPNATHIVQRSEYEYAFTPDWFAGGGYIRKDFDKPGLKWQFLNGAQDDYYDVYGDGTLTTIFTPGHAPGHQSFLVRLPNSKPLLLTIDAAYTLDHWEEKALPGFLASTVDTVRSVQKLRTYAEKHDATVVTGHDPDAWANFKKAPEFYA

SEQ ID NO: 11283 - protein, 245 aa, Agrobacterium tumefaciens str. C58 (Cereon)
MSELAGKRALVTGASRGIGAAIAIALAEKGADVAITYERAADRAAQVVATIEGKGRKALAIQADSMDPEAVKRSVDQAAQALGGLDILVNNAAIAIYKDVADFTVAEIDALFAVNARSPILASQAAMPYLGKGGRIVTIGSAGAERIVGPSTVYSMTKSALQSFTRGLARELGPRDITVNLIQPGSTNTEMNPAEGEFGDFQRALIPLGRYGEPEDVAAAVAFLASGAARQITGTILTVDGGTLT

SEQ ID NO: 11284 - protein, 284 aa, Agrobacterium tumefaciens str. C58 (Cereon)
MFQRSIDSITTTPPLGPGFAGERHKAALVVAPGNFSATDPFFLMADDHVTGEGQFGEAHPHAGLETVTFMLHGTMEDAGGRLGEGDVEWMTAGSGIVHSEDAQVSTGMRLFQLWLVLPEWDRNMAPRVQILRRDEMPVHCGVGFEATVYSGRSAGIIASTKNAVPVTLVEIRLEAGAEFEQVLPSSYNGFVVVIAGEIEAGTGATALTTDKVGWTSPLAVHGDSFMRLRAGKDGARVLLYAGQPQNIHVVAQGPFIAGSKEELAGYYAAYRQGKFPNAGTMRPV

SEQ ID NO: 11285 - protein, 389 aa, Agrobacterium tumefaciens str. C58 (Cereon)
MSRITRPGMRNQPLEEKMTQPATAAVLEEKNGRFILREVKLEAPRPDEVLIRMVATGICATDAHVRQQLMPTPLPAILGHEGAGIVERVGSTVSHLKPGDHVVLSYHSCGHCKPCMSSHAAYCDHVWETNFAGARLDGTIGVAAPDGNTLHAHFFGQSSFSTYALAHQRNAVKVPDDVPLELLGPLGCGFQTGAGSVLNALKVPVGASIAIFGVGAVGLSAIMAAKVADAAVIIAIDVNTERLKLASELGATHCVNPREQADVASAIRDIAPRGVEYVLDTSGRKENLDGGIGALAPMGQFGFVAFNDHSGAVVDASRLTVGQSLIGIIQGDAISGLMIPELVGLYRSGRFPFDRLLTFYDFADINEAFDDVAAGRVIKAVLRFPPQAA

SEQ ID NO: 11286 - protein, 286 aa, Agrobacterium tumefaciens str. C58 (Cereon)
MFDLSERYVCHWYSSTNSKLAPYSHLRKPTQREGIRIMDRLKSKRALITGGTSGIGLETARQFISEGARVAVTGTNPETLDAARRELGPSALVIKADAADVDGQKVVAETIREAFGGLDVVFINAGVALLKPLEAWDEKGFDRVFNINVKGPYFLLQALLPILANPASIVLNTSVNAHIGMPNSSVYAASKAALQSFIRTLSGELIARGIRLNAVSPGPISTPLYGKLGFTETDLKNVAESIQNLVPAGRFGEPSEIAKAVVFLASDEAAYTVGSEIMIDGGMGTL

SEQ ID NO: 11287 - protein, 461 aa, Agrobacterium tumefaciens str. C58 (Cereon)
MNIMQPLRADATAVADPQADISARLERLPITREVFWARNIVGAATFFDGYTVIAIAYAMPVLVREWGLTPSQTGMILSMGYLGQLIGAILFGWLAERIGRLKVLLFTILLFVSMDVACLFAAGAGMMMAFRFVQGIGTGGEVPVASAYINELIGSKGRGRFFLLYEVMFLLGLVGAGLIGYFMVPLYGWKAMFIVGLVPAMLMIPLRWFLKESPRWLAATGRYDEANVIVKRMEESARAAGKALPEPRIIATPAKRVSDWRELFQGIYLKRTLSIWAMWFCAYMVANGTITWLPTLYRQTFNLPLETSILYGFMTSAAGVVAAVICALLIDKVGRKRWYAGALLLAPVPLAILAWLGATSPMQVLIFAGLAYAIVQTVTFSLYLYSAEIYPTRMRAIGTGAGSAWLRLGSSAGPMLVGFVMSSMGIQYVFATFAFILIIGAVVTMLFAVETKGKVLEELSP

SEQ ID NO: 11288 - protein, 256 aa, Agrobacterium tumefaciens str. C58 (Cereon)
MTYPSQIPNISKLFDLSGRRAVITGGARGIGRAIADGFLEVGADVVCIDRGWESSDLPADNRQIVTADLSDRSDLKRGFDEAVERLGGQIDVLVNNAGIWDDTPSLHMELEMWDRIIEVNLTAAFALSRHAARLMLPRGRGRIINIGSIRSLRGGHNAAAYAASKGGIALLTQTLSNEWAPSGLRVNAIAPGAMVTVLTEKLRHDPEVVTRFIERIPARRWGSPADVAGLAIFLASDASDYVTGAIIPCDGGFLAG

SEQ ID NO: 11289 - protein, 655 aa, Halobacterium sp. NRC-1
MPQDPSESPSTADTNRTTNDHTRPGPAPTVPAGKNVAELTVKAVLIGLALNVLLLTANMYLGMRSGLTISASIPAAVISMGLFYALRYAGIGGTILENNIVQTMTSAGEALAAGVIFTIAGVTFLDQSINIVETAAVAALGGLLGVLFMIPMRRYLIVDKHEQLPYPEGTACADVLETGSEGDGGVKLISLGFFVSFIYMWLANGMAVMKTTLETAFSAGQTRGFAIGGDFTPALIGVGYIIGPRIAAYVFGGGLVAWMMLIPLLITGGFVPDQAANLTLMGQAHAVWDQYVRYIGAGAMIVGGFYAIISMAGTIRDALASAAAELSGSKSETATQIPRTQRDLSMKVVVLGALAITIALVAIPQVELGVLGGVIAVVAAFLFVAVSAYLVGVVGSSSNPVSGMAVATVLIAALAMKSTGVSDPVVVLLTASVVAIAAAVAGDTSQDLKTGYLLGATPRKQQIAQMVGIAISSVFAGWVLSFFNQAYGIGSETIPAPQAGMMALISEGVLTGSAQWGMILIGAVFAIVLIMMDVPVLPFSVGIYLPITLATPIFLGGLLRAGVDRYVDWRSDDGDGAAKERATYRGRIIAAGLITGEAIMGIVVGGIYVLGIGADEGAPYAVGLASGTQTLLGGVALVALVAVFVGGVIRDPQDT

SEQ ID NO: 11290 - protein, 312 aa, Halobacterium sp. NRC-1
MSRYRTTGRFLLLCAVWGTAFMATDVGLADLPAVPFAAVRFDIAAALLFAAVFVSDADVYPRTMDDFVYVLVGGTLTIGAHHAFLFTGQQYVTGGVAAVLLGLVPVVTPALTRLVATDEQLTAATAVGVMLGFAGVVIIANPDPTNIADSVLGVSLVLASAFAFAVAAVVTHSRSPSLPFLSTQAWLMATGAVVLHVAVLVLPGQSFAAATWTPSALGALTYLSVVAGVGGFLLYFRLLDDLGPIEMSFIEYVIPVFAALAGWLVLGQEITPATVVGFAFILSGFLASKWRALRLRSVVVTTISSFTGPRDD

SEQ ID NO: 11291 - protein, 308 aa, Yersinia pestis CO92
METGKLVVLGSINADHILNIEQFPRPGETVIGQQYNVAFGGKGANQAVAAGRSGADIAFIACVGDDDIGERVRQQLTADKIDTQPIEAIKGATTGVALIFVNSDGENVIGINAGANSAVTPEYLRRYQQQVIDADALLMQLESPLDTVIAAAKLAKQHQTQVILNPAPARKLPDELLTLVDMITPNETEAERLTGIHIEQDDDAAKAAQILHDKGIATVIITLGSRGVWLSEQGKGKLVAGFKVNAVDTIAAGDTFNGALLTALLEGQSMDVAVRFAHAAAAIAVTRPGAQPSIPWRAEIDSFLQERV

SEQ ID NO: 11292 - protein, 405 aa, Yersinia pestis CO92
MMTGLSGKHIVLGISGGIAAYKSPELVRRLRDKGADVRVVMTHAAKAFIAPLTLQAVSGYPVSDDLLDPAAEAAMGHIELGKWADLVIIAPATADLLARMAAGMANDLLTTVCLATAAPIAAVPAMNQQMYRAPATQENLQTLSKWGVLLWGPDSGSQACGDIGPGRMLDPQEIVALAYNHFSAKQDLQHLSVMITAGPTREPLDPVRFISNQSSGKMGFAIAQALAARGSNVTLIAGPVNLSTPEGVKRIDVITALEMQQAVQKIAQQQNIFISCAAVADYRAEHVSDEKIKKQGDEITLKLVKNPDIVAGVASMAKNRPFVVGFAAETQNVEEYARQKLARKNLDLICANDVSLAEHGFNSDTNALHLFWSTGEKRLPLSDKYLLSQRLIDEIVSRYDEKNRH

SEQ ID NO: 11293 - protein, 273 aa, Yersinia pestis CO92
MSSEELEQVWSNIKSEARALAECEPMLASFFHATLLKHENLGSALSYILANKLANPIMPAIAIREVVEEAYRSDAHMIVSAARDILAVRLRDPAVDKYSTPLLYLKGFHALQAYRIGHWLWAQDRKALAIYLQNQVSVAFGVDIHPAATIGCGIMLDHATGIVIGETAVVENDVSILQSVTLGGTGKTSGDRHPKIREGVMIGAGAKILGNIEVGRGAKIGAGSVVLQSVPAHTTAAGVPARIVGKPESDKPSLDMDQHFNGSIQGFEYGDGI

SEQ ID NO: 11294 - protein, 232 aa, Yersinia pestis CO92
MVKFKAIRGVAFDLDGTLVDSAPGLARAIDMALAHQGLPAAGEALVSTWIGNGADVLVERALHWAGREHNAQLVAQTRELFDHYYAKTVEQGSQLFPQVKATLAQLAANGLPIGLITNKPTPFVAPLLTSLGISDYFSVIIGGDDVVVKKPHPAPLYLLLGKLGLHAREMLFVGDSRNDIMAAQAAGCPCIGLTYGYNYGEAIATSHPDCVLAHFADLLPAIGLPSLKDQEV

SEQ ID NO: 11295 - protein, 939 aa, Yersinia pestis CO92
MGKASSLVTRLTLLMGVTLTVIWLILIATTAFFSYENTRQILINELTHMASMRADLSNHQFEGAERDAASLISRRESLQSTSPLPEISIKHYDSYYIPFNLDSCNINQHKNDLWIIQAYGTAGQTYYLDSFIIKQKEGIVLFPPQKSSSDYLNQRRKDLLLLPKFPTHNNIYWGAPTYTPQGGWHVSVAVCDKVGTLAGFALKLNDLIAYNHPVEQRDINLLLDKNGELLPISQQATSSNQLHEILNQLKNSKLHDGWQQTPDYLVLRTQLKGPGWQQLVIYPRMGFAWEALKPALYQLPFALAILLLLTSVLSLLLRYYLAIPLWNFINIIGATGPQAMEPRLPINRIDELGHIARAYNNLLDTLNEQYDTLEMKVKERTLALAEAKRAAEQANRRKSDHLTTISHEIRTPLNGALGAVELLQNTPLDAGQMRLAETAHQCSLSLLAIINNLLDFSRIESGQMTLSLEKTALLPLLDQAMLTIHSQALSKSLALSTFISANIPLELELDTLRLRQILVNLLGNAVKFTPQGRIQLRVRRQNQTLCFTVEDTGCGIDVQHQQTIFQPFMQTSDHEQGTGLGLAIADNLAKMMGGHLTVFSEPGQGSCFSLCLPFNAITPPMPFHGELFAPQRLHAQLSAWGMTCQPELANQPSRHFVDNALCYLPGRLYAKLKQYLQGAETEALKSLPLQPWQMHILLVDDSETNRDITGMMLQQLGHQVTRADSGTTALAIGRQHRFDLVLMDIRMPVLDGLATTARWRHDPANIDSHCMITALSANASPDEQIKTSQAGMNHYLSKPVTLGQLAEMLDLTAQFQLERGVDLSPQLSEPQPLLDLADSALSLKLYQSLQVLIQQAKDAIENLPVLSHTLHTIKGCAGQAGLIELQDAVIQLEHALDTHETLTQQEIIQLDEIIHVLLQPPTTCESTFIISQGQSLMVK

SEQ ID NO: 11296 - protein, 612 aa, Yersinia pestis CO92
MEQNPQSQLKLLVTRGKEQGYLTYAEVNDHLPEDIVDSDQIEDIIQMINDMGIQVLEEAPDADDLMLAENTTDTDDDAAEAAAQVLSSVESEIGRTTDPVRMYMREMGTVELLTREGEIDIAKRIEDGINQVQCSVAEYPEAITYLLEQYDRVEAGESRLSDLITGFVDPNAEEDIAPTATHVGSELSTEEMDDEDEDEDEDDDAEDDNSIDPELARQKFSDLREQYENARMEIKKNGRNHANAAAEILKLSEVFKQFRLVPKQFDYLVNNMRAMMDRVRTQERIIMKLCVEQCKMPKKNFVTLFSSNETSDTWFNAAVAMGKPWSEKLKDVSEDVQRSLQKLRQIEEETGLTIEQVKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELAERMLMPEDKIRKVLKIAKEPISMETPIGDDEDSHLGDFIEDTTLELPLDSATSESLRSATHDVLAGLTAREAKVLRMRFGIDMNTDHTLEEVGKQFDVTRERIRQIEAKALRKLRHPSRSEVLRSFLDD

SEQ ID NO: 11297 - protein, 277 aa, Yersinia pestis CO92
MTMQPLIKLYDGRLMPQLGLGVWQASIQETELAVSKALEVGYRSIDTAAIYKNEEGVGKALKAAAVARDELFITTKLWNDDQHNPQQALETSLQKLQLDYVDLYLIHWPDPKQDHYVSAWRELVTLKEQGLIRSIGVCNFHIPHLQRLIDETGIAPTVNQIELHPLLQQRQLHAWNATHHIATESWSPLAQGGKGVFDQEIIRKLAQQYNKTPAQIVIRWHLDSGLIVIPKSVTPARIRENFEVFDFKLQKEELLAITKLDCGKRLGPDPEVFGSDR

SEQ ID NO: 11298 - protein, 748 aa, Yersinia pestis CO92
MLMRLREVVEKVAMATGLTEALELLVNETCLAMDTEVCSIYLADNDRRCYYLMATRGLKKPRGRTITLAFDEGIVGLVGRLAEPINLADAQSHPSFKYVPQVKEERYRAFLGVPIIYRRQLLGVLVVQQREHRQFDESEESFMVTLATQLAGILSQSQLNAIFGQYRQTRIRALAAAPGVAVAEGWQDISQPSLDLVYEASTLDSTLERERLTQALEEAAAEFRRFSKRFAASSQKESAAIFDLYSHLLNDARLKRELFAQIDAGAVAEWAVKQVVEAFAAQFASLQDTYMRERASDLRALGQRLLFHLDDSTSGASQWPERFILVADELTATLLAEVPQDRLAGVVVRDGAANSHAAILVRAMGIPTVMGADIQPALLSQRLLIVDGYRGEVLVDPEPVLVKEYQRLVTEEIELSKLAEDDVEQPAALKSGERIQVMLNAGLSPEHEQLLGGRVDGVGLYRTEIPFMLQSGFPSEEEQVAQYQGMLQLYPQKPVTLRTLDIGADKQLPYMPISEENPCLGWRGIRITLDQPEIFLIQVRAMLRANAGTGNLGILLPMITSIEEVDEAKRLIDRAGREVEEMLGYVLPQPRLGVMIEVPSMIFMLPYLTSRVDFISVGTNDLTQYLLAVDRNNTRVASLYDSLHPAMLQVLRQILMQATESGLQVSLCGEMAGDPMGALLLVGLGYRNLSMNGRSVARIKYLLRNIELADAQVLAARVLTAQMTTDVRHLTAAFMERRGLGGLIRGGK

SEQ ID NO: 11299 - protein, 420 aa, Yersinia pestis CO92
MPRALNDRSSALTAQNLIALPERFGCPVWAYDGDIIAERINQLRHFDVIRFAQKACSNIHILRLMREQGVKVDSVSLGEIERALHAGYQPGQEPAEIVFTADLLDQATLLRVTELNIPVNAGSIDMLDQLGQQAPGHPVWLRVNPGFGHGHSQKTNTGGENSKHGIWHEELPRALKKIEHYGLTLVGIHMHIGSGVDYQHLEQVCDAMVQQVITLGHDISAISAGGGLSIPYQFGDDVIDTEHYYGLWNSARERIAAHLGHPVSLEIEPGRFLVAESGVLIAQVRAVKDMGRRHYVLVDAGFNDLMRPAMYGSYHHISLLPADGRDLTSAPLIDTVVAGPLCESGDVFTQQEGGGVETLALPAAVIGDYLVFHDTGAYGASMSSNYNSRPLLPEVLFEKGQPRLIRRRQTIEELIDLERV

SEQ ID NO: 11300 - protein, 251 aa, Yersinia pestis CO92
MQPFDLNGKVAIITGCNTGLGQGMAIGLAKAGADIVGVGVAEAPETQAQVEALGRKFHFITADLIQQKDIDSIVSQAVEVMGHIDILINNAGIIRRQDLLEFGNKDWDDVININQKTVFFLSQAVAKQFVKQGNGGKIINIASMLSFQGGIRVPSYTASKSAVMGLTRALATELSQYNINVNAIAPGYMATDNTAALRADTARNEAILERIPASRWGTPDDLAGPAIFLSSSASDYVTGYTLAVDGGWLAR

SEQ ID NO: 11301 - protein, 398 aa, Yersinia pestis CO92
MKQLTILGSTGSIGNSTLSVVRANPELFKVTALVAGRNVREMAQQCLEFSPRYAAMSDEHSAKSLRLLLAEQGSDTEVYSGETAACELAALDDVDQVMAAIVGIAGLPSTLAAIRAGKQVLLANKESLITCGKLFMDEVKRSRAQLLPIDSEHNAIFQSLPERIQRQLGYSSLNENGVSRIILTGSGGPFRETPLSQFSDVTPDQACAHPNWSMGRKISVDSATMMNKGLEYIEARWLFNASAEQIEVVLHPQSVIHSMVRYHDGSILAQMGTPDMRTPIAHAMAYPMRVSSGVAPLDFCKVGALTFTTPDYQRYPCLKLAIDACNAGQAATTALNAANEISVMAFLDSKIRFTDIEVINRTVVEGLLLSEPTSVEEVLVIDRKARDVAAQVIAKLNN

SEQ ID NO: 11302 - protein, 267 aa, Yersinia pestis CO92
MSIPVFGLGTFRLQDQIVIDSVSQALTLGYRAIDTAQIYENEAPVGQAIQESGINRDELFITTKIWIANLSKDKLIPSLRESIQKLKTDYVDLTLIHWPSPNDEVSVAEFMSELLKAKGLGLTRQIGISNFTIDLMKQAIAAVGAEEIATNQIELSPLLQNRNVVDFAKQNGIAVTSYMTLAYGKALAEPVIKTIAEQHGATPAQVILSWAMQLGYGVIPSSTKAANLASNLLAQKLCLNAADMALIATLDRNERLVSPDGLAPKWD

SEQ ID NO: 11303 - protein, 490 aa, Yersinia pestis CO92
MSRYGLQKLYINGAYTDSTSGDTFDAVNPANGECIAQLQAANAQDVDKAVAAAKQGQPVWAAMTAMERSRILRRAVDILRDRNDELAAIETADTGKPLSETRSVDIVTGADVLEYYAGLIPALEGQQIPLRGSAFVYTRREPLGVVAGIGAWNYPLQIALWKSAPALAAGNAMIFKPSEVTSLTALKLAGIYTEAGLPAGVFNVLTGSGDQVGQMLTEHPGIAKVSFTGGIASGKKVMANAAGSTLKDVTMELGGKSPLIIFADADLDKAADIAMMANFYSSGQVCTNGTRVFVPQALQAAFEQKIVERVKRIHIGDPSDERTNFGPLVSFQHRDSVMRYIDSGKREGATLLIGGYSLTEGALAHGAYVAPTVFTHCRDDMQIVREEIFGPVMSILSYQSEEEVIRRANDTEYGLAAGVVTQDLNRAHRVIHQLQAGICWINTWGESAPEMPVGGYKHSGVGRENGISTLEHYTQIKSIQVELGSFNSVF

SEQ ID NO: 11304 - protein, 673 aa, Yersinia pestis CO92
MVTSDIDTKPQKDTLNPVVFFTSAGLILAFCLMTIFYTDLSNRWIGITLNWVSATFGWYYLLAATLYIVFVIYIATSRYGSIKLGPEQSKPEFSLVSWAAMLFAAGIGIDLMFFSVAEPVTQYMMPPEGQGQTLEAARQAMVWTLFHYGLTGWSMYALMGIALGYFSYRYNLPLTIRSALYPIFGKRIDGPIGHSVDIAAVIGTIFGIATTLGIGVVQLNYGLNVLFHIPESLAVQAGLILLSVVMAAVSVTSGVNKGIRILSEVNVLLALGLILFLLNALVLNVGDYINRFLGMTLNSFAFDRPTQWMNSWTLFFWAWWVAWSPFVGLFLARISRGRTIRQFVVGTLIIPFVFTLLWLSIFGNSALYQILHGNIAFANEVMEFPERGFYSLLAQYPGFTLSASVATITGLLFYVTSADSGSLVLGNFTSRLADINNDSPNWLRTFWSITIGLLTLGMLMTDGVAALQNATVIMGLPFSFVIFFVMVGLYKSLKIEDYRKASSQQTPTPTLISGNEVLNWKQRLSRVMNYPGTTYTAKILDTICRPAMEEVAQELAVRGVKVEFNELPPKEDEQLNRLNHLELLVHLGDEQNFVYQIWPQRYSVPAFTYRARSGKSHYYRLETYLLEGTQGNDLMDYSKEQIINNILDQYERHMNFLHIQSEAPGNIMTFPDQ

SEQ ID NO: 11305 - protein, 296 aa, Yersinia pestis CO92
MLKQNRRNLWLLIGSLFTLYFVWGSTYLVIRIGVESWPPLMMAGLRYLIAGVLLFSFLAIRGHALPTLRQWAAASAIGILLLAIGNGLVTIAEHQHVPSGIAAVMVATVPLFTLCFSLLWGMRNTKLEWAGIALGLVGIILLNTGSNLLGNPVGAMLILLASASWAFGSVWSSRLALPAGAMSGAAQMLVAGVVLLLASTLSGEELQQPPTMSGILALLYLIVFGSMLAISAYMFLLKNVRPAVATSYAYVNPVVAVLLGIGFAGESLSPTEWGALAVIVSAVVLVTLGKFLFARR

SEQ ID NO: 11306 - protein, 957 aa, Yersinia pestis CO92
MLFHHGIRLKYLSSFRTTLKISRYLFRVLAVMLWSLGALLTTFYILNVLNEKKADIRQEYNNNFGLAQNYIRHSAEIIRDIKYMAENRLDKNASDTDATSGMVMNKKAVPQYYPLNSDSGCTTASTSNQASVNTLSNLIWYWKENFTAAYDLNRVFFIGTDTLCMVDFDIRNAPSLQENLLKSLYEHTLKYRDTKNQDKDSNIYWVVPGARPDIGVLYVLSPVYLGNRLEAMIGFEQSVRLEDFISSRTLPIRVTLLNQDNEPVLQMASGDRYPAILDDYPDSPSYFGYADDYKDLILKKALPPSPLSIAYLLPVKTIIEAFKLLIFNALLLNVLSAVVIFTLAWLFERKMFHPAEDNALRLEEHEQFNRKIVASAPVGISILRISDGTNILSNELAHNYISLLTNEDRERITRIICERQANFVDVMTSNNNNLQISFVHSRYRNEDVAICVLVDVSARVKMEESLQEMATAAEQASQSKSMFLATVSHELRTPLYGIIGNLDLLQTKELPQGVDRLVTAMNNSSGLLLKIISDILDFSKIESEQLKIEPSEFSTVEVITHITANYLPLVVKKRLGLYCFIEPDVPRLIEGDPVRLQQVISNLLNNAIKFTDTGCIILQVRVRDCYLEFRVRDTGVGIDSREINQLFDPFFQVGTGVQRHFQGTGLGLAICEKLVNLMDGDVEVISELGMGSIFAIRIPLYHHQNTVLSANDRWQGKVLWLDIRNARLESYLLDLLGYFGATIRRYCGEQTQPEDVLICDYPSQLSPPLLAWIQLSIEHIGLPQETRPAYWSLSTSTLLEIVPLLDWILRGQQPVDNSSLQLHAPKTNQDNNADLQILVVDDHPINRRLLADQLTTLGYRVITANDGLDALVALNTNTVDMVLTDVNMPNMDGYRLTERLRQLNHNFPIIGVTANALAEGKQRCIEAGMDNCLSKPVTLDTLRQMLLYYSDQVRRSR

SEQ ID NO: 11307 - protein, 271 aa, Yersinia pestis CO92
MNDHKKRPDLEKRPDLEKQSYPEKQSLSGKRALVTGAGQGIGAAIAEGLAATGAEVICTDISRERAAATAQALNAKGYNVRAEGLDVTDSAAIDALAAALPPLDVLVCNAGIVTHTPAEEMTDADWDKVIAVNLTGVFRTCRGFGRRMLEAGRGSIINIGSISGQIVNVPQPQCHYNASKAGVHHLTKSLAVEWATRGVRVNAVAPTYIETPLIQGLTSQPGRVSRWLDMTPMGRLGSPHEIASVVQFLASEASSLLTGSIITADAGYTSI

SEQ ID NO: 11308 - protein, 498 aa, Yersinia pestis CO92
MSEYHEKNNALFKSITALDGALFINGEFRKGAGGRLPVENPATGKVIGHLAAATPEEIEEAVAAARRAFPAWAAERPKARANALHRLGDLIAGDALNMARNMTIEQGKPVNEAQGEILKLAEICHFYGEEATRVQGDVVPNDPPGFQSLVVREPVGVVGAITPWNYPAELVGWKLCASLAAGCTLIIKPAELTPYTALAIAEKCLEAGIPAGVVNVLTGKGEQVGQALVEHPQVDKIAFTGSSAVGLHIQQSCPQVKRLSLELGGNGPMVVTACADVAAAVKGAVRRSFRNCGQVCIAINRIYVHRSCYRAFVSKMGVATNGLRLGNGLDDPAADLGAMASVEPLNKTRAHLEDALAKGARLVAGGKAPEGVEYAKGHFFRPTVLADCTHQMRVMTEETFGPLVGLAPFDDIDEVISRANDTPYGLAAYVYARDLAAIHRLSAALDYGNVAINNVDASMMNAPYGGRKQSGVGYEHGREGLLEYFNFKHIRLYHGIGD

SEQ ID NO: 11309 - protein, 206 aa, Yersinia pestis CO92
MLTVWGRNNSTNVKKVLWCLEELGIPYQRIDVGGQYGKLNDPQYRALNPNGLIPCLQDKDFILWESNTIVRYLAAQYGQNSLYLADHHQRASAEKWMDWATSSVVEPFKAVFIGLVRTPPEQQDKVKIAQGMEKMNTLMSIANDALGEQAYLSGDAFGIGDIPLGCLAYAWFNLPIERPELPHLQRWYQSLTQRIAFQKVIAIGLS

SEQ ID NO: 11310 - protein, 377 aa, Yersinia pestis CO92
MIKTRAAVAWGPNQPLSVEEVDLMPPQKGEVLVRIVASGVCHTDAYTLSGADPEGVFPTILGHEGGGIVEAIGEGVTSVAVVDHVIPLYTPECGECKYCRSGKTNLCQAIRSTQGKGLMPDGTTRFSKNGQPIFHYMGTSTFSELTVVPEISLAKINKEAPLEEVCLLGCGVTTGMGAVMNTAKVKPGDTVAIFGLGGIGLSAVIGAQMAGASRIIGIDLNTSKFELARKLGATDLINPKDYDKPIQEVIVELTDGGVDFSFECIGNVNVMRSALECCHKGWGESVIIGVAGAGEEISTRPFQLVTGRVWRGSAFGGVKGRSELPGIVQQYLDGKFALNDFITHTMALDQINEAFDLMHEGKSIRSVIHFNHSSESK

SEQ ID NO: 11311 - protein, 370 aa, Yersinia pestis CO92
MSEKSPEQTTPGLLQSQILKVLTAFTHPTLQKDLNTLRAIHHCALLDNVLHIELVMPFAWQFGFEILKESVSEELLAVTGANAIDWKLSHNITTLRRANDQPGVKGVRNILAVSSGKGGVGKSSTAVNLALSLAEGGVKVGILDADIYGPSIPNMLGTMNQRPTSPDGKHMAPIMAHGMATNSIGYLVTEENAMVWRGPMASKALMQMLQDTLWPDLDYLVIDMPPGTGDIQLTLSQNIPVTGALVVTTPQDIALIDAMKGIVMFEKVHVPVLGIVENMSMHVCSNCGHLEPIFGTGGAEKLAEKYHCKLLGQIPLHISLREDLDRGEPTVVSRPDSEFTDIYRQLAANVAAEMYWQGEAIPTEISFRAV

SEQ ID NO: 11312 - protein, 244 aa, Yersinia pestis CO92
MSFEGKIALVTGASRGIGRAIAELLVERGACVIGTATSEKGAEAISAYLGENGKGLMLNVVDPTSIDTVLATIRAEFGEVDILVNNAGITRDNLLMRMKDDEWQDIIDTNLTSVFRLSKAVMRAMMKKRFGRIITIGSVVGTMGNAGQVNYAAAKAGVIGFSKSLAREVASRGITVNVVAPGFIETDMTRTLTDDQRAGILAQVPANRLGDAKEIASAVAFLASDEASYISGETLHVNGGMYMI

SEQ ID NO: 11313 - protein, 253 aa, Yersinia pestis CO92
MILDSFELKGKVALVTGCDTGLGQGMAIGLAEAGCDIIGVNIVEPRETIEQVTALGRRFFSLTADLSNIECIPSLLERAVAEFGHIDILVNNAGIIRREDAINFSEKDWDDVMNVNIKSVFFMSQAVAKQFIKQGNGGKIINVASMLSYQGGIRVPSYTASKSAVMGVTRLLANEWAKHGINVNAVAPGYMATNNTQQLRKDEERSKEILDRIPAGRWGLPDDLKGPVVFLASKASDYISGYTIAVDGGWLAR

SEQ ID NO: 11314 - protein, 465 aa, Yersinia pestis CO92
MKIVNHWIDGKNITSNDYFTTINPATGEVLADVASGGIKEINQAVAAAKSAFPHWANLPMKVRARLMRRLGELIEQQIPEIAQMETQDTGLPIYQTQNALIPRAAHNFEFFAEICQQMNGQTYPVDDQMLNYTLVQPVGVCALVSPWNVPFMTATWKVAPCLALGNTAILKMSELSPLTADKLGELALEAGIPAGVLNVVQGYGATVGDALVCHQDVRAISFTGGTATGNRIMQRAGLKKYSMELGGKSPVLIFDDADIERAMDAALFSIFSLNGERCTAGSRIFIQESLYSAFIQRFAERASRLRVGDPQDLDTQVGALISKPHWDKVSGYIQLGIEEGATLLAGGPDKPIDLPAHLRGGHFLRPTVLADVDNRMRVAQEEIFGPVACLIPFKNEDAGLRLARSIEAGMVFVNTQNVRDLRQPFGGIKASGTGREGGKYSFDVFAEVKNVCISMGEHPIPRWGM

SEQ ID NO: 11315 - protein, 319 aa, Yersinia pestis CO92
MSKIVSLGIHVLDVLGRHVNRFPPGGELDIINEIRLTVAGTAAGMSVDLAKLGGDVYAMGAVGLDESGNFIIDTLRRYGVNTDHIVRKSEVQTSCSMLPIRPNGERPVLHVLGANATYRLEDIHWDVIASADILHFGGTYLLPGLDGPPTATILKFAKEHGVTTTLDLLVNAQPDLLAKLEPALPYIDYFMPGLDEARAICGLEKRADVIAFFLNRGVGHTVFKMGAEGSSIASLEMAEILIPAYKAQVVDSTGCGDSYCAAFIMGLTKGWDLATSGRFASAAASLVVSGLGSDAGIIDFEHTLKVMNTAETLPIAQET

SEQ ID NO: 11316 - protein, 289 aa, Yersinia pestis CO92
MKKVQGIYRAPRQHWVGDGFPVRSMFSYQSHGKQLSPFLLLDYAGPMDFTPTTQRRGVGQHPHRGFETVTIVYHGEVEHRDSTGNGGIIGPGDVQWMTAGAGILHEEFHSDAFAQKGGPFEMVQLWVNLPAKDKMTAPGYQAIRREAIPQVNLPDDAGNLRVIAGEYAGNIGPAKTFSPLNVWDIRLTQGKSCEFSLPAGWNTALIVLHGTLLVNGDAIAREAEMVLLDPTGTHLSIEANNDTVLLLLSGEPIDEPIVGYGPFVMNTQAQIAEAIADFNGGRFGNMDVA

SEQ ID NO: 11317 - protein, 436 aa, Yersinia pestis CO92
MSESSTESLSQPTQLQEENNAYRKTVWHLLPLLMLCYVLNYLDRVNVGFAKLQMADDLQFSDTVYGLGAGMFFIGYFFLEIPSNLILHRVGARLWIARIMITWGIISACMAFVTTPMSFYVMRFLLGVAEAGFFPGIILYISYWFPSHRRGRVYGLFVISVPLSGIIGAPLSGWIMQYFNGFQGYAGWQWMFILEGIPSVLVGILIIYKLKDRITHATWLTDKEKDILQTNIENEAAHYAHSRLRDAFLQPRVWLLTLIYFCLISGFYTIGFWLPTLIRDSGVKDILSIGFLTAIPSAAAAVTMIVVSRSADRLRERRWHLALTAVLGAVGIILSTYFSDNIVVAMVCLTIGAMGALSTIPLFWSLPTAFLGGSAAAAGIAFINSWGNLGGFVAPYMMGYLKDLTQSTTTGMLIISTTLFIGAALVFLIPAKAVNH

SEQ ID NO: 11318 - protein, 457 aa, Yersinia pestis CO92
MQKYIVEARSLLALAIPVVIAQLSQTAMGVVDTIMAGSVSATDMAAVAVGTSIWLPAILFGHGLLLALTPTVAQLNGSGRRSQIAHQVRQGFWLALCVSVLIMLVLYNSDHVIKQMDNIDPVLAQKAVGFLHAIMWGVPGYLFFQVLRNQCEGLSKTKPGMVIGFVGLLVNIPINYIFIYGKFGAPALGGVGCGVATASVYWVMFLMMRWYVTRARSQQDIKLEKGFAAPDWQVMKRLSGLGLPVALALFFEVTLFAVVALLVSPLGIVAVAGHQIALNFSSLMFMLPMSLSVAATIRVGFRLGQGAVEQAQVAAYTSMAVGLLLASVTAVFTIVFREHIALLYNKTPEVVTMASHLMLLAALYQLSDAVQVIGSGVLRGYKDTRSIFFITFTAYWLLGLPSGYLLGLTDYILPAMGPAGFWIGFIIGLTAAAILMVLRIRWLQKQPTAFILQRAAH

SEQ ID NO: 11319 - protein, 794 aa, Yersinia pestis CO92
MSNNGHTRCNVLWYNQLGMHDVDRVGGKNASLGEMITHLSELGVSVPNGFATTAQAFNDFLEQSGVNQRIYQLLDNTNIDDIAELSKAGAQIRQWVIETPFHPEFEQSIYDAYKQLADGEPEASFAVRSSATAEDMPDASFAGQQETFLNVQGIDAIMVAIKHVFASLFNDRAISYRVHQGYDHRGVALSAGVQRMVRSDLASSGVMFTIDTESGFDQVVFITAAHGLGEMVVQGAVNPDEFYVHKPTLRNGKPAIVRRNMGSKKIRMIYAENQEHGKQVCIEDVPEIQRNRFALSDDEVEALAHQALLIEEHYGRPMDIEWAKDGHTGQLFIVQARPETVRSNEQVMERYQLNNQSNVLVEGRAIGHRIGAGPVKVIHDISEMDRIQAGDVLVTDMTDPDWEPIMKKASAIVTNRGGRTCHAAIIARELGIPAVVGCGNATELLKEGQNVTVSCAEGDTGYVYHELLDFSVQSSQVTELPDLPLKIMMNVGNPDRAFDFARLPNEGVGLARLEFIINRMIGVHPKALLEFDQQEPALQAEIKALMHGYDDPVEFYIGRLTEGIATLGAAFWPKPVIVRLSDFKSNEYANLVGGAGYEPHEENPMLGFRGAGRYVSDHFRDCFALECEAMKRVRNVMGLTNVEVMVPFVRTVAQAEAVVAELARQGLKRGENGLKIIMMCEIPSNALLAEQFLEHFDGFSIGSNDMTQLTLGLDRDSGVVSALFDERNEAVKALLSMAIQAAKRHGKYVGICGQGPSDHEDFALWLMEQGIDSLSLNPDTVVKTWLSLAQHTKH

SEQ ID NO: 11320 - protein, 452 aa, Yersinia pestis CO92
MQTLPSEKIRMDDVPLNRFHIRIAGLTFGAHFIDGYILGLIGFALIQLKPIMALTPLWEGLLGSAALIGLFLGSLILGWISDYIGRQKIFSFSFVIITLASALQFFASTPEQLFILRVIVGIGIGGDYSVGHTLLAEFSPRKHRGVLLGAFSVIWTFGYVSASFVGHYLSMVSPEAWRWLLSSAALPALLILLVRIGTPESPRWLMGKGREDDAMAIVHKYFGPNVTLIDEEPATSTRRFLSLFGRKYWRRTAFNSLFFVCLVIPYFAIYTFLPSILNVMALSQNFATDLLLNGLLVVGALVGIVLTAFCSRRSFLISSFIFLATCLLLLSILPSNQTFWLIALFAAFTLVMSAVSNLVGVFPAESFPTEVRSMGVGFATSMSRLGSAIGTSLLPLAIVNYGMPVTTTLLAFVLIIGAIVSIAWAPETKGLTLVDASQSATTPRPPSSIIPN

SEQ ID NO: 11321 - protein, 548 aa, Yersinia pestis CO92
MLNNPRKDIPLIVTSLLCIILIALAFSLFPQQSSQMAETIFSGVTRLLGSTIQILVLLGLILVLYIAVSKYGNIRLGEGKPEYRTIPWLFMFICAGLGSSTLYWGVMEWAYYYQTPGLNIAPKTPKALEYSVSYSFFHWGISAWATYALASLIMAYHFHVRKNKGLSLSGIISAITGVNPQGFWGRLVDLIFLIATIGALTISLVITAATFTRGLTALIGVPNNFAVQAGVMLVAAVIFSFSSYIGIDHGMQRLSKMVGWGAFGFAVLVLLVGPTEFIINNTINSIGLTTQNFLQMSLFTDPMGDGRFTRSWTVFYWLWWISYTPGVAMFVTRVSRGRKLKEVIWALLLGSSLGCWFFFGVLESYAIQQFISGALDVPLILNTQGGETAVQMLLSALPMGKLFLAAYLFIMIIFLASHMDAVAYCMAATSTRNLREGEDPNRMLRLFWCVVITLIPLSILFAGASLDTMKTTVVLTALPFLLILLIEVYGFVRWIKQDYAHVPAHLIEQSTPQVMLPAESLPPATASMLVVETLVVETAAPPASKHNQ

SEQ ID NO: 11322 - protein, 254 aa, Yersinia pestis CO92
MKNLFSLENRKVLITGSAQGIGFLLAKGLAEFGAEIIINDITAERAEKAVAELRASGFIAHAAAFNVTNHDEVNEAIEKIESHIGAIDVLINNAGIQRRHAFTEFPEKDWDDVIAVNQKSVFLVSQAVARYMVKRQRGKIINICSMQSELGRDTITPYAASKGAVKMLTRGMCVELARYNIQVNGIAPGYFKTDMTKALVDDQAFTDWLCKRTPAARWGDPEELIGAAVYLSSKASDFVNGHLLFVDGGMLVAV

SEQ ID NO: 11323 - protein, 297 aa, Yersinia pestis CO92
MRYAFPTQQLKDNVMQTVKLNNGIAMPLLGFGVFQMTNTAECERAVIDAIETGYRLIDTAASYQNETQVGNALKLSGIARDELFITTKLWLQDTYYEGAKAQFERSLNRLQLDYVDLYLIHQPYGDVHGAWRAMEELHQAGKIRAIGVSNFHPDRLADLMAFNKIIPAVNQIEVNPFNQQLHAVPWMQSRGIQPEAWAPFAEGRNGLFQNPVLTAIGEKYGKSVGQVVLRWIFQRGIVSLAKSVRKGRMEENINILDFELSAEDMLQIAALDTATSAFFSHRDPAMVEWLTGRKLDV

SEQ ID NO: 11324 - protein, 487 aa, Yersinia pestis CO92
MLRIAKEALTFDDVLLVPAHSTVLPNTAELGTQLTATIRLNIPMLSAAMDTVTESRLAIALAQEGGLGFIHKNMSIERQAEEVSRVKKHESGVVTEPQTVTPTTTLRQVKELTARNGFAGYPVVTEDYELVGIITGRDVRFVTDLDQPVTAVMTPKERLVTVKEGETREVVLQKMHEKRVEKVLVVDDSFHLRGMITVKDFQKAERKPNACKDEHGRLRVGAAVGAGAGNEERIDALVAAGVDVLLIDSSHGHSEGVLQRIRETRAKYPNLQIVGGNVATGAGAKALADAGVSAVKVGIGPGSICTTRIVTGVGVPQITAIADAVEALEGTGIPVIADGGIRFSGDIAKAIAAGASCVMVGSMLAGTEESPGEIELYQGRSFKSYRGMGSLGAMSKGSSDRYFQTDNAADKLVPEGIEGRVAYKGLLKEIVHQQMGGLRSCMGLTGCGTINELRTKAEFVRISGAGIQESHVHDVTITKESPNYRMM

SEQ ID NO: 11325 - protein, 396 aa, Yersinia pestis CO92
MLDTQTIAIVKSTIPLLAATGPKLTAHFYERMFKHHPELKNIFNMSNQSSGDQREALFNAICAYATNIENLAALLPTVERIAQKHTSLNIQPEHYPIVGEHLIATLDELFSPGQAVLDAWAKAYGVLADVFIQRESQIYQQSETETGGWRTLRRFRIIKKEQQSEVICSFVLAPEDGGQVLHYKPGQYLGIYIEHESLEFQEIRQYSLTTAPNGKTYRIAVKREEQGTVSNLLHRELNEGDIVRIAPPRGDFFLDVSPDTPVALISAGVGQTPMLSMLNTLYSQQHAAPVHWLHAAENGRVHAFADEVSAIAAKMPNLSRHVWYREPDLQDKHGEDYHSQGLMDLSSYQWLADDPKRHYYFCGPLPFMQFIGRQLLAQGIAPEQIHYECFGPHKVI

SEQ ID NO: 11326 - protein, 112 aa, Yersinia pestis CO92
MKKIDAIIKPFKLDDVREALAEVGITGMTVTEVKGFGRQKGHTELYRGAEYMVDFLPKVKIEIVVADDIVDTCVEAIMQTAHTGKIGDGKIFVFDVSRVVRIRTGEQDEEAI

SEQ ID NO: 11327 - protein, 575 aa, Yersinia pestis CO92
MISGILVSPGIAFGKALLLKEDEIVINRKKISADQVEQEVERFKAGRAKAAEQLEAIKTKAGVSLGEEKAAIFEGHIMLLEDEELEQEIIALIKDEHASADAAAYSVIEGQAKALEELDDEYLKERAADVRDIGKRLLKNILGLNIVDLSAIQDEVILVATDLTPSETAQLNLDKVLGFITDIGGRTSHTSIMARSLELPAIVGTSNVTKQVKNDDYLILDAVNNKVYLNPTADVIEQLKAVKNQYITEKNELAKLKDLPAITLDGHQVEVVANIGTVRDIAGAERNGAEGVGLYRTEFLFMDRDSLPTEEEQFQAYKAVAEAMGSQAVIVRTMDIGGDKDLPYMNLPKEENPFLGWRAIRIAMDRKEILHAQLRAILRASAFGKLRIMFPMIISVEEVRELKAELELLKSQLREENKAFDETIEVGVMVETPAAAVIARHLAKEVDFFSIGTNDLTQYTLAVDRGNELISHLYNPMSPSVLGLIKQVIDASHAEGKWTGMCGELAGDERATLLLLGMGLDEFSMSAISIPRIKKIIRNTNFEDVKVLAEQALAQPTAKELMDLVTTFIEEKTLC

SEQ ID NO: 11328 - protein, 112 aa, Yersinia pestis CO92
MKLVTVVIKPFKLEDVREALSSVGIQGLTVTEVKGFGRQKGHAELYRGAEYSVNFLPKVKIDIAIADDQLDEVIDVISKAAYTGKIGDGKIFVAELQRVIRIRTGETDEAAL

SEQ ID NO: 11329 - protein, 619 aa, Yersinia pestis CO92
MSLDIAKYPTLALAENPEELRMLPKESLPKLCDELRQYLLTCVSRSSGHFASGLGVVELTVALHYVYNTPFDHLIWDVGHQAYPHKILTGRRDRISTIRQKDGLHPFPWRGESEYDVLSVGHSSTSISAGLGMAVAAEREGKGRRTVCVIGDGAITAGMAFEAMSHAGDIHSDMLVILNDNGMSISENVGGLNNHLAQLLSGKLYASLREGGKKAFSALPPIKDLLKRTEEHLKGMVVPSTLFEELGFNYIGPVDGHDVHTLTQTLKNMRDLKSPQLLHIMTKKGKGYAPAEKDPIGWHAVPKFDPASGTLPKSQSSLPTYSKIFGEWLCETAAKDSKLMAVTPAMREGSGMVRFSREYPQQYFDVAIAEQHAVTFAAGLAIGGYKPVVAIYSTFLQRAYDQLIHDVAIQNLPVLFAIDRGGLVGADGQTHQGAFDLSFMRCIPNMVIMAPSDENECRQMLYTGYHHNGPAAVRYPRGNGTSAVLEPLEMLPIGKGVLRREGEKIAILCFGTLLAQAQLAAENLNATLVDMRFVKPLDEELVLEMAAKHQVLVTVEENAIMGGAGSGVNELLMAKRRWVPVLNIGLPDLFVPQGEQDEMRSELGLDAAGIQRQIEAWLA

SEQ ID NO: 11330 - protein, 188 aa, Yersinia pestis CO92
MYDLYEGLIFDMDGTLLDTESTHRQAWRQVLAPYGMHFDEQAMVALNGAPTWKIAGVIIAHNQSDLDPHFLAAQKTSLVNTMLLDNVKPLPLIDVVKSYYGRLPMAVGTGSEHSMAEMLLRHLGLRDYFDAIVGADDVTKHKPEPETFLRCAELLGVRPDKCIVFEDADFGVEAAKRANMAIVDVRLL

SEQ ID NO: 11331 - protein, 314 aa, Yersinia pestis CO92
MSNAEHLASVMVEQFIKAVDNGVDLVPVVADSTSTAKIGPFITRFPDRVVNVGIAEQAMVGMAVGLSMGGKIAVTCNAAPFLISRANEQLKIDVCYNNSNVKLFGLNSGASYGPLASTHHCIDDIAILRGFGNIEIYAPADPQECRQIIDYALAHQGPVYIRLDGKALPPLHDEHYRFAPGQIDVLQEGRDIALVAMGSTVHEAVSAAAILADNNISAAVVNVSSIRPCDTQQLFAILQQSQRVITIEEHNINGGVGSLVAEVLAEAGSGTPLVRLGIPDGGYAIAADRAEMRAYHGFDAAGIVARALRFCRGE

SEQ ID NO: 11332 - protein, 256 aa, Yersinia pestis CO92
MPNDYKWFDTAFSLSGKVAAITGGATGIGHAIAELYLAKGARVVLMDCADNVAEIAEQLDRDNAVGLHCDVSDSQSVRQAVAQAIGAFGQLDILVNSAGIAALDPAEKVREQDWDRTIDINLKGVFLMCQEVGKHFIQHGHGKIVNLASQAGVVALPNHLAYCASKFGVIGITKVLALEWGPLDIQVNAISPTVVLTALGQKAWSGQLAEDMKLKIPARRFAYPAEVAACALFLASDAANMITGENLVIDGGYTIQ

SEQ ID NO: 11333 - protein, 332 aa, Yersinia pestis CO92
MSQSTLKVNELHEDADFDENSTETEIFDEKALVDDEPTESELADDELLAQGVTQRVLDATQLYLGEIGYSPLLTAEEEVYFARRALRGDVSSRRRMIESNLRLVVKIARRYSNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILSDENENGPEDTTQDDDMKQSIVKWLFELNAKQREVLARRFGLLGYEAATLEDVGREIGLTRERVRQIQVEGLRRLREILQTQGLSIEALFRE

SEQ ID NO: 11334 - protein, 431 aa, Yersinia pestis CO92
MSKIVKVIGREIIDSRGNPTVEAEVHLEGGFVGLAAAPSGASTGSREALELRDGDKSRFLGKGVLKAVAAVNGPIAQAVIGKDAKDQANIDKIMIDLDGTENKSQFGANAILAVSLAAAKAAAASKGMPLYEHIAELNGTPGKFSMPLPMMNIINGGEHADNNVDIQEFMIQPVGAKTLKEAVRIGSEVFHHLAKVLKAKGLNTAVGDEGGYAPNLGSNAEALAVIAEAVKAAGYELGKDITLAMDCAASEFYKDGKYVLAGEGNKAFTSEEFTHFLEDLTKQYPIVSIEDGLDESDWAGFKYQTEVLGDKIQLVGDDLFVTNTKILKEGIEKGVANSILIKFNQIGSLTETLAAIKMAKDAGYTAVISHRSGETEDATIADLAVGTAAGQIKTGSMSRSDRVAKYNQLIRIEEALGDRAPFNGLKEVKGQ

SEQ ID NO: 11335 - protein, 930 aa, Yersinia pestis CO92
MTKYSLRARMMILILAPTLLLGLLLSTSFMVNRYNELQNQIVSAGTNIIEPLAVASEYGMSFRNRDTVRQLINLLHRRHSNIVRSISVFDVDNKLFVTSNYNYNSSQLRLPPGEPVPDSLMLSYRGDSLILRMPIVSESNLSSEQASGQGESDQILGYIAIDLDLQSVRLKQYKEIFISTLLLLFCMCVAILFAYRLMRDVTGPIRNMVNTVDRIRRGQLDSRVEGHMLGELDILKNGINSMAMSLAAYHEEMQQNIDQATSDLRETLEQMEIQNVELGLAKKRAQEASRIKSEFLANMSHELRTPLNGVIGFTRQTLKTSLTPTQTDYLQTIQRSANNLLCIINDVLDFSKLEADKLILEHIPFSLRETLDEVIILLAHTAHEKGLELTLHINNDVPDQVLGDAMRLQQIVTNLLGNAIKFTEEGNIDILVVVKAIASQQVTLMVEIHDTGIGISESQQAQLFQAFRQADASTSRRHGGTGLGLVITERLVKEMGGNISFQSQMSCGSIFRFHLTLELNESIPYRQPDMAHLEGKQLAYIERNSTAARATINILNTTPLQVTHRQSLAQLPEQHYDFLLVGVPIPFRNNMAIHQDKLLTALKIADHVILALPSQSQVEAEQLKQIGAKDCLLKPISSIRLIPLLLAEDTHSKVPSEEQPRKQPKLPFRVMAVDDNPANLKLIGTLLEEQIEETVLCDSGAMAITYAREHTLDIILMDIQMPEIDGIRASEIIHQIPHHQETPIIAVTAHAVKGQQEQLLRLGMADYLAKPIDEARLLQVLSRYQSDNPPLSTASTASTASTASTAESLPLPVPKGAGVIDWAQAVRQAANKEDLARDLLTMLLEFMPQITARVQAILAGADDGDILNLVHKFHGSCACSGVPRLRQLCMTIELQLRQQVNLQDLEPEWLELLDEIENVSEAAKTYLRTE

SEQ ID NO: 11336 - protein, 347 aa, Yersinia pestis CO92
MRIEEGLKLGFKDVLIRPKRSTLKSRSEVALERQFTFKHSGWNWSGVPIIAANMDTVGTFRMAEVLASFDILTAVHKHYTLEQWAEFVKRSPESVLRHVMVSTGTSSADFDKMKQILALSPSLKFICIDVANGYSEHFVSFLQRAREACPDKVICAGNVVTGEMVEELILSGADIVKVGIGPGSVCTTRVKTGVGYPQLSAVIECADAAHGLGGQIVSDGGCSVPGDVAKAFGGGADFVMLGGMLAGHDECEGRVVEENGEKFMLFYGMSSESAMKRHVGGVAQYRAAEGKTVKLPLRGSVDNTVRDIMGGLRSACTYVGASHLKELTKRTTFIRVAEQENRVFGTD

SEQ ID NO: 11337 - protein, 337 aa, Yersinia pestis CO92
MKTLGEFIVEKQLDFSHATGELTALLSAIKLGAKIIHRDINKAGLVDILGASGVSNIQGEDQMKLDLFANEKLKAALKARGEVAGIASEEEDDIVIFDGGRAENAKYVVLMDPLDGSSNIDVNVSVGTIFSIYRRITPFGTPITEEDFLQPGTKQVTAGYVVYGSSTMLVYTTGYGVHAFTYDPSLGVFCLSHEKVRYPATGCMYSINEGNYIKFPLGVKKYIKYCQEQDEATKRPYTSRYIGSLVADFHRNLLKGGIYIYPSTASHPQGKLRLLYECNPMAFLAEQAGGKATDGVNRILDIVPEKLHQRAPFFVGTKSMVEDAEGFIAKFPDEEAK

SEQ ID NO: 11338 - protein, 778 aa, Yersinia pestis CO92
MKQIRVLAQYYVDLMVKLGLVRFSLLLASALVLLAMVVQMAVTFVLRGSVETLDLVRSIFFGLLITPWAVYFLSVVVEQLEESRQRLSRLVDKLEVMRHRDLELNKQLTENITQLNQEIVEREKAEKAHLQVVDKLKEEMGHREQAQIELGQQSALLRSFLDASPDLVYYRNEDNEFSGCNRAMELLTGKSEKQLVGLTPKDVYAPDIAEKVMETDEKVFRHNVSLTYEQWLVYPDGRKACFELRKVPFYDRVGKRHGLMGFGRDITERKRYQDALENASRDKTTFISTISHELRTPLNGIVGLSRILLDTELDAEQLKYLKTIHVSAITLGNIFNDIIEMDKLERRKVQLDNQPVDFTGFMADLENLSGLLVQPKGLKFIMEPQLPLPEKVIADGTRLRQILWNLIGNAVKFTQQGKIVVRVRREGNDRLIFEVEDSGMGIPEDEQDKIFAMYYQVKDRNGGRPATGTGIGLAVSKRLAQSMGGDITVKSTQGVGSCFTLTIKAPAVQEASNAPSGDDMPLPALHVLLVEDIELNVIVARSVLEKLGNSVDVAMNGHDALAMFNPEDFDLVLLDIQLPDMSGLDIARQIRAEYGKQSLPPLVALTANVLKDKKEYLDAGMDDVLSKPLSVPALTAMIKQFWDSKPSSAVQKQEHKVMQTHESLLDTTMLEQYIDLVGPQLIHQSLEMFEQMMPGYLAVLDSNMTARDQKGITEEAHKIKGAAGSVGLRHIQQLAQQIQTPTLPAWWDNVQDWVDELKLEWRNDVQVLREWAAEVEKK

SEQ ID NO: 11339 - protein, 549 aa, Yersinia pestis CO92
MEIFFTILILILVVSLSGVVTRMLPFQVPLPLMQIVCGALLAWPNFGLHVNFDPELFLVLFIPPLLFADGWKTPTREFIHHGREILGLALALVLVTIVGIGYLIYWMVPGIPLVAAFALAAVLSPTDAVALSGIVGKGRIPKSIMGVLEGEALMNDASGLVALKFAIAVAMGTMIFTVSGATLEFLKVAIGGLLAGVAITWLYSKSLRIMSRWSGDDPATQIVLLLLLPFASYLVAEHLGVSGILAAVAAGMTISQSGIIRNAPLAMRLRADSVWSMLEFVFNGMVFILLGLQLPGILETSITQAELDPTIQTWNLFADVAIIYGALLLLRFGWLWSMKKISKRVLTKRPLQFSDYTTRELWVASFAGVRGAITLAGVLSIPLFLSDGSAFPSRYQLVFIATGVILLSVIIGVIALPPLLRGVVVADKSASREEIRLARAAMAEVAIVSLNKMEERLMTSSEENIDSELLKEVSSRVIGTLRRRTGSKDEVENTLLIENLERRFRLTALRAERGELYHLRATQKISNETLQKLLHDLDLLEALLIEKEG

SEQ ID NO: 11340 - protein, 1231 aa, Yersinia pestis CO92
MVDTVIDNKVKELHQQLAQRILVLDGGMGTMIQSYRLEEADYRGARFADWASDLKGNNDLLVLSKPEVITAIHNAYLEAGADILETNTFNSTSIAMADYQMASLSAEINYEAARLARICADEWSARTPEKPRYVAGVLGPTNRTASISPKVNDPAFRNVSFDQLVEAYRESTRALIEGGVDLIMIETVFDTLNAKAATFAVESEFEVMGVLLPVMISGTITDASGRTLSGQTTEAFYNSLRHVKPLSFGLNCALGPDELRQYVAELSRISEYYVSAHPNAGLPNAFGEYDLEAKEMAEQIGEWARAGFLNIVGGCCGTTPRHIAAMVNAVAGVPPRPLPDIPVACRLAGLEPLTIDANTLFVNVGERTNVTGSARFKRLIKEEKYGEALDVARQQVESGAQIIDINMDEGMLDAEAAMVRFLNLIAGEPDIARVPIMIDSSRWDVIEKGLKCIQGKGIVNSISMKEGVDAFIHHAKLVRRYGAAMVVMAFDETGQADTRARKIEICRRAYKILTETVGFPPEDIIFDPNIFAVATGIEEHNNYAVDFIEACADIKAELPHALISGGVSNVSFSFRGNDPVREAIHAVFLYYAIRNGMDMGIVNAGQLAIYDDLSDELRDAVEDVILNRRDDSTERLLDLAEKYRDSKSGEVAIQQAEWRGWPVVKRLEYSLVKGITEFIELDTEEARQQADRPIEVIEGPLMSGMNVVGDLFGEGKMFLPQVVKSARVMKQAVAYLEPYIEASKQKGTTAGKILLATVKGDVHDIGKNIVGVVLQCNNYEIIDLGVMVPTEKILRTAREEKVDIIGLSGLITPSLDEMVNVAKEMERQGFTLPLLIGGATTSKAHTAVKIEQNYSGSTTYVSNASRSVGVVSALLSDTQREAFVAKTRKEYETVRIQHARKKPRTPPVSLQAARNNPTVIDWENYTPPVAHKLGVQVVEASIETLRNYIDWTPFFMTWSLAGKYPRILEDEVVGEEAKRLLADANALLDKLSAEDLLHPKGVVGLFPANSVGDDIEIYRDERRDEVLAISYHLRQQTEKTDFPNYCLADYVAPKSSGKADYFGAFAVTGGLEEDALADAYDAQHDDYNKIMIKALSDRLAEAFAEYLHERVRKVYWGFAPNENLSNEELVRENYQGIRPAPGYPACPEHTEKGQIWQLLDVETHTGMKLTESYAMWPGASVSGWYFSHPDSKYFAVAQIQRDQVEDYAARKGMPTAEVERWLAPNLGYDAD

SEQ ID NO: 11341 - protein, 285 aa, Yersinia pestis CO92
MTKEMQTLALVPQGSLEAYIRAANAYPMLTAEEERELAERLHYQGDLGAAKQLILSHLRFVAHVARNYSGYGLPQADLIQEGNIGLMKAVRRFNPEVGVRLVSFAVHWIKAEIHEYVLRNWRIVKVATTKAQRKLFFNLRKTKQRLGWFNQDEVELVAKELGVTSKDVREMESRMSAQDMTFDPSPDDEARDGQFMAPVLYLQDKTSDFADGIEEDNWDSHAADKLSYALEGLDERSQHIIRARWLDDENKSTLQELADQYGVSAERVRQLEKNAMKKLRMAIEA

SEQ ID NO: 11342 - protein, 900 aa, Caulobacter crescentus CB15
MSQASTPEPAPASSFGEGEAARWFFDNASDLFTVISAEGRFISVNDAWSHLTGWARDELVGQPTIKFVHPDSQAELVDTGRRLRQTGSAINELKIRCKDGRWIWLQGRSRLGPHGEMVGVMHDISAEVEARLELEAARRTQALLAEKAGIGVWSYEPETQRIDWAPDALALMGVSPEDIATPELFLARLPENHRAEVQAAFVHAARTGEGGTLEYRLRANDGRWFTLRATYRTEARPGSGFALKGVSQNITDVARSRDKAIWSERRARRLIEDAPFAVAVYDVDMRLRMVSPRFLEIFRSTEAQVIGKTLTELTNGTRRRFVNRVARALSGEVVTRREDRLYDAEGVERAFRWEARPWRDVAGEIVGVITYMDEITALTEARREARNNARRLKVALGAARAGVYEIDHEKQAFWGSPEFHRMMGRRIEYQDVREGIWPMVHPEDLTQLYETAATWRREGRRTPQEHEVRLLSPGGEARWARVFHEVRRDGQGKALKAVGLILDIDEKKKAELALIEAERAAQAANEAKAQFLANMSHEIRTPMNGVLGVMHVLKRELPPGDSASLLNEALAAGQMLSTLLDDVIDISRIEAGRLDLNHEPVDPRDLVRGVARLLATQAAHKGLRLELDLPDDLGWIETDPTRVRQALFNLIGNAVKFTLKGSVTVRAQRRITDAGPYLVFDIIDTGVGVPLEAQKRLFERFQQADAGTTRRFGGSGLGLAITRKLARMLGGEVSFRSVPGEGSTFSLTIAAPPVGPPSAQAGETSELLTSLKVLVVEDNPTNQLVARRILEQLGAEVSVADDGAAGVEAAERGRFDLILMDVQMPGMDGLEAARRIRALPGPAGRAPIIALTANVMAHQRAAYRAAGMDGVAAKPISPAALVAEILRLSRIEPDPRCAVA

SEQ ID NO: 11343 - protein, 514 aa, Caulobacter crescentus CB15
MSDSRSDDRHPSVTPEQLATLSHEFRTPLNGVLGMARLLENTKLTAEQRSYVTALRESGDHLLSLVNDVLHFARLGAAAIELSLAPVDIEGLLRQVAELMSPRAHEKGIEIAWAVSSPLPTILADEGRLRQILLNFAGNAVKFTEAGGVLLTASAIDGGRVRFSVADTGPGVAPDARARIFEAFVQTDVTHATQLGGAGLGLAIVSRLSAAMGGAVGVGGELGQGAEFWFEAPFATAAAPLRAAPLEGRNVAIASPNAIVRAATARQIEAAGGRAYAAVDIASALAGAPADAVLLIDAALSGPRGALKPPAGRRSVVLLTPEQRDRIDRLKAAGFSGYLIKPLRAASLVAQVLQAVTADGVAEDEPAHDDRIAGAVASGARVLLAEDNPINALLARTLLEREGCIVDRVADGEQAIAAASAGVYDLILMDLRMPGLTGIEAARALRAKGVATPIAALTADAFDEDRRTCLAAGMDDFLVKPLTQEALRDALKRWTTGGVSGGWTKPATRAKVAG

SEQ ID NO: 11344 - protein, 161 aa, Caulobacter crescentus CB15
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 11345 - protein, 261 aa, Caulobacter crescentus CB15
MAQSTGRVAGKKAFITGGAQGLGAAAGRMLAKEGAKVALADINLAGAQAVADEINAAHGAGTAFAFELDVTQEDQWIDVLEKATAAMGGLSVLVNNAGIGGDGPIESLDFGLWKKVMSVNVDSVFLGAKHALTHMRAHQPGSIINLSSIAGLIANGNSPAYNASKAAVWLLSKNIALYCAKMKLDIRSNSIHPTFIDTPILDGFSARFGKEEAFAKLARQVPLGRIGEPTDIANAVLYLASDESKFMTGAEIKVDGGISAM

SEQ ID NO: 11346 - protein, 463 aa, Caulobacter crescentus CB15
MADYIVKDISLADFGRKEIAIAETEMPGLMATRAEYGPQQILKGARIAGSLHMTIQTAVLIETLTALGAEVRWASCNIFSTQDHAAAAIAAAGVPVFAFKGENLVEYWEYAHKIFEWHDGGYPNLILDDGGDATLLCVLGPKAEKDPSILNNPQNEEEEALYAVMKKYLAEKPGFYSAIRAAIGGVSEETTTGVHRLYQMAQKDELPFPAINVNDSVTKSKFDNLYGCRESLVDAIRRGTDVMLSGKVAVVCGYGDVGKGSAASLRQGGARVIVTEVDPICALQAAMEGYEVQTLNDVADKADIFVTATGNKDVITVDDMRKMKNNAIVCNIGHFDSEIQIAGLRNFKWDEIKPQVHHVEFPDGKKLIVLSEGRLVNLGNATGHPSFVMSASFTNQTLAQIELWTNKAKYENQVYTLPKHLDEKVAFLHLEKLGAKLTTLRKDQADYIGVPEAGPFKPDHYRY

SEQ ID NO: 11347 - protein, 449 aa, Caulobacter crescentus CB15
MGAGRRPRSRTSTMAPCSTVSISPSNPILEGTRSGKSESAFVPRGGSLISAAAVSLPRHNLCWELDRIRYVERPRGGGSLALEDYSESRRAGERLAAGHGVDDPFAAAISATRMAMIVADATQPDIPIIFANDAFLRLTGYARDEVIGRNCRFLQGPDTDPKAIQAVRDALAAGEDVAVDLLNYRKDGSPFWNALNMSPVRNDAGQLVYFFGSQVDVTDKKVVELRARDHSDGLQQMVEERTRELTEALKQKTALLHEVDHRVKNNLQLISSLLLLQNRRVPDPAVKASLRGMLGRVNAIATVHRRLFQSEDVERFDVSAFIRDMVADLMGSAMRDDIRVELDLERVEIPAAKAAPLALVVNELLTNALRHGFPEGRGGRIFVGLSRLNGDFRIEITDDGVGQDRETRASGFGLTIVQLLCQQLKAKWETTDAEPGTRVVVLLPINGTQ

SEQ ID NO: 11348 - protein, 483 aa, Caulobacter crescentus CB15
MNRRDILRGAALTGAAAVLTPETLWAAAANDWTLGIADVEADIAPTGLTRIHGRAPADLTGTLFRNGPAKFRRPGGAVGHWFDGDGMVRKFQMADGQARMTARFVDTVKRRQDTAADAVITPGYGTASGPGARLGSADDANAANTSVMMAGGELWALWEGGSPTAMDPVTLETRGFKALSPDMKGMPFLAHPRVEPDGTVWNLGLAGKRAVVWNLSADGALRKAEVITLPRAGYMHDFTATERSLVIILQPWVQEGMSMPIATNMVWRPELGTKVLVLDKNDLSKRRVFELPPFFFFHLGDAWEEADGTIRFDACIDKDPSGTAANGGAIVRGEFLKAPPPRRAMITLRANGQAELAAEAVSAEFPRSDPRFAGLARRYSVHLTNERPDRPLFQSVAVRDWKKDRDQVFDFGARHLVEEMVFALRPGSSAELDGWLVGTTLNLDARATELHVFDARHVERGPLVTWRASVALPVTFHGVFVGA

SEQ ID NO: 11349 - protein, 419 aa, Caulobacter crescentus CB15
MRTYHSPLDLVRERSPERPVALVRPDAVAVAARWFQSEFKGDVFYAVKANPSPWVIRELAKAGVRSFDVASLNEVELVANEAPGSRMAFMHPVKSRAAISAAYFDHGVKTFSFDTHEELAKILDATGQAKDLNLIVRMGVQAEGAAYSLSGKFGVEMHNAPDLLLAARRATQDLMGVSFHVGSQCMRPTAFQAAMAQASRALVRAGVLADVVDVGGGFPSIYPGMVPPDLSEYLAAIDRGFAEMMVHETTELWCEPGRALVAEASSLLVKVELKKGDALYLNDGSYGSLFDAAHMKWPFPVKLYRKSGEVVEEGLKPFRFYGPTCDSVDHMPGPFYLPESVDEGDYIEIGMLGAYGVAMNTRFNGFGETDTAQVQDAPMASMYGLAKRSIPVVRQETEERKIVRFSRPKGAAGKRKRRR

SEQ ID NO: 11350 - protein, 479 aa, Caulobacter crescentus CB15
MREYTKFYIDGAWVDPAAPNTLDVINPATEEVCGVISMGSEADVDKAVRAARKAFASFSQTSREERIDILERIIAEYQKRFEDMAKAITEEMGAPAWLAQRAQAAMGIGHVQTAAAVLKGYKFEEDRGTTRIVKEPIGVCAFITPWNWPVNQIACKVGPAIATGCTMVLKPSEIAPFSGYIWTEIMHAAGVPAGVFNLVNGDGPTVGAALSRHPEVDMVSFTGSTRAGIEVAKNAAPTVKRVHQELGGKSPNIILDDADFSRAVAGGVASVMMNSGQSCNAPTRMLVPGARMDEVIAIAKAAAESHTVGDPNGNHKMGPVVSETQWNKIQGLIQKGIDEGATLVTGGVGRPEGLDKGYYVKPTVFANVTNEMTIAKEEIFGPVVSILGYDTVDEAVTVGNDTEYGLAAYVSGGDQDEVRKVASRLRAGQVTLNGAGPDLMAPFGGYKMSGNGREWGDHAFGEFLETKAILGYSAKVAAE

SEQ ID NO: 11351 - protein, 276 aa, Caulobacter crescentus CB15
MPVRPVLKIVKGQPTSDGAGVRLTRMLGTPEAQMFDPFLMLDCFDNDQASDYLGGFPDHPHRGFETVTYMLEGRMRHKDNTGREGVIGPGGIQWMRAGKGIVHSEMPEQDQGRMRGFQLWVNLPARLKMSAPGYQEFETDSIPVEARDGGVTVKVISGATETGTAGPIGGGAVDALYFDVALPAGTVFEEPVGDDRNAMLAVYEGKVRVAHDTVDALSGVFLGRGDTVRVEAVTDARVLLLAGRPIGEPVFWHGPFVMDTREGLMQAFDDFQRGRF

SEQ ID NO: 11352 - protein, 114 aa, Caulobacter crescentus CB15
MKMIVAVIKPSRLDAVLEAVTEAGASGLTVTEVRGYGRQKGKTEVYRGAEYEVKLLPKVKLEIAVPTDVLEPVIEALQRTANTGKIGDGKVFVMDLEQALRIRTGERDAAAIAG

SEQ ID NO: 11353 - protein, 716 aa, Caulobacter crescentus CB15
MSLYRRRLGVEALELIRRGTSQNALLGKGFAVDVGASGSDLCLWASGSDGEAARELLTELASLVVELVADASPFAMLEQAPDDLISHYDLTGRLLRVSPAWSRIIGGSVAEAAGRRTWDFIAPEDHPAVAAYYADLLREGAAPSSRLRMRVRHVAGDIRVLESRPMPIRNAEGVVTGFVDIARDITEQIETERRYQLALAQAHEARERAEASEWRLRLLAESAQDLTVQVDASGKILYASSSADRLGLANLAQEGASFMSLVHPDETERAATFIAGAFESRGDKRPSLDTELRFLSVDGDYRWMEGKGWLERDADGVPVALTSTFRDMTDRHSLEESLIAARVRAEAAVRAKSAFLANMTHELRTPLTSVIGFAEQIQAEPALSPTVRHASDRISAGGRALLSTINDILDFSKLESGGVSIVTAATEVNGLIAETVALLSVQADRKGLSLSYDGSAVLGLCAALDSQHVRQVLLNLIGNAIKFTEQGGVTVTAQRNDDGMLEIAVADTGIGIAEDHLERLFGRFSQVDDTIARRFGGSGLGLAIGRFLAEAMGGEIQVSSTVGRGSTFTLTLPLLSLDAAPESAAAPPVLPEGAPILLIGSAIQSLSAVLADAGARVDEATTAEAALSLSEARGYDCVVFQLDLDLDGHCDLARRMRQAGQNRYAPYLAVVSREAAATPPPQILDGLLAQDASPATAIRSVAALMDDGLPEGVGPA

SEQ ID NO: 11354 - protein, 473 aa, Caulobacter crescentus CB15
MLSKRARLQSLRAARRRAGDSDPPPRSTRIKATEQRRSRLPEDRSDAVSRPRRRRLALADTQTIEAIMLSREFLKAGHAPTLFAAFLYFDLSFMVWVILGPLGVAIAKDFNLDPAQKGLMVAVPVLAGAVLRLVNGVLVDRIGPKKTGIIGQLIVLAGLVTAWAVGLHNYQQILALGLVLGVAGASFAVALPLASRWYPQEHQGLALGIAGAGNSGTALAALFAPALAKTFGWQNVIGLAAIPLAFAFVAYLVLAKDAPEQPAPKKLAEYLDVLKVPDAWWLMLLYGVTFGGFVGLASSLTMYFNSEYGLDPVIAGFFTAACVFAGSFIRPVGGALADRYGGVRTLGVVYVLAAIGLTVAGFQLPSAGLALAVLLFAMLALGAGNGAVFQLAPQRFRNEIGVMTGLIGMTGGIGGFYLASTLGLAKKMTGSYQSGFIGFALLAVFALIALFSLKARWRAVWPTLHGDAAPVRV

SEQ ID NO: 11355 - protein, 776 aa, Caulobacter crescentus CB15
MPTPFPQDIDALRASEAFFRLLTEQAGDVISRHRLSGTDHYVSPAVERMMGWTAEEMLEAGFKAFYHPDDTPAVYDVYNRMRAGVEHCSVRYRGRRKDGRYVWLESHLTLVRDEAGAPSELIAVTRDIDERVQLEDEARHTREAMRETQQRAMLAEQVAQVAFWRVDLITNEVYLSPRFRELYGWTQDEPISLGEVLSRFHPEDRPVARARVAEHLRTGEPSRNRMDRIIRLDGAVRHIVGSFEFDFDDNGRPIAMSGTTVDVTDLVAAQQSLAKTESRFQDLAKATRDIVIEVDRRGNILFVSAAVEPVLGYAEGELLGRKAAKLTHPNDLPGLVQAFGAVLADPEGLPPVLEARALHKDGHWVWLQGRPVLNRTAGRIEGVIQDITEYKRARDELAAEQARAEQALEARSAFLANMSHELRTPLTAVIGFAALVEGLDDLPETARDYVGRISTAGKALLSVINDVLEMSKLETGQVQAHLAPCALAPLIDDTVRMFGLHAAEKNLQIAVRMVDPPPRVLMIDPDRVRQVLINLIGNAIRYTDAGSITLEVIWRGELEELFVAVKDTGIGIDPADQAHLFKRFSQIESARARSRGGSGLGLVISKGLVEAMGGRIGASSKPGEGSTFWFAIPASGPLRDEDAGPEPEPVFEPVRSGGRILLADDNALNREMTRAILGVFDAEVVEARDGQQAVEAARDQAFDLILMDIRMPVLDGLDATRAIRAEPGPNQGAPILAFSADMDFQLSEIFDGLVRKPITAAQLIQAVAGAQRAVAI

SEQ ID NO: 11356 - protein, 591 aa, Caulobacter crescentus CB15
MRPFATCKGAARTRSLVSFPRTSAALPRFAEWLDQDVTSVTARSLPTLGVRLAICAATALIYALAVDLQGGLLWGLAVASAEAAVFICSSPQRADRKISHAQRLSYVAAVAWMNIVWWSLAIMLWRQDHPALRMAALCVVCAFLVHAQAFTARSKTLLLIVGGGSATLLLVLCGVLNDFPPSERLALCAAAIILIIYTAKAAQTNGQQGRALELAKSQAEAASQAKSEFLALMSHELRTPLNGMLGLSQALKLEPLEPGEREQVELLEESGRTLLALLNDVLDMAKIEAGKLDIAPTQEDLSRLAERVVRINQAQAREKGTEITLEIDPATPRALLFDPLRVRQCLGNLVSNAVKFTPAGQIRVRVTCEAGDQPDRMLAKIIVSDTGVGMGPAVLARIFTPFEQADPTIARRTGGTGLGLNITRRLAQMMGGSVSVRSTEGKGSTFTLTFGCRLPSAGAAETGGPLSGEHPLRLLVVDDYAVNRKVIAMMLAPLGCEIVEADNGQRALDLLAEREVDAVLLDFNMPVMGGLETTRRLRADPRWRKLPIVCLTAGVMDDERAAAATAGMDGFIEKPIEMSTLVSTLARVARR

SEQ ID NO: 11357 - protein, 367 aa, Caulobacter crescentus CB15
MPDDASKPAKPAAADKFGEGFVWDAWYVAALSPDLKPGTKSKREYLGEPVLLGRTRAGQVYAIRDICPHRAAALSAGRLHREADGTDSVECPYHGWRFGPDGACTAIPSLTADSDFDIAKVRVRRYPTVESQGLVWIWMSSDPRFDGQPPEPPPVIPGVVGGKPKLVDHLDYDIHIDHAVLGLIDPAHGPYVHQQWWWRTKTSQHEKNKRFAPSEAGFTMVRHEPSKNSKAYAILGGEPLTEITFRLPGLRWEHVTVGKKQVLALSAMTPINAHKTRMNQIMWSDHWAFTALYPIIRIAARAFLRQDGRIVENQTPGLKCNPPLMWVGDADQQARWYHQCKREWNASRREGRPFVNPVKDQTLRWRT

SEQ ID NO: 11358 - protein, 483 aa, Caulobacter crescentus CB15
MKVERLPPVRTSLGPTNHPYMTGPWTPQHEEVNAWDLEVLEGAIPADLDGVYLRNTENPVHDPIGRYHPFDGDGMIHQIEFKGGAATYRNRFVRTRCFEAEQEVNEGLWGGLMDGPGVSKRPGFGAHGALKDSASTDIVVHNGEAIATFYQCGEAYRLDPLTLENLGVASWAPLEGVSAHPKVDEATGELMFFNYSKAWPYMHYGVVGPDGKRKVYQGVPLPGPRLPHDMAFSSKYAILNDLPVFWDQELMARDIHAVRLHKGIPSRFALVPREGGEPRWFEAEPTYVLHWLNAYEDGDEVVLDGYFQEKPIPRPLEGAPDGHGHLMAYLDEHSFLPKLHRWRFNLKTGETTEKHLDDRVLEFGMFNQKYAGKPYRYAYSTTAKPGWFLFNGFVKHDLETGESWSIALPEGRYASEAPFAPKVGAVDEDDGYLVSFIIDENKGASECLIVDAKRFEVVCRIALPHKLSSGTHTVWAGREMLTK

SEQ ID NO: 11359 - protein, 519 aa, Caulobacter crescentus CB15
MVVRTTACALIPVTLMSPATKGPTRTSRASTGRYGPMGRTPVASVSNAGPSAGMSADGGKVNMTFVAAIVAVATIGGFMFGYDSGVINGTQEGLESAFNLSKLGTGLNVGAILIGCAIGAFAAGRLADVWGRRTVMIISALLFVISAIGTGAAESSIVFIIFRLIGGLGVGAASVLCPVYISEVTPANIRGRLSSVQQIMIITGLTGAFVANYALAHTAGSSTAEFWLGLPAWRWMFWMQIIPAGVFFLCLLGIPESPRYLVAKGKDAQAEAILSRLFGAGQGAKKVEEIRASLSADHKPTFSDLLDPTTKKLRVILWAGLVLAVFQQLVGINIVFYYGSVLWQSVGFTEDDSLKINILSGTLSILACLLAIGLIDKIGRKPLLLIGSAGMAVTLGVLTWCFSTATTVNGALTLGDQIGLTALIAANLYVIFFNLSWGPVMWVMLGEMFPNQMRGSALAVCGFAQWIANFAISVSFPALAAASLPMTYGFYALSAVVSFFLVQKLVHETRGKELEAMQG

SEQ ID NO: 11360 - protein, 478 aa, Caulobacter crescentus CB15
MTDTLRHYIGGERVAADAPAESLNPSNTNDVVAKVPMGGQAEVDAAVDAARKAFPAWADASPEVRSDLLDKVGSTIIARSADIGRLLAREEGKTLAEGIGETVRAGRIFKYFAGEALRRHGQNLESTRPGVEIQTYRQAVGVYGLITPWNFPIAIPAWKAAPALAFGNTVVIKPAGPTPATANVLADIMAECGAPAGVFNMLFGRGSMGDALIKHKDVDGVSFTGSQGVGAQVAAAAVARQARVQLEMGGKNPLIVLDDADLERAVAIALDGSFFATGQRCTASSRLIVQDGIHDKFVALLAEKVAALRVGDALDPNTQIGPAVSEDQMETSYRYIDIAASEGGRVVTGGDRIKLDNPGWYVRPTLIADTQAGMRINNEEVFGPVASTIRVKSYEEALEIANGVEFGLSAGIATTSLKHARHFQRYARAGMTMVNLATAGVDYHVPFGGTKSSSYGAREQGFAAVEFFTQTKTSYSWS

SEQ ID NO: 11361 - protein, 586 aa, Caulobacter crescentus CB15
MGWLAKAWSDERLDEVAADTYRLTLSRLISAALVAVIMVFALGPAIATGWLLSLYIGEGLALLVTRRFKDGRTGTPRERAWFAWASIPINISWTTLAILLWLHGEDLMKIAAVAIWCGQVIYTQNFRHQSAALLLLNGLTPMASLLIFPFFFMPDASAAAQTARWGLVLLVGTTLNVMIQNRAAARRMDELTRGLREEREKALEAARAKSTFIAVTSHELRTPMNGLLGMAHALQRSTLDPVQREQIALMIKSGDSLMQLLNDVLDLSRVETGKVELAPIDMSLQDLVGEVVDAWRDAAVFKNLSLSVDYAPDLPPGVHADPLRIRQVVTNLVSNAIKFTVDGGVRLEVAARPANGGDQRVSITVADTGPGVPADAMERVFDSFTQADQTISREHGGAGLGLSIARALARQMGGDLVLVPSGRGACFVFTFAAPACAAPVAAPEEVGANGDALGPLQVLMAEDNAINQLVVRTMLEPLGVALTVVENGQEALEAMAERRFHCVLMDINMPVMDGITALEAIRDGRTGNPAMPVIALTASAMTGDRERFLGLGFDDHLGKPVKPVDLITAIAKAVNPEPPNAGRRAA

SEQ ID NO: 11362 - protein, 605 aa, Caulobacter crescentus CB15
MAPSKGEDSRLVRIALTEAYVPIARGYLLAAAIYNSLIAIAHPFYEKGLAFVMLTSLTGATAIYAFSAWFLLRRRRIVGGHLEWLVLGMNALFLGHVTAFHLFHLEPQKLIYFVLLALVFATSAPSRRVANVSVGAALVSLVFIARGAPGDMVNQYLFVGLAGAFAAVGMSTLMRGVVGREVRARLASQALNDELERELTENRRLRTEAQALALAAEKANRAKSEFLATMSHEIRTPLNGVLGMAQIMASGKLQVDQRRRLETITASGQSLLGLINTILDVSRIEDGKMEIVEGPFDLTAQMHTLSLLYGGLARDKHLDFSLEVSPTVAGCRQGDGERLRQVLSNLISNAIKFTDSGAVRVTLDGDDQGLVARVLDTGVGIPEAQRERLFTKFAQLDSSSTRRVGGSGLGLAICKSLAELMGGEIRFLAPAEGGACFELTLPMARIDPPPAVAAPPAPALAPASADEDAAPRILVVDDNQTNRAVLLTLLGHLGADAHFAVDGRDAVAMWEQDRWDVILMDIHMPEMDGLQACQVIREGERQGGRLRTPVVAVTASVLPHERSLYVEAGMDAVVPKPVEVPKLLEVLANVLADADEAAVETRGAA

SEQ ID NO: 11363 - protein, 570 aa, Caulobacter crescentus CB15
MVRVLEYGSVMTAFDRRTLLQGALSLGAAGLLPGWATAAGGERSPPALSGEEIKLTVGHTMAKIDGKAGHAVTVNGAIPGPLIRLKEGQNVRLSVTNTLDEDTSIHWHGLLVPFQMDGVPGVSFPGIKPGETFTYEFPIRQSGTYWWHSHSGLQEQMGHYGPMIIDPAGEDPVAYDREHVVVLSDWSFLHPHELFRKLKVSAGHFNRQKQTVAGLLKGQDQSLKDRVAWGQMRMDPTDIADVTGSVYTYLMNGHGPGDNWTGLFAPGERVRLRFINAGAMTIFNVRIPGLSLEVVGTDGQLVSPVAVDEFQIAPAETFDVIVRPTEDKAFTLVAEASDRSGMARGTLAPRLGMTAAVPPLRRRPLANMKDMGMGNMHHGMDMPGMDMSMRAQSNAPNVPLTPGVQTISPMPMDRMVEPPQGLEDAGHRVLTYADLASLYPPKDSRAPGRTIEIHLTGNMERFMWAFDGEAFGPLKKPIAFQRDERARVVLINDTMMAHPIHLHGHFFELVNGQERQPLKHTVNVAPGGKVAFDLTADEPGDWAFHCHMLLHMHAGMFNVVTVRPLDGAAA

SEQ ID NO: 11364 - protein, 597 aa, Caulobacter crescentus CB15
MILPTALKSRLALEFETLPDPFRRPAARAAGLDPAHAWRLGWLAAVCLAAAAALFTADSGGWPVWAALGAGALPALVSLIFTREDERTQSWLLVLWAVGGSLAAVLTGGVGGAMAAWCLAPVAAASTQDQPKRLAEGAALALIGACVAALTQLSGLAPAAPTGPLAFVLGFLALVTTGLGLAAGLLIGRRRQGARDDRYASEIIGLETLLDGLPHLAIAVRGQGQVTAVRGAAPPGVTRADLVNRGLTGAAAPGDRQRLTAAIAQAHREGSASLTFNPALGVERVVALDMHRVAPNQLVGVLRDITVERHREHALDQARIDAEALAAGRARFLANMSHELRTPLNAIMGFSDIMRARMFGPLSDRYAEYAELIHESGGHLLDLINDVLDMSKIEAERFELQRGVFDAREAVQAAMRLLRVQSDTAGVQLRGVLPPGELEVDADRRALKQIVLNLVSNALKFTPRGGQVTVTAHGYDGVLEIVVADTGVGISPEDLERLGRPYEQAGGAEQRARGTGLGLSLVRAFAQLHGGEMVIESRLGAGTTVSVRLPVLLAPMVAATPTPPAAPEAPSAPEPAPTVEEPPPASLGDNVIAFAPR

SEQ ID NO: 11365 - protein, 260 aa, Caulobacter crescentus CB15
MSSPLHKLFDLTGRVAIVTGGSRGLGLQIARALAEYGAAVALVARKQGELDAAVAALTAEGRTAVGLVADLGQAGSAQDLTARVLERFGRIDILVNNAGAAWGAPAEDYPLEGWNKVMDLNVTGLFLLTQAVAREAFLKQGKGAVVNVASIEGLQGHHHSQLGTIAYNTAKGAVINMTRALAAEWGPRNIRVNAVAPGYFPSKMTMTTLGQHGDDMLRQTPLGKLGGDTDLMGPALLLASDAGGHITGQIIVVDGGMTII

SEQ ID NO: 11366 - protein, 112 aa, Caulobacter crescentus CB15
MKLIIAVVKPFKLDEVREALVAAGVEGLTVSEVKGYGRQKGQTEIYRGAEYQVNFVPKVKLEAVVDDASAAKAVEAIKGAAATGKIGDGKVFVLNVEEAVRIRTGETGSAAL

SEQ ID NO: 11367 - protein, 317 aa, Caulobacter crescentus CB15
MSSNTLDRALVLDAVRVTEAAAIASWTMLGRGDEMAADQAAVDAMRNALNELDIDGEIVIGEGERDEAPMLYIGEKVGTGKGPRIDIALDPLEGTTLAAKSQPNALTVMAWAPKGTLLNAPDTYMDKIACGPGLPAGVIDLDRSPAENIQAVADAKGVALSEITVCVLDRPRHAEIIASVRAVGARIHLITDGDVAGVINTTDPLTGIDLYLGSGGAPEGVLACAALKCVGGQFQGRLLFRNADERARAARWGVTDLDKKYDLHEIVRDEAIFAATGVTRGGLLDGVVYRDGCVHTHTLVMNSSTGTVREVRMKRKV

SEQ ID NO: 11368 - protein, 336 aa, Caulobacter crescentus CB15
MGRSAFGSRTRMTAFVDLAARLAAEPADAALKDVVLTIAETCAQISRVVASGALSGSLGAAGSTNVQDEEQKKLDVITNDMLSDALKACGPVAGLASEELEEVEPTGRVGGYLVTFDPLDGSSNIDVNVSVGTIFSVLPAPAGHAPTEGDFLQPGRNQVAAGYAVYGPQTMLVVTLSGGVNGFTLSADGRWLLTHPDLAIKPDTAEFAINMSNQRHWAPAVRRYIDGCLQGKDGARGKNFNMRWVASMVADVHRIMMRGGVFMYPWDAREPDKPGKLRLMYEANPMSLLAERAGGKSIEGLNEILDINPAKLHQRVPVVLGSANEVEVIRAEMRAG

SEQ ID NO: 11369 - protein, 900 aa, Caulobacter crescentus CB15
MNSKMPVETLTKAQWVYAFGGGGADGDASMKNLLGGKGANLAEMSSLGLPVPPGFTITTEACVHYYANGKQYPAELAEQVQAGLAKIEEITGKQFGDVTNPLLVSVRSGARASMPGMMDTVLNLGLNDETVEGLAKLSGDRRFAYDSYRRFIQMYSNVVLNLEHHMFEEILDDHKDRLDVNVDTGLTADDWAAVIKDYKAAVREQLGKPFPQDAQEQLWGAVGAVFASWMNDRAKFYRRMHDIPESWGTAVNIQSMVFGNMGETSATGVAFTRNPSNGDNRLYGEFLINAQGEDVVAGIRTPQSLTKAAREEMGDTAPSMEEAMPEVFGQFKTVVETLERHYRDMQDIEFTVEQGKLYMLQTRNGKRTAKAALKIAVDMAAEGVISTSEAVGRVEPASLDQLLHPTIDPSAHRDVIAKGLPASPGAATGKIVFNSDAAEKAAANGESVILVREETSPEDIHGMHAARGIITARGGMTSHAAVVARGMGRPCVSGAGDVAIFEKEGLFRVRGRDFRAGEIITIDGSTGDILAGAPKMIEPELTGDFATLMGWADQVRRLKVRANAETPLDAKTARQFGAEGIGLCRTEHMFFDDTRIAAVREMILADDEKGRRAALAKIAPFQKADFVELFTIMEGLPVTIRLLDPPLHEFLPHTEEDVQAVAVATGLDAAKLMRRAKELHETNPMLGHRGCRLGVSYPEIYEMQVRAILEAACEVKKAGKQPPAPEIMHPLVAKGEEMKYLRDLTDRVAKAVLEEQGVALEYTVGTMIELPRAALRAGDLAANAEFFSFGTNDLTQTTFGISRDDAGKFLNAYIEKGIFEKDPFVSLDQDGVGDLIRIAAERGRAVRPNVKLGICGEHGGDPASIGFCEKVGLDYVSCSPYRVPIARLAAAQAAMANKVE

SEQ ID NO: 11370 - protein, 255 aa, Caulobacter crescentus CB15
MANPFSLEGKVALITGANTGIGQGIAIALAAAGADIAAAGRSAPTETQAAVEALGRKFLSIKADFSSIEPVQRVVDETVAAFGKVDILVNNAGIIRRADSIEFSEADWDAVMDTNLKVVFFLTQAFAKQALKQGFEGGQAKVINIASLLSFQGGIRVPSYTASKSGLAGLTKILANEWATKGINVNAIAPGYFDTNNTEALRADQDRNAAILARIPAGRWGRPEDIGGAAVFLASSASDYVQGITLPVDGGWLAR

SEQ ID NO: 11371 - protein, 487 aa, Caulobacter crescentus CB15
MEIREGLTFDDVLLEPAASDVMPTQVTTETRFTREISLNIPLVSAAMDTVTESRLAIAMAQAGGMGVLHRNLSNEEQADQVREVKRYESGMVINPLTIHPDTTLAEIREIKARRKISGFPVVERGSGKLVGILTNRDMRFEGDDKVPASQLMTRDNLITVSEGVDHREARELLRRHKIERLIVVDEAYRAVGLITVKDIEKAQAHPLAAKDDKGRLLVGAASTVGDAGFERSMALVDAGVDVVVIDTAHGHSSQVAAAVTRLKREANRVQIVAGNIATYDAARALIDAGADAVKVGIGPGSICTTRIVAGVGVPQLTAIMEAVRAAKESNTPVIADGGIKYSGDLAKAIAAGASTAMMGSMFAGTEEAPGEVFLYQGRSYKSYRGMGSVGAMARGSADRYFQKEVTDNFKLVPEGIEGQTPFKGPISPVLHQLVGGLRAAMGYLGAPTIPELQKRARFVRITGAGLRESHVHDVMITREAPNYPSAV

SEQ ID NO: 11372 - protein, 246 aa, Caulobacter crescentus CB15
MFDLTGKTALVTGATGGIGGAIARALHAQGAHVVLSGTRESALAELKAELGERASTVVANLSDAEQVDGLVAKAEEAAGAPLDIVIANAGVTRDGLIVRMKDEDWDTVIKVNLEGYFRLSRAAAKGMMKRRAGRIIGITSIVGVTGNPGQTNYAASKAGMIGFSKALAQELASRGVTVNCVAPGFIASPMTDALNEQQKAGILSTIPAGKLGEGADIAAACVYLASDQAGYVTGQTLHVNGGMAMI

SEQ ID NO: 11373 - protein, 560 aa, Caulobacter crescentus CB15
MGTVLRTFWTNLAEDYRPAALSRRKQVPLRLFVIVTLCVAALILKNMPFLFGWSVAYLVVQICELYALKRFINAADPTDRVWVNLVSDVALATVFGWLALPLWEMGTPAGAAGAMLLLSASIFTALMGAEGCMVAFISGAGPHVAYLFITPLLAGGGGDPVLPYFLIGGGLFTLTIAMTFLWSHRAMKAEREARRAAEAQVAARSALIAMVSHELRTPINAIVNGAGRLDAGSAGLIADAGRMMRTLLNDLLDLSKIEAGRMGVEMVDHDLRAQVSDAVDFWRGAAEAKGVTLTLTGAERLPRWVRGDPMRLRQVLNNLISNAVKFTTEGGITVDVRPVASGAAAVEIEVRDTGPGLTEAQIIRLFDPYEQLGSETARNFGGTGLGLAISRDLARLMGGELAASSAPEGGARFVLRLPTPAGAEPTIQALAEEQDLVLAPRLDAPRILVVDDHDINRRTLRGILEAFGAVVDVAEDALSALAVCEDQRFDAIVMDVRMPGMDGLEATRRLRAAGLNRQTPVVAVTGAVSDDEVAACRDAGMTACVAKPVSARELYAALFA

SEQ ID NO: 11374 - protein, 426 aa, Caulobacter crescentus CB15 [sequence omitted]

SEQ ID NO: 11375 - protein, 450 aa, Caulobacter crescentus CB15
MTDILMPALSPTMEEGTLAKWLVKEGDTIKAGDVIAEIETDKATMEVEAVDEGVIEAILVPAGSENVKVNTLIARLKGDGEAAAPAVAAPVAEAATVVVAAPAAGGPISAASTFADPEIPTGTALKKITVRDALRDAMAEEMRRDDRVFLMGEEVAQYQGAYKVSRELLQEFGDRRVIDTPITEHGFAGMGVGAAMAGLKPIVEFMTWNFAMQAIDHIINSAAKTLYMSGGQIKSSIVFRGPNGAASRVGAQHSQDYAAWYGNVPGLKVIAPYDAADAKGLLKAAIRDPNPVVFLEHEMMYGHEFDIPDVEDWVVPIGKAKVRRQGSDVTLVAYSRMVGFALKAAEELEKEGIAAEVVDLRTIRPMDHATILESVKKTNRLVTVEEGWGPMGVGAEIVARITEFGFDYLDAPPLRVCQEDVPLPYAANLEALSLPSVEKIVKAAKAVCYK

SEQ ID NO: 11376 - protein, 252 aa, Caulobacter crescentus CB15
MAGRLEGRVAAVTGASRGLGRATAALLAAEGAMVALLDLKAHWAQAAADEIIAAGGKAVGLGCDVSDREALTATLGAVNDAHGRFDVLVNNAMWNVYEPLAAIRPESLDRMVSVGFSGVIWGMQAAAPLMAASGGGSIVNIASVSAQLGIPNGIAYCGVKAGVAGMTRAAAAELGAMNIRVNAVAPSTVDTEGVRRVVSEERIAMRIGQTPLGRLGTTEDIAKAVRYLACDDSDFVTGQMLTVDGGLATALS

SEQ ID NO: 11377 - protein, 521 aa, Caulobacter crescentus CB15
MTSKAQSRVVLVTGGADGIGWAACQRFARAGDQVLVADRNVERARERADSLGPDHHAIAMDVSSEAQIREGFEQLHREFGRLDVLVNNAGVTDPQPTATLDQTAEEVARLQAINVTGAFLAAREAGRLMIEQGHGAIINLASGAGLVALAKRTSYSASKAAVISLTRTLACEWAAKGVRVNAVLPGYTRTQMVQDQIDAGLLDPSIVLSRIPLGRMGEPEEMAEGAFFLASDAASYVVGATLVVDGGYTVYGGSGPASTTPAPSPLAPSPRVSAITGGGRGIGRCVVDLFHAAGDRLLVIERDAEGAKALAEALGDEHIVVQADITDVAAVEAAFAQAQARWGRLDVLINNAGAADVFKPSLEQTAQDFTSVYDLNFSGPLATAKAAARLMSQGGVIVNLGSIAGLGALPQRNAYCAAKAAVTMMSRSLACEWASAGIRVNTVAPGYIETPAVLALKSAGRAQFDKIRRRAPIGRLGDPMEVARTIAFLASPAASYVAGATLTVDGGWTAFGDAGDASDIL

SEQ ID NO: 11378 - protein, 399 aa, Caulobacter crescentus CB15
MGALTSPRKVVVLGSTGSIGLSTLSLFEESGAPVQILALTAGRNVERLIEQARRWKPSLAVIEDESRLDDLRAGLAGTGVEAAAGADAVRDAAAMGADWVMSAIVGAAGLAPTVAAARTGAVIALANKESLVCAGPALLAIAKAAGGSVIPVDSEHSAIFQVLQSECAHRVSRLILTASGGPFRTWDKAAMARATPEQAIAHPNWSMGAKISVDSATMMNKGLEMIEASYLFATPEDRVDVVIHPQSVIHSLVEYVDGSTLAQLGPPDMRAPIACAFAWPDRLPWPAPRLDLAAYGQLTFESPDVERFPAIGIAREALRLGGGAPAAMNAANEVAVAAFLDRRIGFLDIAGAVAGTLERMNSLGDLSVAESDAVETAMLIDGSARRIAAEVVAQKRQRA

SEQ ID NO: 11379 - protein, 112 aa, Caulobacter crescentus CB15
MKKIEAVIKPFKLDEVKEALQDMGVQGMTVLEAKGYGRQKGHTELYRGAEYVVDFLPKIKVEVVVEDSQLEPALEAITRAARTGRIGDGKIFVSEIAEVIRIRTGENGPAAV

SEQ ID NO: 11380 - protein, 640 aa, Caulobacter crescentus CB15
MSSKTPLLDTIASPADTRGLSLAELKQLAAEVRAETIDAVSVTGGHLGAGLGVVELTVALHHVFETPKDIVIWDVGHQAYPHKILTGRRDRIRTLRQGGGLSGFTKRAESEYDPFGAAHAATSISAALGFCAARDAKGEDNSVIAVIGDGSLGAGMAYEAMNAATDTTKRLIVILNDNDMSIAPPVGGMSAYLANLVSGGAYRSVRKLGKTVVEKLPTPMREAARKAEEYARGMVTGGTFFEELGFYYIGPIDGHDMDALVSVLKNAKAFGDKPVLVHCVTQKGKGYAPAEGAADKLHAVVKFDVVTGQQQKAAGGPPSYTKVFAQELIKQAEKDDKIVAITAAMPSGTGLDLFGKAFPERTFDVGIAEQHAVTFAAGMAADGMKPFAAIYSTFLQRGYDQVVHDVAIQGLPVRFAMDRAGLVGADGPTHAGSFDIGFMGALPGMVLMAAADEVELARMVATAAEIDDRPSAFRYPRGEGLGLDMPAIAEPLEIGKGRIVREGTSVAIVSFGTRLSESLKAADLLAARGLSATVCDARFAKPLDLDLLLRLAREHEAIITVEEGSMGGFGAFVLQALAQHGALDRGLKIRTLCLPDVFQDQDKPDAMYAQAGLDAEGILRGALSAMGMDNVSAAGAGRRA

SEQ ID NO: 11381 - protein, 207 aa, Caulobacter crescentus CB15
MKLYDCLRAPNPRRVRWFMAEKGIDDVEIVTLSIMGGEHRSPEYRGKAGLAHVPALELDDGTVITESVAICRYLESVYPEPNMFGRDPKETAIIEMWLRRTEMMVATPIMQGVRHSHPGMAALEAQVPEVAAYNLESVRKSLKVLDDRLAESPFIATDRVTIVDVIAVTSLDFGRMIKWRPDPERVHVNRWLDAMLARPAAAAGMTA

SEQ ID NO: 11382 - protein, 366 aa, Caulobacter crescentus CB15
MTATLDDARAALDRIADPASGQGLVKAGLVQGLVVRNGRAGFMLEVPASVVASYAPVREAAEKALAALPGVEQAQVVLTAQAAEGATRVRKGAKISEDPQARMVPPPEAEKPQHVRHVIAVASGKGGVGKSTVSTNLAVAFAKMGLRVGLLDADIYGPSAPKMMGVDGDPLFENEKLQPLEAHGVKLMSIGFIVDEGKAMIWRGPMASSAVRQMIHDVAWGSEAQPLDVLVVDLPPGTGDVQLTLVQKLRIDGAVLVTTPQEIALIDARRAAAMFEKTATPILGLIENMAFFADPSTGAPIPIFGEGGGVAEAARLNVPLLGRVPIEIAVRLGGDQGVPAVIGEPKGQAAEVFIGAAKVLWKSVSH

SEQ ID NO: 11383 - protein, 221 aa, Caulobacter crescentus CB15
MSFPRRVEGVVFDMDGLLLDTEIVYRAAMIEAGQVFGIGFTGEIYAAMVGKTTPECGVMLRELFGETFPVQSYFERVWADVEDLLEAETRLKAGVIEILDFLDDQGLPRGIATSNGKPAVERYLGRFDLLPRFHAVVAHHDVVRHKPHPDPYLEAARRIGVDPAACLALEDSHPGVRAAHAAGMMTVMVPDILDPNEEMHDKCVHIADSLHHVLDLLKASA

SEQ ID NO: 11384 - protein, 358 aa, Caulobacter crescentus CB15
MTDLSIRANRVAALKAAAKERILILDGSWGVMFQKKGLTEADYRAERFAAYNGQMKGNNDILCLTRPDLVAELHDAYFSAGADISETNTFSGTTIAQADYHLGEQDVWDINLEGAKIGRSVADRWNAQNPDRPKFIAGSMGPLNVMLSMSSDVNDPGARKVTFDQVYEAYRQQVDALYQGGVDLFLIETITDTLNCKAAIKAILDWRDEGHEELPIWISGTITDRSGRTLSGQTAEAFWNSVKHAKPFAVGFNCALGADLMRPHIAEMARIADTLVAAYPNAGLPNAMGQYDEEPHETGHALHEWAKDGLVNILGGCCGTTPDHIRHVADEVRGVTPRQIPERPKAMRLAGLEPFELA

SEQ ID NO: 11385 - protein, 421 aa, Caulobacter crescentus CB15
MNHFEYGPQGLACEGVPLAKIAAEVGTPVYVYSRATLERHFVVFRDALAMSGVVDPLIAYAVKANSNVAVLKVLGDLGAGADTVSEGEVRRALAAGIPGERIVFSGVGKARREIAFALQAGVAEINVESEPELNLIAEVAAELGVRAKVAFRVNPDVAAGGHAKIATGKSENKFGVSFAEAARLYANASNNANLQPVGVACHIGSQITDLAPMRAAFTKMRGLVEQLLAEGLSVERLDLGGGLGVPYFNHPEPPSPAEFAAMVGEVTQGLPVTLAFEPGRVIAANAGVLVSEVIHVHERPEGRKFLVIDAAMNDLVRPAMYDAFHDIRPVIQRTGETVYDVVGPVCETGDTFTRDRALPPFAAGDLVAFMSAGAYGAAMASEYNTRPLVPEVLVDGDRYAVIRQRPTYDEMLARDLVPDWV

SEQ ID NO: 11386 - protein, 541 aa, Caulobacter crescentus CB15
MHFTLRVASARAQMPPAKRDEKFCEPAGSTGGRSGGGSMARQRLSFLQIWNMCFGFFGIQIGFGLQNANTSRIFQSLGVDVNHLAILWIAAPATGLLVQPIIGHFSDKTWGRFGRRRPYFFWGAILTTLALLVMPNSPTLWVAAAALWIMDASINITMEPFRAFVGDNLPDEQRATGYAMQSFFIGLGAVFASALPWMLTNWFDVANTAPAGQVPDSVRIAFYTGGAGLLLAVLWTVFTTREYSPEQLTAFEKAEREIAGLGLHEEPEPSVNAYIALGVGGVLLGAALALIVWGAGLEKELYVLAGLLFAFGLAGVAGARFKRIGRTDNGFSEVLADVFRMPKTMRQLAVVQFFSWFGLFAMWIYTTPAVATVHFGAVDASSKAYNEGADWVGVLFAVYNGVAALAALVIPLMVKVTSRRVSHAVCLGLGALGLLSFLVIRDPGLLWIGMVGVGFAWSSILSTPYSILAGALPARKMGVYMGIFNVFIVVPQLLAATLLGLMLKTFFGNQSIFALVLGALSFALAAAATFLVRDRVAGAPA

SEQ ID NO: 11387 - protein, 597 aa, Caulobacter crescentus CB15
MLAERRPAVTPTDGAQVLKALDAQAALLPYALGVFAVSLPLFVWVGSFAANPLWMTASFAIFAINWGVFYAAVSWIRDEPSQDLARRARVQVLCGVLWALAVMQISAFAHNAGPARETLLLLATAGAVLCAFFAAPYLPGLLIIAPLAAAGPLLAQFSSADSRHAGELTFGATALAMTLALILNRMFRRQHDLAISHEQLVVERLRVLEAAERTARSKSDIVATLSHEIRNGLTGVTHVLAAAAGRGGRAAPSREQLNAALDAAQDLIAVLNATLDSETAESGRLQVDARPFDPVRLVQDLALLDKPHAAAKGLELSVHVDPLLRERAKGAAIADALRTRQIVSNLLGNAVKYTVRGRVEVRLELRDDRIAIEVADTGPGLSTEELEQAFEPFRRVERTGAGVNGAGLGLSLSRQLARLMGGALEARSAVGVGSCFTLTLPFDLGAKDEQAEALDTAVAEASGAPRALRVLIAEDDALNAAMLRAVLEQLGHQVVHAANGRRAADLAKIAEFDLLMLDHRMPVMDGPEAASSLRQGDGPNRQTPIVAVIDGDAEEAAEFLEAGAEIVLRKPVSVAGVARALADAAALERTDPAKVAA

SEQ ID NO: 11388 - protein, 353 aa, Caulobacter crescentus CB15
MAKAAPWPLDAWYVACTPDEIADRPLGRRICGKAMVFHRGKDDRPVALEDFCPHRGAPLSLGFVRDGELVCGYHGLTMGCEGRATAMPGQRVAAFPAIRAFPVLERYGFIWVWPGDPAQADPAKLHPLFWADSPDWAYGGGLYHIACDYRLMVDNLMDLTHETYVHATSIGQKEIDEAPVTTRLEGEEVVTSRFMEGIHAPPFWRMALRGAGLPENALVDRWQICRFSLPSHVMIEVGVALAGHGGYHAPADKKVSSVVVDFITPETETSHHYFWGMARSFAVGDAALTDTIREGQGKIFSEDLEMLERQQKNLLAYPDRKLLKLNIDAGGVRSRMAIDKAIAAETALAAQAK

SEQ ID NO: 11389 - protein, 366 aa, Caulobacter crescentus CB15
MQVTAAVTRSPSGPFSLEALDIEPPRAGEILVRVVATGVCHTDMVMRDQHLPTPQPVVLGHEGAGVVEQVGPGVAKVAVGDHVVMTFNSCGRCPSCSDHAPTYCHEFFPRNFMGAREDGSSGLSKGSEVIHANIFGQSSFATYALCHERNAVKVDKTAPLERLGPLGCGVMTGAGAVMNALKVPAGRSLVVFGAGAVGLSAVLAAKAIGAGPIIAIDINPERLALALELGADHALNGAEGGVVEKIQAITGTGAHFSIDTTANLKVMRQAVDCLGARGVCGLVGASKMGDELPLDAVSVMSGGKVVRGVVEGDADPDVFIPELIALHLAGRFPFDRLIQFYPLAEINQAVSDGETGRVIKPVVRMS

SEQ ID NO: 11390 - protein, 487 aa, Caulobacter crescentus CB15
MSEPLLSADAWTDRLFSDGWVKPSGGVIAVQEPATETVLTQVGRADRSDVARAAASAKAAQPAWAALTADARQAILLRAADLLVEHAPDLAPWIMRESGSVAAKAAVELEHAAGFVRQAGAMATEAAGLVLPSSPGKTSIARRVPLGVVAVISPFNFPLVLSIRAVAPALATGNAVVLKPDPRTPISGGFLIARVFEAAGLPAGLLHVLPGDAEAGDALCRDPNIAMVAFTGSTGAGRKVGEVAGAHLKKVALELGGKNPLIILDDADPDVAASNAAWGAWLHQGQVCMTAGRLLVQRGIHDAVVERLAAKAGHLPVGDPMRGDVALGPLISRGQLDRVHAIVSDTVADGARLVAGGTHKGLCYAPTVLTGVAPGMRAFEEEIFGPIAAVTVFDDLDEAARLANDGPYGLSAGIISGSVGRAMTLGAKLEVGHLHINDQTVDAGPHSPFGGMKASGNGTRISGPANLDEFTTWRWETVKAAATAYPF

SEQ ID NO: 11391 - protein, 470 aa, Caulobacter crescentus CB15
MSSPQAVFERRDPVTGAVATTSIAMTADQARVAVDAAQAALPTWSALGPNARRALLSKAAAALEARADDFVAAMMGEIGATEGWARFNLMLAASMVREAAALTTQVSGEVIPSDKPGCLAMAVREPVGVILGIAPWNAPIILGVRAVATPLACGNTVVLKASESCPRTHELIAEAFAAAGLPEGALSIVTNAPADAAEVVGALIDHPAVRRINFTGSTAVGKIIAKRAAEHLKPVLLELGGKAPLIVLEDADLDEAVKAAAFGAFMNQGQICMSTERIIVVDAIADAFVAKFAAKASSLAVGDPREGKTPLGAVVDLKTVTHVQGLVADALADGAVQVSGGPANGVLMPATVVDKVTPAMRLFREESFGPVVAVIRARDEEHAIALANDTEYGLSASVFTRDIARGLKVARRIQSGICHVNGPTVHDEAQMPFGGVKASGYGRFGGKAGVDAFTELRWITVETQPGHFPI

SEQ ID NO: 11392 - protein, 842 aa, Caulobacter crescentus CB15
MGRHGGPAAAGPTAPSAVRAKAVNAPSQVFVRIAILAALLLLAVYTAFGVHRLQREAMAQPGGAPLAAKADLIAGRVDANLAAQRAGLSAAADLLKRDPGATMDAAETTLRAAGGEAAAVAVVSEAGVVAVAGRDDGADWKAAALAAGASGRTNWVGSVGETGRLYVATTTSLDRARAFVIASGDASRLVADPEKGESGALALPDGKLIAARGRGVQGAGALREAFALSIEDLGDGPAAVRGQAADGALLDVAVRPVAQGALLAVAAAPTRSVANLDRQVMEGAFSLLVPLGVGIALALLLMIQSRKAEVAHREFIDSERRFRLAVEAARCGIWEWDLNGDQVYLSDVTGAMFGWGGGGVVSGQDLLERISIDHRERVRQALANAAMYGAFDVSFRVPASEQGARSLWIDARGQGFGKPGSEGHARIIGVALDVTEERIAQARAQAAENRLRDAIESVSEAFVLWDRQGRLLMCNRNYRSVFSLEPKILKPGAARAEVNRFAALAIKQDHPAPDGAKGVREAEMMDGRWIQISERRTAEGGLVMTAADITAIKTQEEARRRNEEQLQNAVAGLERSQEQLAELARKYETEKVKAESANKAKSEFLANMSHELRTPLNAINGFSEIMMNEMFGPLGDQRYKGYSQDIHSSGQHLLALINDILDMSKIEAGKMNLKFESMHLEDVAEDAVRLVRNRAEAAGLKLDIDFPQLPEIEADYRAVKQVLLNLLSNAIKFTPRAGSVTVRAEVRRDPFGDLIKVSVTDTGIGIAKEDLARLAKPFEQVESQFSKTTQGTGLGLALTKSLITMHDGVLEMHSTPGEGTTVSFTLPVRHSDQKITRDFVAA

SEQ ID NO: 11393 - protein, 637 aa, Caulobacter crescentus CB15
MAATDCLRSGWGGHLSLLLGRHRDSDDLRSPAINPAAIRVRILRAVPAVCLIVGVAMAMDYIVTILLLNEPAAYVPIATLVISTIIAVPLAYWLAGQRLRLETMHAELKASLDAKQDAIEDAEVALAKYREVDRLYRLLGDNLTDHVALWSPLGERLYSSPSIERITGYTLEEFMALPPAALVGEADFRRVQGIIRSLEPGGEPVSADYESLCKDGSRIWVESTYSLLGDGSGILLVTSRDITERKRLELDIAKALQMAEAASAAKSDFLANMTHELRTPLTAIIGFAEVLRRSRNLNKTAARQVGHILDASNTLLSVVNDVLDFSRLEAGGLELDPAPFDPAAMASSCAGLVAERAEAKGLAVEVRAPRGLKPMNLDGPRLSQVLLNFLSNAVKFTSHGAITVALRQTIDGDQAVLRGEVTDTGIGIAPEHRENIFDRFSQADAAVSRRFGGTGLGLAISRRIIERMDGRIGVDSVEGQGSTFWFEVRGPLADLPTQEAVETSPLDADAGVRLLLVEDNAVNRELICAILEPFGVAIETANDGVAGVEAMRQGHYDLVLMDVQMPMMDGLTATREIRAMEGARGASTPIIAMTANVLPEQVANCMAAGMDDHLGKPISPAKLLEAVARWSGRSHAA

SEQ ID NO: 11394 - protein, 369 aa, Caulobacter crescentus CB15
MKTRAAVAFEAKKPLEIVEVDLEGPKAGEVMVEIKATGVCHTDAYTLDGFDSEGIFPSILGHEGAGVVVEVGAGVTSVAVGDHVIPLYTPECRQCKSCLSGKTNLCTAIRATQGKGLMPDGTSRFSYKGQPIYHYMGCSTFSNYTVLPEIAVAKIRRDAPFKTACYCGCGVTTGVGAVTNTAKVEPGANAIVFGLGGIGLNVIQGLKLVGANMIVGVDINPDREEWGRKFGMTHFVNPKDVQGDLVAHLVALTDGGADYTFDATGNTGVMRTALEACHRGWGESIIIGVAEAGKEISTRPFQLVTGRVWKGTAFGGARGRTDTPKIVDWYMDGKIQIDPMITHVLPLEEINKAFDLMHAGESIRTVVTF

SEQ ID NO: 11395 - protein, 839 aa, Caulobacter crescentus CB15
MVERSGAGQGAGLDKGSGAIAGVTAPLARRLLTTVAILSIAVTSVATAAAFIFVRESAADTQTRHLAEYVGERVKTEDRLFSDLVKVHDAASESLTRRLDHTANEPMGAEFQRLYPEKGDGTRRSEPKLYDGVRTGGHYTHGLGAYLRDAATISPPEQALFVAAADVVATTGEAQIRHYDNFYFFTPQTRLVMFGPLRQDRLQYYRRDAPNTLDISKEEMTTLTLPENNPERVMKCTKLRRLISDPSGRGLNAACMTPFYYKGQFMGAFGTSLSLDSYLLRAVADALPGGSNMIVADDGEVVAAQGLQRNGFVDADLLRRFEAENELKNLIARIRAEKRDVGAVLSPDGDRLVAYGRLVEPGWWFLMSFPSSDIVWSSLKTASWVLLFGFFGVLLQVLLLYRLTHQMVAAPLEALADAQQQGDPAAARPFEARPDEIGSLARALRRQRERNEELLRSLEQRVAVRTAELERANQAKSVFLANMSHELRTPLNGVIAIGDRLAEEEDPQARRELASLVTSSGRLLEQVLGDILDVSKIEAGQFQLSPAPFDLVQLVRSMAELHAAAAKAKQLSLRWSVSPDAEGSYDGDAGRISQILSNLLANAVKFTAKGEVSLEVDRQGEALRFVVRDTGVGFDDAVRDRLFKRFVQADQSITRQFGGTGLGLSICAALAEMMQGSISADAVPGQGARFEVVLPLPRCAEVADVAVEEDREISLEGMRVLVAEDHPTNRKVVEIVLEPFGVDLTMVEDGQAALDALEQGRFDAVLMDMQMPVMDGLSATRAIRAREKASGAWPILVVMLTANAMEEHVAAARSAGADLHLAKPLHPAQLLEALARAHR

SEQ ID NO: 11396 - protein, 189 aa, Caulobacter crescentus CB15
MRIFLAEKGVEVPEIRIGMMQGGHRSPEHLARNSLGQVPVLELDDGTTISETIAICRYFEVLHPDPPLFGVSALEQAQIEMWTRRMEFRLMVPIGMFWRHAHPLTARLLKQNVEFGESNREVVEKGQLWLDRELSDGRPYLTGDTYTIADIAGQTALDFADFTSLSTPAEAKHVLAWRERMAARPSASA

SEQ ID NO: 11397 - protein, 693 aa, Caulobacter crescentus CB15
MAQRIASHEERRQTALLLALSFAVAAAIVFSENLTRTTLGVAAFWPANAFLAAGLLTLTSVRRLVLIAVFVFFHVAVCLQAGDGPLKALVFATVDGLEAGAVWAAFRRFWNGAPRVRTLRALAQLPAITTPIAAGSALICATVLHFGYGAPFAESLVDWLLRSALGLAVALPATLVLIDAEHRRSFQRPWSEKLLLMFSVVTVALLCAHPAAGAPPVLMFPVTLAAAYRLGARGAALAAFLTIGIIMPMVISVGSSSFNSTQDTVIQARTIQVFMGVLFYTCLAAGLAFGQQNRLKRLLLRREQLTRAARGRALAATEAKTEFLATMSHEIRTPLNSVLGFAQLLAAREDLPPDARRQVNLIDSAGAALLTVVDDILDFSRVEAGQIELLPGPTSAAALLRDTVAIMAPEARAKGLSMDVEIIDPIGVLHDLDADRLRQVLINLLNNAVKFTEEGRIDARLIIEPGDIEDRLRFEVLDTGVGIELDKQGLLFQRFSQTDSSPSRLHGGPGLGLAIAKALIDVMGGKIGVDSVPGRGSCFWVELSAPVAEPAPAPEPAKPPAPGAARILIVDDHPINLEIGAALLTLVGYEVDLAENGKQAVEKAEAGAYDLILMDIHMPLMDGLQATRAIKALRTSTGKAPIIAMSADALPRQVERCYAAGMVDHVAKPIQREVLYAKIERWLHPLRDGDKPA

SEQ ID NO: 11398 - protein, 666 aa, Caulobacter crescentus CB15
MLMADTTAPRTELTLRGVLLGILITLVFTAAQVYLGLKVGLTFATAIPAAVISMALLRAFKTSTIQENNIVQTIASAAGTLSAVIFVLPGLLMIGWWANVPFLPTFGACAVGGILGVMYTIPLRRALVTNSNLPYPEGVAAAEVLKVGAGSREGAAEGKAGLAAIGFSALASALFGALGAAKLFAAEIAAYFKFKLGAASGATGIGASSSLALMGAGHLMGITVGVAMFTGLFIAWAILVPILTLVTPMPEADAATHALTVWKSQVRFLGAGVIGAAAIWTLAKLVGPITSGLKSAFAAAQARKAGGAKLPRVEQDIPIGIVGLVSVLLLAPAGWFLAHFLTGGPIASLTTPLVAIGIGYLVFAGLLAAAVCGYMAGLIGSSNSPVSGIAILSVLGASLMVGMVGRGVIGPDVTKALIAFALYVTTCVLAVAVVANDNLQDLKTGQLVDATPWKQQVGLIIGVLAGSMVIPFVLELLNRSYGFAGAPNLQAISDEPLAAPQATLISTLAKGVLGGNLDWGLLGYGALIGLGLVAVDAILRKTSHERLSLPPLGVGLAIYLPSSVTAPVVVGALAGWLYEKVVSKDRAAEPSRRLGVLIASGFIVGESLFNVSLALLIVSTGKGDPLALPFAPSEHVGMFLSLAAAAIVVVGFYRWARKAGAKAMEA

SEQ ID NO: 11399 - protein, 279 aa, Caulobacter crescentus CB15
MPKHLEVVTSDTETPVWVALRNQAEHAAKAEPALASLLNAVILSHDNLADALTFQLARKLGDQEMRAMTAREFAADAFEDDLSIVEAAEADLKAVFERDPACKGYVQPFLFFKGFLALQTHRVSHWLWNQGRETLAFYLQSRSSEVFQVDINPAAKIGKGVFIDHGTGIVIGETAVVGDDVSMLHGVTLGGTGAERGDRHPKIGKGVLLGAGAKVLGNITVGDYAKVASGSVVLRPVPAHCTAAGVPARLVNCPTCEEPAKTMDHTLAEAVYSTSSYEI

SEQ ID NO: 11400 - protein, 267 aa, Caulobacter crescentus CB15
MLGRDFEGFTVVVTGGSTGLGRAIAVETARRGAGLVVINFARSAEEAEETARLVQAEGAKAVLAQGDVSSDEDCRRIAAAADASGRIDALFNNAGMTKFAPNHADLDAVNAEDFLRLYSVNVVGAFQMVRAARTLLEAAPSPGAVVNTSSIAGVVGNGSSVPYAASKGAMTTMTLSLARALAPRIRVNAVCPGFIDTPWFEKAMDAERIDRLRAGAAAATPLKVASTAEDIAGAAVFLASPASRHVTGETLLVDGGLHLGGASLSMR

SEQ ID NO: 11401 - protein, 690 aa, Caulobacter crescentus CB15
MRRTTAHRAFRRTMNLIAGGKPLASALKAIVQAVEAEDPTILCGILLLDADRRRLLMGAAPSLPTFYNQAIEGVEIGPSVGSCGTAAYLGRRVMVDDIQSSPLWVGYQELAAQAGLAACWSEPIKTSDGAVAGTFAIYHREVSKPNKEDIAFIEAAAQLAAFAIDRRRAEEELAASEARARLLAEQALETSRNLSNFFDVSADLLSISNMQGRFVKVNRAWETALGYPIEALEGVPFLPLLHPEDQQSTRVQINRIEVDDEVNGFVNRYRRADGSYCQLEWRARRCDDLVFGVARDVTERLRIQAEMAEARDAAEAANRAKNDFLANMSHEIRTPLNGVIALAAALDETPLTSKQAEMVAMIRRSGETLERLVSDILDVSKIEAGQMTLQPQAFDLGALVDGLLDVTRLRAKEKGVAVRLERSPTAAGGFLGDSVRIGQVLSNLFSNAVKFTDQGEVIVRVDVEEAGNGQAARLFVEVEDTGVGFDAEKAEMIFQRFNQADSTITRRFGGSGLGLSISKTLVEMMGGEITAQSSPGAGSLFRVTLPLSRTQMGPDAEIDAPRSAAPGEGLKVLLAEDHPINQRVVQLILEPCGAAVTVVENGAQAVEAMASGAFDVVLMDMQMPVMDGLAATRAIRAREGEGQRTPIIMLSANAMDVHRREALQAGADLHVPKPITIAALLDSIGQVMAR

SEQ ID NO: 11402 - protein, 653 aa, Caulobacter crescentus CB15
MNAATLVDTHAVDTALQEAFEAAPEGFALFDAEDRCVIWNARYGELWSKWGVTLAVGATFESLLLAGLAAGRFPEANGDRAAWLAHQLGRRKLDRIEEIREEFGEYLRFESRRTPAGGLITTCANLTNLRRREAQALAARSFLDTIVENTPAMLFVKDGDTGAFLLVNRAAENQLGVPRAELLGKSDYDFFPKEQADAFAADDRRVIASGKLVTIDEEPLDTPHNGRRWLQTRKIAIPGEDGRRHLLVICEDITERKAGAAALAEALQKAEAGSVAKSEFLANMSHEIRTPLNGVIGMAEVLSRTALDDAQREMMEVILNSGRALNLLLSDILDLSKIEAGGLELSRDPLDLREAITAAVAVFKAVAESKGLVFRLTFADDFHDHVLGDALRVRQIVANLTSNAVKFTTAGSVIIEARTLVAEDGRIDLTVSVQDTGEGFDEDSADRLFERFQQADGSVTRKVGGTGLGLPIARRLARLMDGEISCVAHPGEGATFVFEALFLADGQRTPAASADPAGELALDRRLRVLLAEDHPTNQKVIGLMLADAADVTVAEDGQAAVEAFEKHAYDVVLMDTQMPVMDGLAAIAEIRRREREAQARRTPIISLTANAMPHQVRACLEAGADLHLAKPVSIQGLFATLGAALETRPGGEG

SEQ ID NO: 11403 - protein, 713 aa, Caulobacter crescentus CB15
MARYQGVAGDLGAAIKIMAVPELDQEAARIRALLDLGILDTPPEQEFDDIVQAARDACQAPIAVLSLIDSDRQWFKARVGIEACETERDASFCAHAVAASKTLSIPDARLDARFKDNRLVNGPEQIRSYLGAPIMTREGVAIGAVAVIDQRPRDWSSGDTQALERLARIAARLIEMRARCELADAQGQQLLNLAAEGVQFRTIFAAMREGVVLQDRSSIILRHNPAAAALLGLTHDQLLGKSSVDDDWRIVDAAGAPLPVEAQPSMVCLATGEPVLNFVLGVHLRDGALRWLSVNSLPIFDKIGEPPNLTVTSFIDVTELRERETELRDALELAERASRVKSQFVANVSHEIRTPLNGVIALASALRQSALTDRQREMVEIIVESGTTLESILSALLDLAKIEAERMELEIVSFGLEDLVRSSTDLFKIKADNKGLGFDVSVIAPPGARYRGDAQKIRQILWNLLANAIKFTDAGEIAVSVTVEGADPAAQTLLIEVRDTGVGLSPEMEHVLFEPFIQGDASATRRFGGTGLGLTICRALARMMGGDIEALARAERGSVFRVHVPVSTAEPEASVAVESEADLATAMTILLVEDNPNNRRVVELLLEPTGAELVMAENGAEALTILATQRFDLILMDMQMPVMDGLTATREVRCLEAREGEGRTPTPIVMMTANASREHRDAAFAAGADGFITKPVTPATLYAGINTALTAAA

SEQ ID NO: 11404 - protein, 574 aa, Caulobacter crescentus CB15
MARPLLDDSIDLIASTGRQARPARLGMAVLVAGFLGFNVSAAIAIVWFAAAMVAEVYGLGVTRLSRRLNLSPVLRRLGYVTVVIVMVGVWTALTLVLWTSGNPALQWAAICLAAGQLIHAQSVTFRAPVLFAIDVGMPSTSLIVMPILTGGFAPVQIATMMTAVALMLLYTFTSATANNRRIAALEAAEAQALKASEAKSAFLAMISHEIRTPMNGVLAMTDALSRADLGPDQARQTALLKRSGEDLMTLLNDVLDISRIEAGKLEIECQPFDLPELLGDLRALWTPAATDKGLDLVLTIAPGLDAYRLGDPTRLRQILGNLVSNAVKFTRSGGVALSARPGEAPGAVVFDVADTGIGMTPEQQGRLFQSFSQADASIARRFGGSGLGLSICSQLATLMDGAITVDSDLGSGSTFRLTLPLPVTERPAAPAPAEPAADTAETPATPDSLAGLTVLVADDHPVNQAVARAILEAVGARVAVADNGEAALASLKSAPADLVLMDLHMPGLGGRETVRRIRRGEGGDPAVPIIALTGEALGEDPAAWRAEGFDAVQQKPVVARDLLAAAARLTARTA

SEQ ID NO: 11405 - protein, 624 aa, Caulobacter crescentus CB15
MTSAVIPFSPAQVDAASDREARIARLERRLSRELLARREAEAIAEAATHRLYRQGERMRLLADLALEANRSDDLDTVLRAALRAIGSQTGWPVGHVQLVETDAEAMDWLQPTALWLAPPDTDIAALRRATTPRRAQIGGGVLGQVMRLRGACTIESLASCPAERRRAASALGLNQGVGFPILVGDEIAAVVEFFHDHGRGPDAETLAFLDQIGAVLGRAFERRRAERAAQEARARLEESLAAAEAASRAKTHLLAVASHEVRTPLNAVLGLAEVLARSPLDATQREHVDGVRQAGGMLLRLLSSVLDFARIESGATPLVPAPFNLADLAREVTGVWRAAAGAAQLDLHLDLSACPDPCWISADSGKIEQTLTNLVSNAIKFTPAGGKILVRVETTPSASPTFRIVVEDSGAGVPAEDIDRIFDPFQQAALGREVGGAGLGLAICAANLRAMGGDIGYQPAPERGSQFWFSFVAEAVDAQAEPAKVDALTDLPLRILAAEDNPANQRVLRLLLEQVGITPTVVEDGAAAVEAARSTPFDLILMDANMPRMDGPAAVEAIRALGIGKDRTPIVMLTANVFEDDVRRYRAAGADGVLAKPLAVAELYAVLAEVQNRVAGEGLEPFPI

SEQ ID NO: 11406 - protein, 366 aa, Caulobacter crescentus CB15
MKAAVLREVGKPLQIETVAIGKPGPREVLIRTKAAGVCHSDLHFVEGSYTHALPAVLGHESAGIVEAVGSEVRTVKVGDHVITCLNPYCGHCEVCLTGHMNLCISPETRRSKSDAPRLFKEDLNGATGPMAQFLNLSSFAEMMLVHEHACVAIRKDMPFDRAALIGCSVMTGVGAVMHTSNVRPGETVAVIGCGGVGLATINGAAIAGAGRIIAIDRLAGKLELAKTFGATDVVDASQVDDIAKAVVELTGGGVHHSFEAIGLKATAEASFKMLRRGGTANVIGMIPVGTKIELHGVDFLGERRIQGSYMGSNRFPVDMPRLVDFYMSGKLKLDELISRRIKLEDVNSAFDELKRGELARSVIVFD

SEQ ID NO: 11407 - protein, 652 aa, Caulobacter crescentus CB15
MSNNSSAETEAPETTGGDGPLLDLTDAGVKKFIKQAKARGYVTMDELNKVLPSEEVSPDAIEDTLAMLSEMGVNVVEAEEDAENAEGGEVATRDENTTVIASDKPAAYDRTDDPVRMYLREMGSVELLSREGEIAIAKRIEAGRDTMIRGLCESALTFEAIMVWREELGTGRILLREVIDLEGTYAAINGVAAQPAAEDDEGPAEPVDDEAGEAKAEGAEGEDEDDFDDGAGPTVSAMEGELREGVMAILDAIASEFEAFRKLQDKLVGSRLKGEDLSDADRKAYEGLSATIIQHLKTLKLNNNRIEALVEQLYAINKRLIGLEGRLLRLADSYGISRGEFLKAYFGSELNPTWSEQVKAMGVRWTKFVENDSQSVTDIRSEIAALATETGVPIDDYRRIVQTVQKGEREARQAKKEMVEANLRLVISIAKKYTNRGLQFLDLIQEGNIGLMKAVDKFEYRRGYKFSTYATWWIRQAITRSIADQARTIRIPVHMIETINKIVRTSRQMLHEIGREPTPEELAEKLAMPLEKVRKVLKIAKEPISLETPIGDEEDSHLGDFIEDKNAILPIDAAIQSNLRETTTRVLASLTPREERVLRMRFGIGMNTDHTLEEVGQQFSVTRERIRQIEAKALRKLKHPSRSRKLRSFLDS

SEQ ID NO: 11408 - protein, 850 aa, Caulobacter crescentus CB15
MRRVLILFVLVMTFGASGAWAKSDAPLAQRLEQLSQKIGAHEVRKPPRDNDDIERAGRSALREAGQERLYGLWRVLYALKSNQIQGRFDAWAARTREVARRDKDATLEALVDLEVLAYRHESGGFQAFQDKDWDRFLKSSGPDIRLMAGIERVRHLGQIGRWAEAARLAAELTGDLERRGHIAQPLLAELHQVHSYTLSDLGDKEGALDHMAQAAALDERDTFYVRKIERIYDIAFSAADLGELAAAERFATLHHKLTMADGDPGLVTWDRFLCARIAGLREAPERVIQCLAPAAGLLANPDRRLQVRMLGQRALALAQLGQSQAARRDLERLKTIPETLASRDRPLEALVEAYIDQYEGRSADAFRKLDAWRKADGLVSRNAYAKGVAEMSAALESELRVKRDESRRLTEQVRLSRSLARASVVIALLLGVLVAGAAAWAVHQRGASRRLRLAQERAEAASTAKSAFLAVMSHELRTPLNGMLGLAQALRSDQLTPAQREQVDLILDSGDTLLVLLNDILDLSKIEAGKLEIAPTAGDLVQTCARLVGGYQPTAREKGVTLSFQLDGEAPGWLMFDGVRVRQCLSNLVSNALKFTSQGKVEVALACYPEAGDRVRVRLRVADTGIGMNAATVAKLFRPFTQADASTTRNFGGTGLGLNITRRLVEMMRGDIQVESEEGVGSVFTIEMVMDQALAIEAAPSEAGATSESIGAAALQGRRVLVVDDHPVNRRVIRLFLEPFECELVEAENGRHALDVLQHEAVDLVLMDVNMPVMDGLEATRRLRQDPRFARLPVVALTADVMSAQIKTCLDAGCDAHVAKPIDLRNLLSVMDRCLAQSLARDAAARLGAL

SEQ ID NO: 11409 - protein, 254 aa, Caulobacter crescentus CB15
MSLFDLTGKVAIITGSSRGIGKAIAERMAEHGAKVVISSRKAGPCEEVASELNAKHGAGTAIAVPANIASKDELQNLVDETRKAFGKIDICVCNAASNPYYGPLAGIADDQFRKILDNNIISNHWLIGMVAPEMQARKDGSIIIISSIGGLRGNAIIGAYNISKAADFQLARNLAHEFGPDNVRVNCIAPGLIKTDFAKALWDNPETLKRSTTAVPLRRIGEPDEIAGAAVYLASKAGSFMTGQAMVVDGGATI

SEQ ID NO: 11410 - protein, 298 aa, Caulobacter crescentus CB15
MSKMAVNSLSVMSPDGGLSRYLTEIRKFPMLSKDEEFMLAQRWKEHQDPQAAHKMVTSHLRLVAKIAMGYRGYGLPIGEVISEGNVGLMQAVKKFEPEKGFRLATYAMWWIRASIQEYILRSWSLVKMGTTAAQKKLFFNLRKAKSQIAAFQEGDLHPDQVSQIATKLGVLDSEVISMNRRLSGPDASLNAPLRADGESEWQDWLADEEQVSQETRVAEDEEKSLRMSLLEEAMVELTDRERHILTERRLKDDPTTLEELAAQYGVSRERVRQIEVRAFEKLQKTMREAAIAKNMVDA

SEQ ID NO: 11411 - protein, 560 aa, Caulobacter crescentus CB15
MLVVTRRSRAARLIATAMVGGLLFFYLGWTALIVWLVANTICELWVVYLERAYRPHWGQGVIRFMRIGPPSAFAMVWSFMSAYCVLNGPMAMRYAALLILFGIVVEGVRYAMNSLAAMLSLTVWPFLMLAALPLLAKRFDLLDRLAAFAILLGLIGYVADAVRTMRASAKAREEAEAQALEASRAKSAFLAMMSHELRTPMNGVLGLAHALRGTKLDAQQSEYLEMIEQSGHGLMTILNDILDLSKIEAGKLNLEVAPFDLRKLALQTRAVWSESARLKGLDLILEVSPSAPPWVSGDATRVRQILMNLVSNALKFTESGRVVIRLGGEAGGVVTLSVTDTGVGMTAEQIGRLFTPFAQGDASIARRFGGTGLGLSICRQLAELMAGEIIVSSEPGVGSTFTVRLGLPAAAPLVAAPARAAVTQLDGARVLVVDDNLVNQTVARTILEAVGAAVAVAGDGHAALARLRIEDFDVVLMDVHMPGMDGVEAVRRIRAGEAGRTDLPVVALTADAMVGDAERLLAQGFDDAHPKPVQPAGLLATVASLRKAPTELQRLRAVGM

SEQ ID NO: 11412 - protein, 482 aa, Caulobacter crescentus CB15
MTALNLVETAALIDGQWVRGEASFDVLNPADGTLIAAVADLGAAETTLAIDAAHRALPAWAARTAKERGAILRRWSDLILAHADDLARLMTDEQGKPLAEAKGEVVYGASFIDWFAEEAKRAYGHTIPTPMPGKRLASIKQPVGVCAAIAPWNFPIAMITRKVGPALAAGCTVVVKPAAETPLSALAIARLATEAGVPAGVLNIVTTTRSSEVGKVLCDDSRVRKLSFTGSTPIGKVLYQQCAGTMKKLSLELGGNAPFIVFDDADLEAAVDGAIASKYRNAGQTCVCANRLIVQSGIHDAFAARLAEKVAALKVGPGTGEGVQIGPLINEKALTKVVGLVSGAVQAGAEVLTGGDVHGLGGHFYQPTVLVGATPEMRIFQEEIFGPVAPIVKFETEAEAVELANATPFGLAAYFYSRDVGRCWRVAEQIEAGMVGINEGLISTEVAPFGGVKESGLGREGASEGLDEYLETKYLCFGGVAG

SEQ ID NO: 11413 - protein, 496 aa, Caulobacter crescentus CB15
MTLPADMTERLAKLAPPSQAVIDGDLVEAASGATFHNVSPRDGQVLNLVTACQADDVERAVAGARAAFEDGRWRDQGPRQKKAVLFRLAELMERDADELALLESLDVGKPISDARNVDIPLAINTCRWYAEALDKVYGEVGTSPADRLSYAVHEPLGVIGAIVPWNFPLHMAMWKVAPALAMGNSVVLKPAEQSPLTALKLGALALEAGLPPGVLNVIPGLGGVAGEALALSMDVDMIAFTGSGPVGRRLMEYSARSNLKRVSLELGGKSPQIVFADCPDLEAAAQAAAWGVFYNQGEVCTAASRLLVEAPIKDAFLARVIEVAKGMKVGDPLDPSTQFGAMVSERQMNTALDYIATADSQGARRVLGGQRVRQEAGGFYVEPTIFDQVRPDQTLAREEVFGPVLGVMTFSSEDEAMRLANDTVYGLAAGLWTADVSKALRGARRLKAGLVWVNGWDACDITMPFGGFKQSGFGRDRSLHALHKYADLKSVSVTLR

SEQ ID NO: 11414 - protein, 288 aa, Caulobacter crescentus CB15
MIDLVFDARRKDLGNFEVGRVLPFHAHRMVGPFTFLDHMGPAAFQPGFPKSADVRPHPHIGLSTLTYLFEGEITHRDSVGSLAVIKPHEVNWMTAGSGITHSERFEGLREHGGRMDGMQAWVALPTEFEEIDPSFTHHEGPAELPYYENGGLKARLIAGEAFGAKSSVPVYSPLFYVHWELEPGVTAALPAEYPERAAYIAAGRVEVDGRELVEAQMAVFAPGETVVFKALERSTVMLLGGEPVGPRFIEWNFVSSSKDRIEQAKADWKAGRMKLPDLDHGEFIPLPE

SEQ ID NO: 11415 - protein, 642 aa, Caulobacter crescentus CB15
MGKRLDTKAGARIEAAAADWFFQNSLDMFVVLRDSRIIRANPAWSQLTGWAAEDTLGREIRDFFHLHDTEVLTAAGHTLKTVGHAHSENRLARKGGGWLWVRTQSTILEGGGQLIVFQDISEDRAREAARLQAERSNELLRNAAGVYVWRFNPRRGVYAFDQDIPTPSAPEGGARTMTVAEMTQSIHPEDSARVWQAFSRTLQTGEHVEIDYRYLDPGADDWIHLHVAWRGVRGSSPDTYDVIGITQNVTELVAARDAALAAAETKSQFLANMSHEIRTPMNGVLGVLHLLKTEKLSDDGRRLLTEALSCGEMLSALLNDIIDFSKIEAGKLELSAEPVCPAELLRGVADMLRAQAETKGLYLRVEASDDLGWVATDPLRLRQALFNLIGNAVKFTLEGGVVARLSGRRIDSPDGARLRLRFEIDDTGVGIGEEAGARLFERFRQGDGSTTRRFGGSGLGLAICRRLAELMGGEVGFESQLGKGSTFWLEVETQACARPDTQETLADGPLFDGLHVLLVEDNATNRLIATRMLEALGARVTTAEDGAQGVAAARQGFDLILMDIQMPVMDGVEATHRIRAFNSPAGAAPILAMTANAMAHQQASYLAAGMDGAIAKPLSPLALTQAIAAALTLDPSRQRKAS

SEQ ID NO: 11416 - protein, 657 aa, Caulobacter crescentus CB15
MFCRATLLSDGSEALGTFRHTLAKSEVLGAMSENRNHNVSSHAPLQARIAGVALATTVLALVAACLCFMLQQWSVARQEARANHEVLVQMAAAGAAAPLADHNMVGVYRALEAVAKAPGVAGVRIIDAKGRAVAQLGEANPSNADTLQRPIKLSSQTVGTLVLVAKRPGLAQTLARDLALTGALFFGAAGMAILLANSLARRLAQPMERLSEAMHETAVGGRFKALEETADDDVFRSLIASFNHLVARLECNDQDLRGAMAELVKARDDANAANVLKSHFLANMSHEIRTPLNGVLAMADVMAMDQLSDIQRERLAVIRESGAVLLGVLNDVLDLSKIEAGRLEIQDRPFDIAQLAQSIRETFVPQARAKGLAFEVGVAPEAQGLWRGDADRLRQILGNLISNALKFTLDGAVAVRFASAEDGSGLRIDVADTGIGISPEILPRLFDKFVQADSTTTRRFGGSGLGLAICRELAAMMNGSIKVQSREGRGSTFTVLVGLPREETLTDVHYIDDGDPIMAPPAAEPPRLRVLAADDNPTNQKVVAAVLAPLNADVTLVDDGAACVEAWKTGDFDVVLMDIHMPVMDGLEAARSIRATEQAEMRRRTPIIAVTANALTHQIEEYLSVGMDGHVAKPIEVSKLYDAIEAAMAGTRLSRAA

SEQ ID NO: 11417 - protein, 260 aa, Caulobacter crescentus CB15
MAYAPFNLSGKVALVTGGNRGIGLGMAKAMAQAGADIVIWGSNPERNLAAEQTLTALGVRVKAQTVDVSDEAQVREGMEEAVAAMGRVDSVFANAGIGYGSPSFVDMSTEVYRKVLAVNLDGVFFTLREACRHMVERAKAGDPGGSLVGVASLAAIEGAARNEAYAATKGAVISMIKSVAVEHARYGVRANAILPGWIATDMTAGAQGNAAFAEKVIPRVPARRWGEPEDFGGMAVYLASDASSYHSGTTLVIDGGYSIF

SEQ ID NO: 11418 - protein, 279 aa, Caulobacter crescentus CB15
MSKLVPAVRSGDVLMPALGFGTWQLENGTAVPLVEKALEIGYRHIDTAQIYGNERDVGAAIRNSGVKRDEIFLTTKVWIDQFADGDLQRSAEKSLEKLGVDQVDLLLLHWPKPEVPLAETLKALNAVRAKGWTRAIGLSNFPSAQLEEAAKLSEAPIATDQVEYHPYLSLKTLKAKADQLGVSITAWSPLAQGKVAQDPVLIEIGRAHGKTPGQVTLRWIIQQGIIAIPRTSNPKRIEENFDILDFELSEKEMAQIHGLARPDGRIGDWIDRAYAWDAE

SEQ ID NO: 11419 - protein, 506 aa, Caulobacter crescentus CB15
MTKPEFIESLSRPPFKARYDNFIGGQWVAPADGRYFDNSSPIHGRKICEIARSQAIDIERALDAAHAAKAGWARTSAADRSRILLRIADRMEENLAALATAETWDNGKPIRETLAADIPLAIDHFRYFAGCLRSQEGSISEIDHDTIAYHFHEPLGVVGQIIPWNFPLLMACWKLAPALAAGNCVVLKPAEQTPASIMVWAEMIGDLLPAGVLNIVNGFGLEAGKPLASSPRIAKIAFTGETSTGRLIMQYAAQNLIPVTLELGGKSPNIFFDDVAREDDDYLDKALEGFTMFALNQGEVCTCPSRALVQESIYEKFMERALKRVNAVVQGSPLDPATMIGAQASEEQLNKILGYMDIGRNEGAKLLAGGQRKILPGQLADGYYVEPTVFEGHNKMRIFQEEIFGPVLAVTTFKTEEEALEIANDTAFGLGAGVWSRDANRCYRFGRGIEAGRVWTNCYHAYPAHAAFGGYKQSGVGRETHKMMLDHYQQTKNMLVSYSPKALGFF

SEQ ID NO: 11420 - protein, 595 aa, Caulobacter crescentus CB15
MGGGGAPMSAETKDIDLERAVASRRVNTYLRLSSTFAICATLHLVVGLRWVWIWGALYTAIQFLETWLALQLIKRPQSSPDRWRRFSVIALPFLTSAVFGFLAIPLFASDARFAPTLGGMLLAGALMNVVIVHGGLRSATIAAATPYVGYLLVIPIVARQANPDAPLANALWFGALLLIAAVAVASRTLHAALKAEADAKTEAERRRHEAEEAVAAKSAFVAMISHELRTPISAILAGAGRLHSEAPEASSKVHAQLIADAGGLMRTLLNDLLDFSRLEAGRMSVEKSPFNLRQSLSDTLRFWRPELARKGLKLRVVGASTIPQWTLGDAMRLKQVLNNLLSNAAKFTRSGGVSVTLRAEIVGDQVRLVVDVVDTGPGIPEAALPRLFTPFDQLNESVARLHGGSGLGLAISRELARLMGGDLTASNALGQGAHFRFSALLEAAEAPVVPTLGPSISGLRVLVVDDHVVNRRAVELVLQPFGVEATLAESGEEALELLRSEVFDAILMDVYMPGMDGRETTRTLRAGQGPNRDAPVVAVTASATIKDWEACAAAGMNAHVAKPIDPAELFSALAQVMAARDAVGPFRTDVAASSA

SEQ ID NO: 11421 - protein, 310 aa, Caulobacter crescentus CB15
MRSRGEPLPAGGRMKTLAFVALALAGISWGLGFPTGKLILRETDAAHMVLLRFLVAAVAAAPFALRRPEVRALFRSPIVLLAGALYGVAFLVQFEGLAHVSVTVAALLVGAMPALIAVSARVLGEKVSRLSWAGVAAATLGAALIAGKPDGASSPLGVALSIAALFLFLTWLLVLRRAPPAPNPMAIPAVSIIVAALVVLPIALIMHGPPKLALSAPAWTAIVAQGVLATLLATAAWQYGAAQVGAASAGVFINIEPLMGAACGVLLFGDHLTAALFAGGLLIIGGSFAVVMGERQAKPGEIQATVAPTP

SEQ ID NO: 11422 - protein, 412 aa, Caulobacter crescentus CB15
MGMCWGNDRSVERDVGEKRVLLIVGGGVAAYKALLLTRLLRKAGVAVRPILTKAGAAFVTPLSLAALAEDKVYEDLFSLTDEHEMGHIELSRSADLVVVAPATADLIAKAAQGLAGDLASTTLLATDKPVLMAPAMNVRMWLHPATQRNIATLEADGVRFVGPEEGAMACGEFGPGRLAEPEAIFAAIMAALEGPAARPLEGKRALVTAGPTFEPIDPVRGITNRSSGKQGFAIAEALAKLGAEVTLIAGPVALPTPPGVRRIDVETARQMLAASQAALPADVGVFVAAVADWRVDEAFGSKLKKEKGGPPALTFVENPDILATLSASGPHRPRLVVGFAAETDHVEEHARAKLARKGCDWIIANDVTEPGVMGGGENAVLLVTKTGTERWDRAAKDRVAAQIAQRIAEALG

SEQ ID NO: 11423 - protein, 365 aa, Caulobacter crescentus CB15
MSQGDGQPSRCHGRSHPLIATLLGPSVLFFQRFFRLMTALYDVAAIGNAIVDVIAQCDDAFLEREGLVKGSMALIDPARAASLYDVMSAAIEASGGSAANTVAGVASFGGKAAFLGKVADDQLGRVFRHDMNAIGCVFTTPPLAEGPATAQSLINVTPDAQRTMSTYLGACVELNPADVDPDIIEAAQISYLEGYLFDPPEARRAFAKAAALAHGSDRKIALTLSDSFVVDRHRGALLGFVETQCDIVFANAAEVCALFETDDFDAAVKALAERCEIAAVTRSEKGSVVAANGQLHEISAYPVEKVVDTTGAGDQYAAGFLFGLSQGRPLPICGQLGSLAAAEVIDHYGPRPQVSLRELAEKNGL

SEQ ID NO: 11424 - protein, 504 aa, Escherichia coli K12
MKNEKRKTGIEPKVFFPPLIIVGILCWLTVRDLDAANVVINAVFSYVTNVWGWAFEWYMVVMLFGWFWLVFGPYAKKRLGNEPPEFSTASWIFMMFASCTSAAVLFWGSIEIYYYISTPPFGLEPNSTGAKELGLAYSLFHWGPLPWATYSFLSVAFAYFFFVRKMEVIRPSSTLVPLVGEKHAKGLFGTIVDNFYLVALIFAMGTSLGLATPLVTECMQWLFGIPHTLQLDAIIITCWIILNAICVACGLQKGVRIASDVRSYLSFLMLGWVFIVSGASFIMNYFTDSVGMLLMYLPRMLFYTDPIAKGGFPQGWTVFYWAWWVIYAIQMSIFLARISRGRTVRELCFGMVLGLTASTWILWTVLGSNTLLLIDKNIINIPNLIEQYGVARAIIETWAALPLSTATMWGFFILCFIATVTLVNACSYTLAMSTCREVRDGEEPPLLVRIGWSILVGIIGIVLLALGGLKPIQTAIIAGGCPLFFVNIMVTLSFIKDAKQNWKD

SEQ ID NO: 11425 - protein, 347 aa, Escherichia coli K12
MRIEEDLKLGFKDVLIRPKRSTLKSRSDVELERQFTFKHSGQSWSGVPIIAANMDTVGTFSMASALASFDILTAVHKHYSVEEWQAFINNSSADVLKHVMVSTGTSDADFEKTKQILDLNPALNFVCIDVANGYSEHFVQFVAKAREAWPTKTICAGNVVTGEMCEELILSGADIVKVGIGPGSVCTTRVKTGVGYPQLSAVIECADAAHGLGGMIVSDGGCTTPGDVAKAFGGGADFVMLGGMLAGHEESGGRIVEENGEKFMLFYGMSSESAMKRHVGGVAEYRAAEGKTVKLPLRGPVENTARDILGGLRSACTYVGASRLKELTKRTTFIRVQEQENRIFNNL

SEQ ID NO: 11426 - protein, 398 aa, Escherichia coli K12
MKQLTILGSTGSIGCSTLDVVRHNPEHFRVVALVAGKNVTRMVEQCLEFSPRYAVMDDEASAKLLKTMLQQQGSRTEVLSGQQAACDMAALEDVDQVMAAIVGAAGLLPTLAAIRAGKTILLANKESLVTCGRLFMDAVKQSKAQLLPVDSEHNAIFQSLPQPIQHNLGYADLEQNGVVSILLTGSGGPFRETPLRDLATMTPDQACRHPNWSMGRKISVDSATMMNKGLEYIEARWLFNASASQMEVLIHPQSVIHSMVRYQDGSVLAQLGEPDMRTPIAHTMAWPNRVNSGVKPLDFCKLSALTFAAPDYDRYPCLKLAMEAFEQGQAATTALNAANEITVAAFLAQQIRFTDIAALNLSVLEKMDMREPQCVDDVLSVDANAREVARKEVMRLAS

SEQ ID NO: 11427 - protein, 267 aa, Escherichia coli K12
MAIPAFGLGTFRLKDDVVISSVITALELGYRAIDTAQIYDNEAAVGQAIAESGVPRHELYITTKIWIENLSKDKLIPSLKESLQKLRTDYVDLTLIHWPSPNDEVSVEEFMQALLEAKKQGLTREIGISNFTIPLMEKAIAAVGAENIATNQIELSPYLQNRKVVAWAKQHGIHITSYMTLAYGKALKDEVIARIAAKHNATPAQVILAWAMGEGYSVIPSSTKRKNLESNLKAQNLQLDAEDKKAIAALDCNDRLVSPEGLAPEWD

SEQ ID NO: 11428 - protein, 310 aa, Escherichia coli K12; identical to SEQ ID NO: 847

SEQ ID NO: 11429 - protein, 490 aa, Escherichia coli K12
MSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCKAAFEQKILARVERIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 11430 - protein, 369 aa, Escherichia coli K12; identical to SEQ ID NO: 1184

SEQ ID NO: 11431 - protein, 620 aa, Escherichia coli K12
MSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKNRRTVCVIGDGAITAGMAFEAMNHAGDIRPDMLVILNDNEMSISENVGALNNHLAQLLSGKLYSSLREGGKKVFSGVPPIKELLKRTEEHIKGMVVPGTLFEELGFNYIGPVDGHDVLGLITTLKNMRDLKGPQFLHIMTKKGRGYEPAEKDPITFHAVPKFDPSSGCLPKSSGGLPSYSKIFGDWLCETAAKDNKLMAITPAMREGSGMVEFSRKFPDRYFDVAIAEQHAVTFAAGLAIGGYKPIVAIYSTFLQRAYDQVLHDVAIQKLPVLFAIDRAGIVGADGQTHQGAFDLSYLRCIPEMVIMTPSDENECRQMLYTGYHYNDGPSAVRYPRGNAVGVELTPLEKLPIGKGIVKRRGEKLAILNFGTLMPEAAKVAESLNATLVDMRFVKPLDEALILEMAASHEALVTVEENAIMGGAGSGVNEVLMAHRKPVPVLNIGLPDFFIPQGTQEEMRAELGLDAAGMEAKIKAWLA

SEQ ID NO: 11432 - protein, 493 aa, Escherichia coli K12
MNKHASQPRAIYYVVALQIWEYFSFYGMRALLILYLTNQLKYNDTHAYELFSAYCSLVYVTPILGGFLADKVLGNRMAVMLGALLMAIGHVVLGASEIHPSFLYLSLAIIVCGYGLFKSNVSCLLGELYEPTDPRRDGGFSLMYAAGNVGSIIAPIACGYAQEEYSWAMGFGLAAVGMIAGLVIFLCGNRHFTHTRGVNKKVLRATNFLLPNWGWLLVLLVATPALITILFWKEWSVYALIVATIIGLGVLAKIYRKAENQKQRKELGLIVTLTFFSMLFWAFAQQGGSSISLYIDRFVNRDMFGYTVPTAMFQSINAFAVMLCGVFLAWVVKESVAGNRTVRIWGKFALGLGLMSAGFCILTLSARWSAMYGHSSLPLMVLGLAVMGFAELFIDPVAMSQITRIEIPGVTGVLTGIYMLLSGAIANYLAGVIADQTSQASFDASGAINYSINAYIEVFDQITWGALACVGLVLMIWLYQALKFRNRALALES

SEQ ID NO: 11433 - protein, 196 aa, Escherichia coli K12
MQSERIYLVWAHPRHDSLTAHIADAIHQRAMERKIQVTELDLYRRNFNPVMTPEDEPDWKNMDKRYSPEVHQLYSELLEHDTLVVVFPLWWYSFPAMLKGYIDRVWNNGLAYGDGHKLPFNKVRWVALVGGDKESFVQMGWEKNISDYLKNMCSYLGIEDADVTFLCNTVVFDGEELHASYYQSLLSQVRDMVDAL

SEQ ID NO: 11434 - protein, 904 aa, Escherichia coli K12
MGFALMALLTLTSTLVGWYNLRFISQVEKDNTQALIPTMNMARQLSEASAWELFAAQNLTSADNEKMWQAQGRMLTAQSLKINALLQALREQGFDTTAIEQQEQEISRSLRQQGELVGQRLQLRQQQQQLSQQIVAAADEIARLAQGQANNATTSAGATQAGIYDLIEQDQRQAAESALDRLIDIDLEYVNQMNELRLSALRVQQMVMNLGLEQIQKNAPTLEKQLNNAVKILQRRQIRIEDPGVRAQVATTLTTVSQYSDLLALYQQDSEISNHLQTLAQNNIAQFAQFSSEVSQLVDTIELRNQHGLAHLEKASARGQYSLLLLGMVSLCALILILWRVVYRSVTRPLAEQTQALQRLLDGDIDSPFPETAGVRELDTIGRLMDAFRSNVHALNRHREQLAAQVKARTAELQELVIEHRQARAEAEKASQAKSAFLAAMSHEIRTPLYGILGTAQLLADNPALNAQRDDLRAITDSGESLLTILNDILDYSAIEAGGKNVSVSDEPFEPRPLLESTLQLMSGRVKGRPIRLATAIADDMPCALMGDPRRIRQVITNLLSNALRFTDEGYIILRSRTDGEQWLVEVEDSGCGIDPAKLAEIFQPFVQVSGKRGGTGLGLTISSRLAQAMGGELSATSTPEVGSCFCLRLPLRVATAPVPKTVNQAVRLDGLRLLLIEDNPLTQRITIEMLKTSGAQIVAVGNAAQALETLQNSEPFAAALVDFDLPDIDGITLARQLAQQYPSLVLIGFSAHVIDETLRQRTSSLFRGIIPKPVPREVLGQLLAHYLQLQVNNDQSLDVSQLNEDAQLMGTEKIHEWLVLFTQHALPLLDEIDIARASQDSEKIKRAAHQLKSSCSSLGMHIASQLCAQLEQQPLSAPLPHEEITRSVAALEAWLHKKDLNAI

SEQ ID NO: 11435 - protein, 244 aa, Escherichia coli K12
MNFEGKIALVTGASRGIGRAIAETLAARGAKVIGTATSENGAQAISDYLGANGKGLMLNVTDPASIESVLEKIRAEFGEVDILVNNAGITRDNLLMRMKDEEWNDIIETNLSSVFRLSKAVMRAMMKKRHGRIITIGSVVGTMGNGGQANYAAAKAGLIGFSKSLAREVASRGITVNVVAPGFIETDMTRALSDDQRAGILAQVPAGRLGGAQEIANAVAFLASDEAAYITGETLHVNGGMYMV

SEQ ID NO: 11436 - protein, 495 aa, Escherichia coli K12
MNFHHLAYWQDKALSLAIENRLFINGEYTAAAENETFETVDPVTQAPLAKIARGKSVDIDRAMSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEESIADEFLALLKQQAQNWQPGHPLDPATTMGTLIDCAHADSVHSFIREGESKGQLLLDGRNAGLAAAIGPTIFVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 11437 - protein, 500 aa, Escherichia coli K12
MMTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADHLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPDWLDGWCETKSVCVRY

SEQ ID NO: 11438 - protein, 479 aa, Escherichia coli K12
MSVPVQHPMYIDGQFVTWRGDAWIDVVNPATEAVISRIPDGQAEDARKAIDAAERAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVAFGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 11439 - protein, 474 aa, Escherichia coli K12
MQHKLLINGELVSGEGEKQPVYNPATGDVLLEIAEASAEQVDAAVRAADAAFAEWGQTTPKVRAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINILFGRGKTVGDPLTGHPKVRMVSLTGSIATGEHIISHTASSIKRTHMELGGKAPVIVFDDADIEAVVEGVRTFGYYNAGQDCTAACRIYAQKGIYDTLVEKLGAAVATLKSGAPDDESTELGPLSSLAHLERVGKAVEEAKATGHIKVITGGEKRKGNGYYYAPTLLAGALQDDAIVQKEVFGPVVSVTPFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 11440 - protein, 470 aa, Escherichia coli K12
MTHKGDTPMTITPATHAISINPATGEQLSVLPWAGADDIENALQLAAAGFRDWRETNIDYRAEKLRDIGKALRARSEEMAQMITREMGKPINQARAEVAKSANLCDWYAEHGPAMLKAEPTLVENQQAVIEYRPLGTILAIMPWNFPLWQVMRGAVPIILAGNGYLLKHAPNVMGCAQLIAQVFKDAGIPQGVYGWLNADNDGVSQMIKDSRIAAVTVTGSVRAGAAIGAQAGAALKKCVLELGGSDPFIVLNDADLELAVKAAVAGRYQNTGQVCAAAKRFIIEEGIASAFTERFVAAAAALKMGDPRDEENALGPMARFDLRDELHHQVEKTLAQGARLLLGGEKMAGAGNYYPPTVLANVTPEMTAFREEMFGPVAAITIAKDAEHALELANDSEFGLSATIFTTDETQARQMAARLECGGVFINGYCASDARVAFGGVKKSGFGRELSHFGLHEFCNIQTVWKDRI

SEQ ID NO: 11441 - protein, 457 aa, Escherichia coli K12
MQKYISEARLLLALAIPVILAQIAQTAMGFVSTVMAGGYSATDMAAVAIGTSIWLPAILFGHGLLLALTPVIAQLNGSGRRERIAHQVRQGFWLAGFVSVLIMLVLWNAGYIIRSMENIDPALADKAVGYLRALLWGAPGYLFFQVARNQCEGLAKTKPGMVMGFIGLLVNIPVNYIFIYGHFGMPELGGVGCGVATAAVYWVMFLAMVSYIKRARSMRDIRNEKGTAKPDPAVMKRLIQLGLPIALALFFEVTLFAVVALLVSPLGIVDVAGHQIALNFSSLMFVLPMSLAAAVTIRVGYRLGQGSTLDAQTAARTGLMVGVCMATLTAIFTVSLREQIALLYNDNPEVVTLAAHLMLLAAVYQISDSIQVIGSGILRGYKDTRSIFYITFTAYWVLGLPSGYILALTDLVVEPMGPAGFWIGFIIGLTSAAIMMMLRMRFLQRLPSAIILQRASR

SEQ ID NO: 11442 - protein, 322 aa, Escherichia coli K12
MAKRNNDMDNLDVICIGAAIVDIPLQPVSKNIFDVDSYPLERIAMTTGGDAINEATIISRLGHRTALMSRIGKDAAGQFILDHCRKENIDIQSLKQDVSIDTSINVGLVTEDGERTFVTNRNGSLWKLNIDDVDFARFSQAKLLSLASIFNSPLLDGKALTEIFTQAKARQMIICADMIKPRLNETLDDICEALSYVDYLFPNFAEAKLLTGKETLDEIADCFLACGVKTVVIKTGKDGCFIKRGDMTMKVPAVAGITAIDTIGAGDNFASGFIAALLEGKNLRECARFANATAAISVLSVGATTGVKNRKLVEQLLEEYEG

SEQ ID NO: 11443 - protein, 284 aa, Escherichia coli K12
MQQKMIQFSGDVSLPAVGQGTWYMGEDASQRKTEVAALRAGIELGLTLIDTAEMYADGGAEKVVGEALTGLREKVFLVSKVYPWNAGGQKAINACEASLRRLNTDYLDLYLLHWSGSFAFEETVAAMEKLIAQGKIRRWGVSNLDYADMQELWQLPGGNQCATNQVLYHLGSRGIEYDLLPWCQQQQMPVMAYSPLAQAGRLRNGLLKNAVVNEIAHAHNISAAQVLLAWVISHQGVMAIPKAATIAHVQQNAAVLEVELSSAELAMLDKAYPAPKGKTALDMV

SEQ ID NO: 11444 - protein, 933 aa, Escherichia coli K12
MFRALALVLWLLIAFSSVFYIVNALHQRESEIRQEFNLSSDQAQRFIQRTSDVMKELKYIAENRLSAENGVLSPRGRETQADVPAFEPLFADSDCSAMSNTWRGSLESLAWFMRYWRDNFSAAYDLNRVFLIGSDNLCMANFGLRDMPVERDTALKALHERINKYRNAPQDDSGSNLYWISEGPRPGVGYFYALTPVYLANRLQALLGVEQTIRMENFFLPGTLPMGVTILDENGHTLISLTGPESKIKGDPRWMQERSWFGYTEGFRELVLKKNLPPSSLSIVYSVPVDKVLERIRMLILNAILLNVLAGAALFTLARMYERRIFIPAESDALRLEEHEQFNRKIVASAPVGICILRTADGVNILSNELAHTYLNMLTHEDRQRLTQIICGQQVNFVDVLTSNNTNLQISFVHSRYRNENVAICVLVDVSSRVKMEESLQEMAQAAEQASQSKSMFLATVSHELRTPLYGIIGNLDLLQTKELPKGVDRLVTAMNNSSSLLLKIISDILDFSKIESEQLKIEPREFSPREVMNHITANYLPLVVRKQLGLYCFIEPDVPVALNGDPMRLQQVISNLLSNAIKFTDTGCIVLHVRADGDYLSIRVRDTGVGIPAKEVVRLFDPFFQVGTGVQRNFQGTGLGLAICEKLISMMDGDISVDSEPGMGSQFTVRIPLYGAQYPQKKGVEGLSGKRCWLAVRNASLCQFLETSLQRSGIVVTTYEGQEPTPEDVLITDEVVSKKWQGRAVVTFCRRHIGIPLEKAPGEWVHSVAAPHELPALLARIYLIEMESDDPANALPSTDKAVSDNDDMMILVVDDHPINRRLLADQLGSLGYQCKTANDGVDALNVLSKNHIDIVLSDVNMPNMDGYRLTQRIRQLGLTLPVIGVTANALAEEKQRCLESGMDSCLSKPVTLDVIKQTLTLYAERVRKSRDS

SEQ ID NO: 11445 - protein, 1197 aa, Escherichia coli K12
MKFLPYIFLLCCGLWSTISFADEDYIEYRGISSNNRVTLDPLRLSNKELRWLASKKNLVIAVHKSQTATLLHTDSQQRVRGINADYLNLLKRALNIKLTLREYADHQKAMDALAEGEVDIVLSHLVTSPPLNNDIAATKPLIITFPALVTTLHDSMRPLTSPKPVNIARVANYPPDEVIHQSFPKATIISFTNLYQALASVSAGHNDYFIGSNIITSSMISRYFTHSLNVVKYYNSPRQYNFFLTRKESVILNEVLNRFVDALTNEVRYEVSQNWLDTGNLAFLNKPLELTEHEKQWIKQHPNLKVLENPYSPPYSMTDENGSVRGVMGDILNIITLQTGLNFSPITVSHNIHAGTQLSPGGWDIIPGAIYSEDRENNVLFAEAFITTPYVFVMQKAPDSEQTLKKGMKVAIPYYYELHSQLKEMYPEVEWIQVDNASAAFHKVKEGELDALVATQLNSRYMIDHYYPNELYHFLIPGVPNASLSFAFPRGEPELKDIINKALNAIPPSEVLRLTEKWIKMPNVTIDTWDLYSEQFYIVTTLSVLLVGSSLLWGFYLLRSVRRRKVIQGDLENQISFRKALSDSLPNPTYVVNWQGNVISHNSAFEHYFTADYYKNAMLPLENSDSPFKDVFSNAHEVTAETKENRTIYTQVFEIDNGIEKRCINHWHTLCNLPASDNAVYICGWQDITETRDLINALEVEKNKAIKATVAKSQFLATMSHEIRTPISSIMGFLELLSGSGLSKEQRVEAISLAYATGQSLLGLIGEILDVDKIESGNYQLQPQWVDIPTLVQNTCHSFGAIAASKSIALSCSSTFPEHYLVKIDPQAFKQVLSNLLSNALKFTTEGAVKITTSLGHIDDNHAVIKMTIMDSGSGLSQEEQQQLFKRYSQTSAGRQQTGSGLGLMICKELIKNMQGDLSLESHPGIGTTFTITIPVEISQQVATVEAKAEQPITLPEKLSILIADDHPTNRLLLKRQLNLLGYDVDEATDGVQALHKVSMQHYDLLITDVNMPNMDGFELTRKLREQNSSLPIWGLTANAQANEREKGLSCGMNLCLFKPLTLDVLKTHLSQLHQVAHIAPQYRHLDIEALKNNTANDLQLMQEILMTFQHETHKDLPAAFQALEAGDNRTFHQCIHRIHGAANILNLQKLINISHQLEITPVSDDSKPEILQLLNSVKEHIAELDQEIAVFCQKND

SEQ ID NO: 11446 - protein, 285 aa, Escherichia coli K12
MFILYFQREWSVTLCINKESIKMGKLTGKTALITGALQGIGEGIARTFARHGANLILLDISPEIEKLADELCGRGHRCTAVVADVRDPASVAAAIKRAKEKEGRIDILVNNAGVCRLGSFLDMSDDDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPEDPESVLTEMAKAIPMRRLADPLEVGELAAFLASDESSYLTGTQNVIDGGSTLPETVSVGI

SEQ ID NO: 11447 - protein, 396 aa, Escherichia coli K12 [sequence omitted]

SEQ ID NO: 11448 - protein, 178 aa, Escherichia coli K12
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 11449 - protein, 482 aa, Escherichia coli K12
MKLNDSNLFRQQALINGEWLDANNGEAIDVTNPANGDKLGSVPKMGADETRAAIDAANRALPAWRALTAKERATILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDNGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 11450 - protein, 188 aa, Escherichia coli K12
MYERYAGLIFDMDGTILDTEPTHRKAWREVLGHYGLQYDIQAMIALNGSPTWRIAQAIIELNQADLDPHALAREKTEAVRSMLLDSVEPLPLVDVVKSWHGRRPMAVGTGSESAIAEALLAHLGLRHYFDAVVAADHVKHHKPAPDTFLLCAQRMGVQPTQCVVFEDADFGIQAARAAGMDAVDVRLL

SEQ ID NO: 11451 - protein, 330 aa, Escherichia coli K12
MSQNTLKVHDLNEDAEFDENGVEVFDEKALVEQEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 11452 - protein, 469 aa, Escherichia coli K12
MTGRCLFGFSGEKPFLLPDNEGVKMNTSPVRMDDLPLNRFHCRIAALTFGAHLTDGYVLGVIGYAIIQLTPAMQLTPFMAGMIGGSALLGLFLGSLVLGWISDHIGRQKIFTFSFLLITLASFLQFFATTPEHLIGLRILIGIGLGGDYSVGHTLLAEFSPRRHRGILLGAFSVVWTVGYVLASIAGHHFISENPEAWRWLLASAALPALLITLLRWGTPESPRWLLRQGRFAEAHAIVHRYFGPHVLLGDEVVTATHKHIKTLFSSRYWRRTAFNSVFFVCLVIPWFVIYTWLPTIAQTIGLEDALTASLMLNALLIVGALLGLVLTHLLAHRKFLLGSFLLLAATLVVMACLPSGSSLTLLLFVLFSTTISAVSNLVGILPAESFPTDIRSLGVGFATAMSRLGAAVSTGLLPWVLAQWGMQVTLLLLATVLLVGFVVTWLWAPETKALPLVAAGNVGGANEHSVSV

SEQ ID NO: 11453 - protein, 286 aa, Escherichia coli K12
MRKVTSLSRGKLPFFFFALRKLELTMSIESLNAFSMDFFSLKGKTAIVTGGNSGLGQAFAMALAKAGANIFIPSFVKDNGETKEMIEKQGVEVDFMQVGITAEGAPQKIIAACCERFGTVDILVNNAGICKLNKVLDFGRADWDPMIDVNLTAAFELSYEAAKIMIPQKSGKIINICSLFSYLGGQWSPAYSATKHALAGFTKAYCDELGQYNIQVNGIAPGYYATDITLATRSNPETNQRVLDHIPANRWGDTQDLMGAAVFLASPASNYVNGHLLVVDGGYLVR

SEQ ID NO: 11454 - protein, 420 aa, Escherichia coli K12
MPHSLFSTDTDLTAENLLRLPAEFGCPVWVYDAQIIRRQIAALKQFDVVRFAQKACSNIHILRLMREQGVKVDSVSLGEIERALAAGYNPQTHPDDIVFTADVIDQATLERVSELQIPVNAGSVDMLDQLGQVSPGHRVWLRVNPGFGHGHSQKTNTGGENSKHGIWYTDLPAALDVIQRHHLQLVGIHMHIGSGVDYAHLEQVCGAMVRQVIEFGQDLQAISAGGGLSVPYQQGEEAVDTEHYYGLWNAAREQIARHLGHPVKLEIEPGRFLVAQSGVLITQVRSVKQMGSRHFVLVDAGFNDLMRPAMYGSYHHISALAADGRSLEHAPTVETVVAGPLCESGDVFTQQEGGNVETRALPEVKAGDYLVLHDTGAYGASMSSNYNSRPLLPEVLFDNGQARLIRRRQTIEELLALELL

SEQ ID NO: 11455 - protein, 253 aa, Escherichia coli K12
MILSAFSLEGKVAVVTGCDTGLGQGMALGLAQAGCDIVGINIVEPTETIEQVTALGRRFLSLTADLRKIDGIPALLDRAVAEFGHIDILVNNAGLIRREDALEFSEKDWDDVMNLNIKSVFFMSQAAAKHFIAQGNGGKIINIASMLSFQGGIRVPSYTASKSGVMGVTRLMANEWAKHNINVNAIAPGYMATNNTQQLRADEQRSAEILDRIPAGRWGLPSDLMGPIVFLASSASDYVNGYTIAVDGGWLAR

SEQ ID NO: 11456 - protein, 321 aa, Escherichia coli K12
MMSLAWPLFRVTEQAALAAWPQTGCGDKNKIDGLAVTAMRQALNDVAFRGRVVIGEGEIDHAPMLWIGEEVGKGDGPEVDIAVDPIEGTRMVAMGQSNALAVMAFAPRDSLLHAPDMYMKKLVVNRLAAGAIDLSLPLTDNLRNVAKALGKPLDKLRMVTLDKPRLSAAIEEATQLGVKVFALPDGDVAASVLTCWQDNPYDVMYTIGGAPEGVISACAVKALGGDMQAELIDFCQAKGDYTENRQIAEQERKRCKAMGVDVNRVYSLDELVRGNDILFSATGVTGGELVNGIQQTANGVRTQTLLIGGADQTCNIIDSLH

SEQ ID NO: 11457 - protein, 464 aa, Escherichia coli K12
MPDAKKQGRSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 11458 - protein, 236 aa, Escherichia coli K12
MGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 11459 - protein, 613 aa, Escherichia coli K12
MEQNPQSQLKLLVTRGKEQGYLTYAEVNDHLPEDIVDSDQIEDIIQMINDMGIQVMEEAPDADDLMLAENTADEDAAEAAAQVLSSVESEIGRTTDPVRMYMREMGTVELLTREGEIDIAKRIEDGINQVQCSVAEYPEAITYLLEQYDRVEAEEARLSDLITGFVDPNAEEDLAPTATHVGSELSQEDLDDDEDEDEEDGDDDSADDDNSIDPELAREKFAELRAQYVVTRDTIKAKGRSHATAQEEILKLSEVFKQFRLVPKQFDYLVNSMRVMMDRVRTQERLIMKLCVEQCKMPKKNFITLFTGNETSDTWFNAAIAMNKPWSEKLHDVSEEVHRALQKLQQIEEETGLTIEQVKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELAERMLMPEDKIRKVLKIAKEPISMETPIGDDEDSHLGDFIEDTTLELPLDSATTESLRAATHDVLAGLTAREAKVLRMRFGIDMNTDYTLEEVGKQFDVTRERIRQIEAKALRKLRHPSRSEVLRSFLDD

SEQ ID NO: 11460 - protein, 776 aa, Escherichia coli K12
MKQIRLLAQYYVDLMMKLGLVRFSMLLALALVVLAIVVQMAVTMVLHGQVESIDVIRSIFFGLLITPWAVYFLSVVVEQLEESRQRLSRLVQKLEEMRERDLSLNVQLKDNIAQLNQEIAVREKAEAELQETFGQLKIEIKEREETQIQLEQQSSFLRSFLDASPDLVFYRNEDKEFSGCNRAMELLTGKSEKQLVHLKPADVYSPEAAAKVIETDEKVFRHNVSLTYEQWLDYPDGRKACFEIRKVPYYDRVGKRHGLMGFGRDITERKRYQDALERASRDKTTFISTISHELRTPLNGIVGLSRILLDTELTAEQEKYLKTIHVSAVTLGNIFNDIIDMDKMERRKVQLDNQPVDFTSFLADLENLSALQAQQKGLRFNLEPTLPLPHQVITDGTRLRQILWNLISNAVKFTQQGQVTVRVRYDEGDMLHFEVEDSGIGIPQDELDKIFAMYYQVKDSHGGKPATGIGLAVSRRLAKNMGGDITVTSEQGKGSTFTLTIHAPSVAEEVDDAFDEDDMPLPALNVLLVEDIELNVIVARSVLEKLGNSVDVAMTGKAALEMFKPGEYDLVLLDIQLPDMTGLDISRELTKRYPREDLPPLVALTANVLKDKQEYLNAGMDDVLSKPLSVPALTAMIKKFWDTQDDEESTVTTEENSKSEALLDIPMLEQYLELVGPKLITDGLAVFEKMMPGYVSVLESNLTAQDKKGIVEEGHKIKGAAGSVGLRHLQQLGQQIQSPDLPAWEDNVGEWIEEMKEEWRHDVEVLKAWVAKATKK

SEQ ID NO: 11461 - protein, 261 aa, Escherichia coli K12
MKTLATIGDNCVDIYPQLNKAFSGGNAVNVAVYCTRYGIQPGCITWVGDDDYGTKLKQDLARMGVDISHVHTKHGVTAQTQVELHDNDRVFGDYTEGVMADFALSEEDYAWLAQYDIVHAAIWGHAEDAFPQLHAAGKLTAFDFSDKWDSPLWQTLVPHLDFAFASAPQEDETLRLKMKAIVARGAGTVIVTLGENGSIAWDGAQFWRQAPEPVTVIDTMGAGDSFIAGFLCGWSAGMTLPQAIAQGTACAAKTIQYHGAW

SEQ ID NO: 11462 - protein, 466 aa, Escherichia coli K12
MDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 11463 - protein, 542 aa, Escherichia coli K12
MIAVVKLLPTGEDFASHVYPCYTSHRKETIMTNNPPSAQIKPGEYGFPLKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGVIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 11464 - protein, 336 aa, Escherichia coli K12
MRRELAIEFSRVTESAALAGYKWLGRGDKNTADGAAVNAMRIMLNQVNIDGTIVIGEGEIDEAPMLYIGEKVGTGRGDAVDIAVDPIEGTRMTAMGQANALAVLAVGDKGCFLNAPDMYMEKLIVGPGAKGTIDLNLPLADNLRNVAAALGKPLSELTVTILAKPRHDAVIAEMQQLGVRVFAIPDGDVAASILTCMPDSEVDVLYGIGGAPEGVVSAAVIRALDGDMNGRLLARHDVKGDNEENRRIGEQELARCKAMGIEAGKVLRLGDMARSDNVIFSATGITKGDLLEGISRKGNIATTETLLIRGKSRTIRRIQSIHYLDRKDPEMQVHIL

SEQ ID NO: 11465 - protein, 549 aa, Escherichia coli K12
MEIFFTILIMTLVVSLSGVVTRVMPFQIPLPLMQIAIGALLAWPTFGLHVEFDPELFLVLFIPPLLFADGWKTPTREFLEHGREIFGLALALVVVTVVGIGFLIYWVVPGIPLIPAFALAAVLSPTDAVALSGIVGEGRIPKKIMGILQGEALMNDASGLVSLKFAVAVAMGTMIFTVGGATVEFMKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILETSLMAAEIDPNVEIWMLFTNIILIYAALMLVRFGWLWTMKKFSNRFLKKKPMEFGSWTTREILIASFAGVRGAITLAGVLSIPLLLPDGNVFPARYELVFLAAGVILFSLFVGVVMLPILLQHIEVADHSQQLKEERIARAATAEVAIVAIQKMEERLAADTEENIDNQLLTEVSSRVIGNLRRRADGRNDVESSVQEENLERRFRLAALRSERAELYHLRATREISNETLQKLLHDLDLLEALLIEENQ

SEQ ID NO: 11466 - protein, 332 aa, Escherichia coli K12
MKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 11467 - protein, 254 aa, Escherichia coli K12
MNDLFSLAGKNILITGSAQGIGFLLATGLGKYGAQIIINDITAERAELAVEKLHQEGIQAVAAPFNVTHKHEIDAAVEHIEKDIGPIDVLVNNAGIQRRHPFTEFPEQEWNDVIAVNQTAVFLVSQAVTRHMVERKAGKVINICSMQSELGRDTITPYAASKGAVKMLTRGMCVELARHNIQVNGIAPGYFKTEMTKALVEDEAFTAWLCKRTPAARWGDPQELIGAAVFLSSKASDFVNGHLLFVDGGMLVAV

SEQ ID NO: 11468 - protein, 124 aa, Psammechinus miliaris
MSGRGKGAKAKSKAKSRSSRAGLQFPVGRVHRFLKKGNYGNRVGAGAPVYLAAVLEYLTAEILELAGNAARDNKKSRIIPRHLQLAVRNDEELNKLLGGVTIAQGGVLPNIQAVLLPKKTGKSA

SEQ ID NO: 11469 - protein, 157 aa, Homo sapiens
MFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 11470 - protein, 375 aa, Pseudomonas sp. DSS73
LLLTLLPTSLMALVLGGYFTWTQQSDLQSQLMQRGEMIAEQLAPLVAPAMGHGNSDLLERIATQSLEQPDVRAVTFLAPDRSPLAHAGPTMLNQAPSGDSAHLQRRSGNDATRYLMPVFGKHRNLAGELIPQESDRLLGWVELELSHNGMLLRGYRSLFASLLLIAAGLAGAALLALRMGRTINRPLSQIKQAVAQLKDGHLETRLPPLGSQELDELASGINRMAGTLQNAREELQHSVDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDHIPFNLRDLLQDTLTILAPAAHAKQLELVSLV

SEQ ID NO: 11471 - protein, 434 aa, Streptococcus pneumoniae
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKALPTPMMNIINGGSHSDAPIAFQEFMILPVGAPTFKEALRYGAEIFHALKKILKSRGLETAVGDEGGFAPRFEGTEDGVETILAAIEAAGYVPGKDVFLGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 11472 - protein, 506 aa, Yersinia pseudotuberculosis
MRYAHPGTPEALVSFKAIYGNYIGGEFIEPLGGQYFMNTSPVNGSDIAQFPRSDARDIDAALDAAHQAADAWGKTSVQHRSNLLLQMADRIEANLEYLAVAESWDNGKPIRETLNADLPLAVDHFRYFAGCLRAQEGGVAEIDEKTVAYHFHEPLGVVGQIIPWNFPLLMAAWKLAPALAAGNCVVLKPAEQTPLGITLLLELVGDIFPAGVINVVQGYGREAGEALARSKRIAKIAFTGSTPVGRHIMACAAENIIPCTVELGGKSPNIYFADVMEAEPEFIDKAVEGLVLGFFNQGEVCTCPSRALIHESIYAPFMARVMTKVANIRRGDPLDTETMIGAQASRQQFDKILSYIDIARKEGGEILTGGARATITPALDSGFYIQPTLIKGDNLMRCFQEEIFGPVIGVTTFKDEAEALAIANQTQFGLGAGIWTRDAHLAYRMGRGIKAGRVWTNCYHVYPAHAAFGGYKQSGVGRETHKMALNQYQQTKNLLVSYDTAPLGLF

SEQ ID NO: 11473 - protein, 215 aa, Rhizobium leguminosarum bv. trifolii
AAIFFAGTPILESAMVYPLAICGACILTSIAGTFFVKLGTNNSIMGALYKGLIATGVFSVAGLAVATYATVGWGTIGTVAGMEITGTNLFFCGLVGLVVTALIVVITEYYTGTNKRPVNSIAQASVTGHGTNVIQGLAVSLESTALPAIVIVGGIIGTYQLGGLFGTGIAVTAMLGLAGMIVALDAFGPVTDNAGGIAEMAGLDPDVRKRPTRWM

SEQ ID NO: 11474 - protein, 169 aa, Rhizobium leguminosarum bv. trifolii
GSAGLGALVLFAAYANDLSYFAANGDTYPYFKDIGEISFSLANPYVVAGLLFGGLIPYLFGGIAMTAVGKAASAIVEEVRRQFREKPGIMAGTEKPDYGRAVDLLTKAAIREMVIPSLLPVLAPLVVYFGVLLISGSKAFAFAALGAYLLAVIMNRVLVAICMTLVGSS

SEQ ID NO: 11475 - protein, 207 aa, Agrobacterium tumefaciens
AAIFFAGTPILESAMVYPLAICGACILTSIAGTFFVKLGTNNSIMGALYKGLIATGVFSVAGLAVATYATVGWGTIGTVAGMEITGTNLFFCGLVGLVVTALIVVITEYYTGTNKRPVNSIAQASVTGHGTNVIQGLTVSLESTALPAIVIVGGIIGTYQLAGLFGTGIAVTAMLGLAGMIVALDAFGPVTDNAGGIAEMAGVDRDV

SEQ ID NO: 11476 - protein, 221 aa, Agrobacterium tumefaciens
AGLGALVLFAAYANDLSYFAANGDTYPYFKDIGEISFSLANPYVVAGLLFGGLIPYLFGGIAMTAVGKAASAIVEEVRRQFREKPGIMAGTEKPDYGRAVDLLTKAAIREMVIPSLLPVLAPLVVYFGVLLISGSKASAFAALGASLLGVIINGLFVAISMTSGGGAWDNAKKSFEDGFIDKDGVRHVKGSEAHKASVTGDTVGDPYKDTAGPAVNPGHQD

SEQ ID NO: 11477 - protein, 506 aa, Oryza sativa (indica cultivar-group)
MAVDMELDGGGDGKGKAPPQISLSGLFLACMVAGGVQYGWALQLSLLTPYIQTLGIPHALTSVMWLCGPIAGLIVQPCVGLYSDKCTSSLGRRRPFILTGCIIICISVIVIGFSSDIGYALGDATEDCKVYRGPRYHAAAAFILGFWLLDFSNNTVQGPARALMADLSGRHGPSAANAIFCSWMALGNILGYSSGSTNDWHKWFPFLMTRACCEACANLKAAFLVAVVFLGLSTAVTMVFAREVALDPVAAAKRNEGEASGPLAVFKGMKNLPVGMPSVLIVTGLTWLSWFPFILFDTDWMGREIYHGRPDGSPAEVTAFQEGVRQGAFGLLLNSIVLGISSFLIEPMCRRLGARAVWVMSSAVVCVAMAAVSVLSAWSLGDFGGSVQDAARAPAEEGGVRASALALFVFLGLPFAVLCSVPFAVTAQLTASRGGGQGLCTGVLNISIVVPQMAIALGAGPWDELFGEGNIPAFAMASVFAAAAAAAGVVLLPKVSVRSVSMAGGH

SEQ ID NO: 11478 - protein, 472 aa, Homo sapiens
MNKMKNFKRRFSLSVPRTETIEESLAEFTEQFNQLHNRRNENLQLGPLGRDPPQECSTFSPTDSGEEPGQLSPGVQFQRRQNQRRFSMEDVSKRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGLAYCHHRKILHRDLKPQNLLINERGELKLADFGLARAKSVPTKTYSNEVVTLWYRPPDVLLGSTEYSTPIDMWGVGCIHYEMATGRPLFPGSTVKEELHLIFRLLGTPTEETWPGVTAFSEFRTYSFPCYLPQPLINHAPRLDTDGIHLLSSLLLYESKSRMSAEAALSHSYFRSLGERVHQLEDTASIFSLKEIQLQKDPGYRGLAFQQPGRGKNRRQSIF

SEQ ID NO: 11479 - protein, 255 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRNDLELTLEPVYNCNLGCFAA

SEQ ID NO: 11480 - protein, 259 aa, Homo sapiens
SQLQNRLRSALALVTGAGSGIGRAVSVRLAGEGATVAACDLDRAAAQETVRLLGGPGSKEGPPRGNHAAFQADVSEARAARCLLEQVQACFSRPPSVVVSCAGITQDEFLLHMSRDDWDKVIAVNLKGTFLVTQAAAQALVSNGCRGSIINISSIVGKVGNVGQTNYAASKAGVIGLTQTAARELGRHGIPCNSVLPGFIATPMTKKVPKKVVDKITEMIPMGHLGDPEDVADVVAFLASEDSGYITGTSVEVTGGLFM

SEQ ID NO: 11481 - protein, 268 aa, Medicago truncatula
  unsure (1)..(268): unsure at all Xaa locations
MAISHNTLAFTFGMLGNVISFLVFLAPISTFYRIYKKKSTEGFQSLPYLVALFSSMLWLYYALLKKDAFLLITINSFGCVVETIYIILYIIYAPRDARNLTFKLLSAMNVGSFALILIVTNYAVHGPLRVQVLGWVCVSLSVSVFAAPLSIVAQVVRTKSVEFMPFNLSFTLTLSATMWFGYGFFLKDICIXLPNVLGXVLGLLQMLLYAIYRNGGEKAMKKEKKAPIEPPKSIVIETQLEKIEQEKKNKDDDNEEKDKSEEPIGCGV

SEQ ID NO: 11482 - protein, 84 aa, Arabidopsis thaliana
MKVKILRWHAVASWTWDAQDETCGICRMAFDGCCPDCKLPGDDCPLIWGACNHAFHLHCILKWVNSQTSQAHCPMCRREWQFKE

SEQ ID NO: 11483 - protein, 1075 aa, Drosophila melanogaster
MELRQTHLANKDLDGATEDDSIVELRRRDAQATPLPRIAVSALPTLQPHPTPKERQKPPMPRLLSTEDDAGVSFALGSIEKHIHNVEESFKQQQQNQQSQSSMDVMKLEIKRKQSKRYGETENLLRPGISDMSSENDFQYLGGRRAGELDDSNELMLSEFQRGSDGRNSIGAYSKNSAAAANGANAVKAKLARTASDTKNNDTVLAMRATFKQKQHLQDEKQPAVWRPAGTGPTPAARSSSSTTSTSGSASRGGSSSSVVDGVAPSKLTATTISASKRREENLRQFEALLAQKSSHRHGASGASGTGSNAASSKRRSDRPIVAPIPPYNSSRAEHVTSSTRHSVDPRSHSGHESRSGTASTHPPVGHHPTSRVPSVVANRSNVYSNNAAQGSPNMQMRSSAPMRWRATEEHIGKYKLIKTIGKGNFAKVKLAKHLPTGKEVAIKIIDKTQLNPGSLQKLFREVRIMKMLDHPNIVKLFQVIETEKTLYLIMEYASGGEVFDYLVLHGRMKEKEARVKFRQIVSAVQYCHQKRIIHRDLKAENLLLDSELNIKIADFGFSNEFTPGSKLDTFCGSPPYAAPELFQGKKYDGPEVDVWSLGVILYTLVSGSLPFDGSTLRELRERVLRGKYRIPFYMSTDCENLLRKFLVLNPAKRASLETIMGDKWMNMGFEEDELKPYIEPKADLADPKRIGKTEALVAMGYNRSEIEASLSQVRYDDVFATYLLLGRKSTDPESDGSRSGSSLSLRNISGNDAGANAGSASVQSPTHRGVHRSISASSTKPSRRASSGAETLRVGPTNAAATVAAATGAVGAVNPSNNYNAAGSAADRASVGSNFKRQNTIDSATIKENTARLAAQNQRPASATQKMLTTADTTLNSPAKPRTATKYDPTNGNRTVSGTSGIIPRRSTTLYEKTSSTEKTNVIPAETKARNNTALEYSGTSGASGDSSHPGRMSFFSKLSSRFSKRPTIADEAAKPRVLRFTWSMKTTSPLMPDQIMQKIREVLDQNNCDYEQRERFVLWCVHGDPNTDSLVQWEIEVCKLPRLSLNGVRFKRISGTSIGFKNIASRIAFDLKL

SEQ ID NO: 11484 - protein, 773 aa, Drosophila melanogaster
MNRRQDAHKAMQALKNHKLQGRAITISWAAGKGVKSKEWKDYWDLELGVTYIPWSKLSSDTDFDALEEGGMFDEDTMPIQMKQKINQAKNAAKEHKGASIAEAAGAPSVGVPPPNLIFGIDTTQPPPVGPVGPVGPPPGPGAPPPGLMGMVRGQFPMAPPMGINMPPPIMMPPTNMPPPMMMPTTNMPPPMMMPPTMMPPGFPGIGGPPHPMALPPGAPFPPPGAVPPPIPSGGQISNSGNVSDDQMDIEMDLEDAPPLPPQQQANFNPSPSNVDLSPAAMANEMFQQRDRERDRDNRDRSRGPGNSRWGGRDDVVEAAERWRAENGGGGGGPGSGLGPNAAFNEARARLNLNPIEHGMPRPDFMDFDNRGGPGGPRGMGPRGNHNGGGPGGDFFPPNMNHNRFNQPTSLMQMRIPPPASFNQRMGGPAGNGGNGVGPMFMRNQGGGPGGAGPSGGGPGGAGTGGGGPGGRQQGPGFFNPRNPFNDNQRGRGGQSGGGVRGVGGGGGGGPGGRGRWSDDEDEGGNNFKRRGGPGGPGGNRFRGERGGEMMDDRRGNNSRGGRGGPREDRERPGFGNRRGSRDDSNRHSISSTDEGNKAASETEPKPKNVETELGSTNTGAPAAATRVDTEEDWDQELQDYEARMEAQKPGERASQSANSPPQEKLPAENENFAKPADVTGDPLVAKSQTETSAACTPLYDELPPPAVPQTPTQPPKEPQGSPPRPAPPVIETEAAPHEESVPAPPAELQTEAPSAEEPIAPAASADVVAEADP

SEQ ID NO: 11485 - protein, 662 aa, Drosophila melanogaster
MSRSRSSAKAVQFKHESEEEEEDEEEQLPSRRMHSYGDAAAIGSGVPAFLAKLWRLVDDADTNRLICWTKDGQSFVIQNQAQFAKELLPLNYKHNNMASFIRQLNMYGFHKITSIDNGGLRFDRDEIEFSHPFFKRNSPFLLDQIKRKISNNKNGDDKGVLKPEAMSKILTDVKVMRGRQDNLDSRFSAMKQENEVLWREIASLRQKHAKQQQIVNKLIQFLITIVQPSRNMSGVKRHVQLMINNTPEIDRARTTSETESESGGGPVIHELREELLDEVMNPSPAGYTAASHYDQESVSPPAVERPRSNMSISSHNVDYSNQSVEDLLLQGNGTAGGNILVGGAASPMAQSVSQSPAQHDVYTVTEAPDSHVQEVPNSPPYYEEQNVLTTPMVREQEQQKRQQLKENNKLRRQAGDVILDAGDILVDSSSPKAQRTSIQHSTQPDVMVQPMIIKSEPENSSGLMDLMTPANDLYSVNFISEDMPTDIFEDALLPDGVEEAAKLDANQASTSKAAAKAQASEEEGMAVAKYSGAENGNNRDTNNSQLLRMASVDELHGHLESMQDELETLKDLLRGDGVAIDQNMLMGLFNDSDLMDNYGLSFPNDSISSEKKAPSGSELISYQPMYDLSDILDTDDGNNDQEASRRQMQTQSSVLNTPRHEL

SEQ ID NO: 11486 - protein, 374 aa, Rhodococcus ruber
MKTKAAVLRGVGQDWRIEEIELGDPVPGEVQVRLVASGMCHSDHHLRTGGSPIPFPVIGGHEGSGIVTKVGPGVTSLVEGDHVVTAFIPACGTCGPCSRGLQNLCDEGAGLLTGRSISDGTYRASAKGEPLVPMCLLGTFSPYITVNEASLVKIEKDIPLEAAALLGCGVATGWGSATAIGGTKVGDTVVVVGVGGVGINAVQGAAAAGARHVIAVDPVEFKRHMALALGATHVYASLEEAMEPVRDLTWGLMADVTVLTVGDIEGDIIQPALTITAKAGQVVVTAMGDATKNEVTLNLFELTLLQKRVQGAIFGGVGPRTQIPALLHHYRSGALKLEELATTVYRLEDVNQGYDDMLAGKNLRGIIRYTDADF

SEQ ID NO: 11487 - protein, 474 aa, Rhodococcus ruber
MTAGHFTELYINGSWVASTSKTVIEVLNPATEEVIGTVPDGTAADVDAAVAAARAAFDGWASTPVDKRAQYLRAIAAGIADRSDELARTISAEMGAPLSFAQAMQVPLPINSFSHAAAVAESFPFERTEGSSVIVREPIGVVGAITPWNYPLHQIAAKVAYALAAGNTIVVKPSEVAPLNAWMLAEIIDAAGVPAGVFNLVSGTGPVVGEALASHHEVDMISFTGSTNAGKRVSELAAQTVKRVALELGGKSANIVLDDADIDELMPNAVQWAMINSGQTCSALTRLLVPRAILTEAETAAKTIAEAYTVGAPDDPDTTLGPLVSATQLKRVRGYIDRGVQEGATLITGGSEPVEGLAVGYYVKPTIFSEVTPDMTIHREEIFGPVLSIAPYDTEEDAVRIANDSEYGLRGGVWSRDVDRARAVAARMRTGQVMINGGEFNPNAPFGGYKQSGTGREFGTHGLEEFLEIKSLQF

SEQ ID NO: 11488 - protein, 277 aa, Yersinia enterocolitica
MSQNTLKVNELHEDVNFDENSTETEIFDEKQLVEDEPTEASSAEDELLAQGVTQRCWSTQLYLGEIGYSPLLTAEEEVYFARRALRGDVPSRRRMIESNLRLVVKIARRYSNRGLALLDLIEEGNLCLIRAVEKFDPEPGFRFSTYSHWWIRQTIERAIMNQTRTIRLPIHIVKELNVYFGTARELSHKLDHEPSAEEIAEQLNKPVDDVSRMLRLNERITSVDTPLGGDSEKSLLDILSDENENGPEDTTQDDDMKQSIVKWLFELNAKQREVLAR

SEQ ID NO: 11489 - protein, 570 aa, Liriodendron tulipifera
MGALLFALNSLLLFSELAFATHTGSTWHYKFDVQLKSVKRLCNRKSILTVNGRFPGPKLVAREGDRVVVEVVNNVQNNVTVHWHGIRQLQNGWADGPSYITQCPIQTGQTYVYNFTIVGQRGTLFWHAHFSWLRATLYGPLIVLPMQNATYPFGKPDKEVPIIFGEWWNANTEAVINQSLQTGAGPNVSDAYTINGMPGPLYNCSAKDTFKLKVKPGKTYLLRLINAALNDELFFGIASHTITVVEVDATYVKPFNMKILLIGPGQTTNVLLKAKPYYPNATFFMSARPYATGLGTFDNTTTVGLLEYQRPNSSLSSTKLQIFKASLPALNDTAYAAKYSQRLRSLANAQFPANVPQTVDKHFFFTIGLSADPCPKNQTCQGPNGTKFSASMNNISFVLPTTALLQAHFFGQSNGVYNTTFPNNPLFPFNYTGTPPNNTFVSHGTKVVVIPFNTSVEVVLQNTSILGMESHLLHLHGYNFFVVGQGFGNFDPDKDPAKFNLVDPIERNTVGVPSGGWAAIRFRADNPGVWFMHCHFDVHLSWGLKMAWVVLDGKLPNQKLLPPPSDLPKC

SEQ ID NO: 11490 - protein, 585 aa, Liriodendron tulipifera
MVPLLQTSGPMAALLLALSTMLLFPEIARANQEGITRHYKFDIRLQNVTRLCHTKSIVTVNGQFPGPKIVAREGDRVVVKVVNHVQNNITLHWHGVRQLRSGWADGPAYVTQCPIQTGQTYVYNFTIIGQTGTLFWHAHISWLRSTLYGPIVILPKRGIPYPFIKPYKEVSIIFGEWFNVDTEAIITQALQTGGGPNVSDAYTINGLPGPLYNCSARDTFRLSVKPGKTYLLRLINAALNDELFFSIANHTLTIVDVDAVYVKPFDTNILLITPGQTTNVLIKTKPHYPNATFFMGARPYATGLGTFDNSTTVGLLEYQKPNSSHSSNAVGMKQLPLFRPSLPSLNDTAFAANYTKRLRSLANAQFPANVPQTINKSFFFTVGLGSEPCPKNQTCQGPNGTKFAASVNNVSFVMPTTALLQGHFFGQSNGVYTANFPTNPQFPFNYTGTPPNNTMVSNGTKVVVLPFNASVELVMQDTSILGAESHPLHLHGFNFFVVGQGFGNYNPNKDPSNFNLVDPVERNTVGVPSGSWVAIRFQADNPGVWFMHCHLEVHTSWGLKMAWVVLDGKLPNQKLPPPPSDLPKC

SEQ ID NO: 11491 - protein, 586 aa, Liriodendron tulipifera
MGLSLLPSSATIVAFLLALSSLFFLPELAHSKHARITRHYKFDIQMRNVTRLCHTRNILTVNGQFPGPKIIAREGDRVVVKVVNHVANNVTLHWHGVRQLRSGWADGPAYVTQCPIQTGQSFVYNFTIVGQRGTLFWHAHISWLRSTLYGPIVILPKRGVPYPFAKPYKSVPIIFGEWFNVDPEAIITQALQTGAGPNVSDAFTINGLPGPLYNCSAKDTFRLSVEPGKTYLLRLINAALNDELFFSIANHTLTIVDVDAIYVKPFDTDILLITPGQTTNVLLKTKPHYPNATFFMSARPYATGRGAFDNTTTIGILEYQKPNSSHPSNAIGIKDLPLFRPSLPGFNDTTFAANYTRRLRSLANAKFPANVPQTVDRRFFFTVGLGTQPCPNNQTCQGPNGTKFSASINNVSYVQPTTALLQAHFFGQSNGVYSTNFPTKPPFPFNYTGTPPNNTMVSNGTKVVVLPFNTTVELVLQDTSIQGAESHPLHLHGYNFFVIGQGFGNYNPNKDPSNFNLIDPVERNTVGVPAGGWVAIRFQADNPGVWFMHCHLEVHTSWGLKMAWVVLDGKLPNQKLPPPPSDLPQC

SEQ ID NO: 11492 - protein, 585 aa, Liriodendron tulipifera
MAPLLQTSGPMAALLLALSAIFLFPELSHAKHAGITRHYKFNIRLQNVTRLCHTKSIVTVNGRFPGPKIFAREGDRVVVKVVNHVQNNITLHWHGVRQLRSGWADGPAYVTQCPIQTGQTYVYNFRIISQRGTLFWHAHISWLRATIYGPIVILPKHGVPYPFIKPYKEVPIIFGEWFNADTEAIITQALQTGGGPNVSDAYTINGLPGPLYNCSARDTFRLSVKPGKTYLLRLINAALNDELFFSIANHTLTIVDVDAIYVKPFDTDILLITPGQTTNVLLKTKPHYPNATFFMSARPYATGRGTFDNTTTVGILEYQKPNSSHPSNAIGIKNLPLFRPSLPGLNDTAFAANYTRRLRSLANAQFPANVPQTVDRRFFFTVGLGTQPCPKNQTCQGPNGTKFAASVNNVSFVLPTTALLQTHFFGQSNGVYTTNFPTNPPFPFNYTGTPPNNTMVSNGTKVVVLPFNTSVELVMQDTSIQGAESHPLHLHGFNFFVVGQGFGNYNPNKDPSNFNLIDPVERNTVGVPAGGWVAIRFQTDNPGVWFMHCHLEVHTSWGLKMAWVVLDGKLPNQKLPSPPSDLPKC

SEQ ID NO: 11493 - protein, 379 aa, Xenopus laevis
MGCLGNSKTEDQRIDEKAQREANKKIEKQLQKERLAYKATHRLLLLGAGESGKSTIVKQMRILHVNGFNSEEKKQKSQDIRKNVKDAIVTIVSAMSTLIPPVPLANPENQFRIDYIKSIAPLSDFDYTQEFFDHAQKLWDDDGVKACFERSNEYQLIDCAQYFLERIDHVRQNDYTPTDQDLLRCRVLTSGIFETRFQVDKVNFHMFDVGGQRDERRKWIQCFNDVTAIIFVVASSSYNMVIREDNNTNRLREALDLFKSIWNNRWLRTISVILFLNKQDMLAEKVLAGKSKIEDYFPEYVRYTIPDDAVPDAGEDPKVTRAKFFIRDEFLRISTASGDGRHYCYPHFTCAVDTENIRRVFNDCRDIIQRMHLRQYELL

SEQ ID NO: 11494 - protein, 581 aa, Nicotiana benthamiana
MGNTCVGPSISKIGLFQSVSAAMWRTRMPDDSGSTTNGDSARGETAESSKDPNLVVPSKPPEQITMPKSDQKEEEPAKKEEGPEKPKKPVQMKRVGSAGLRTDSVLQKKTGNLKEFFSIGKKLGQGQFGTTFKCVEKATGKEYACKSIAKRKLLTDDDVEDVRREIQIMHHLAGHPNVISIKGAYEDAVAVHVVMEYCAGGELFDRIIQRGHYTERKAAELTRTIVGVLEACHSLGVMHRDLKPENFLFVNQKEDSLLKTIDFGLSIFFKPGDRFNDVVGSPYYVAPEVLKKRYGPEADVWSAGVIVYILLSGVPPLWAENEQGIFEEVLHGDLDFSSDPWPSISEDAKDLVRRMLVRDPKKRLTAHEVLCHRWVQVDGVAPDKPLDSAVPSRMEQFSAMNKLKKMALRVIAESLSEEEIAGLKEMFRMIDTDNSGQITFEELKVGLKRVGANLKESEIYDLMQAADVDNSGTIDYGEFIAATLHFNKIEREDHLFAAFSYFDKDCSGYITADELQQACEEFGIGDVHLEDMIRDADQDNDGRIDYNEFVAMMQKGNPVIGGGKKGLEHSFSTGFREALRL

SEQ ID NO: 11495 - protein, 193 aa, Calamus usitatus
TVVHSGCVAKINPLAPLDKVCVLSCGISTGLGATLNVAKPPKGSTVAIFGLGAVGLAAAEGARIAGASRIIGVDLNPARFDTAKKFGVNEFVNPKDYERPVQQVLAEMTGGGVDRSIECTGNVNVMISAFECVHDGWGIAVLVGVPHKEAVFKTHPINFLNERTLKGTFFGNYKPRTDLPSVVEKYMSKVLEV

SEQ ID NO: 11496 - protein, 193 aa, Phoenix reclinata
TVVHSGCVAKINPLAPLDKVCVLSCGISTGLGATLNVAKPPMGSTVAVFGLGAVGLAAAEGARIAGASRIIGVDRNPTRFDEAKSFGITEFVNPKDYDKPVQEVLAEMTGGGVDRSIECTGNINAMISAFECVHDGWGVAVLVGVPHKEAEFKTHPINFLNERTLKGTFFGNYKPRTDLPLVVEKYMNKELEL

SEQ ID NO: 11497 - protein, 456 aa, Streptomyces antibioticus
MSTRRPYQGAFTPVDQEVTAFDLPVTGRIPAELRGRYLRNGPNPLRLDDPRAHLFLGEGMVHGVRLRDGRAEWYRNRWVRSAAVARSLGEKPRRGTRFAGAEFAPNTHVIGHAGRTLALVENGFRPYELTEELETVGPCDFRGTLQAGYVAHPKLDPHTGELHAVSYATRWEFVQYSVISPTGMVTRTVNIPAPHRPVMHDFALTASYVVLYDLPVVNSLVAAAAGAPMVYDWQENRGARLGLLPRNGTEVRWFDISPCWVFHTLNAYEDGDRVVVDVIRYPRMFTGLRLDGNSTPTMDRWVIDTVSGRVTETRLDDRAQEFPGVNPAVVSGPHRYGYAAVVPDMHTYFGPDDDLDDLPDQAYSDALIKHDFSAGSSSVRPLGRGHYTGEPVFVATASPAAEDDGYLLAYVHDPDRGASDLVILSAQDFTGEPVATVHLPARVPLGLHGSWIADPA

SEQ ID NO: 11498 - protein, 125 aa, Castanea sativa
AHVLVPGISLMGGYDSLKPVLLTGDLADSFFASFALGWLITNGAGLASYPIDTVRRRMMMTSGEAVKYKSSLDAFSQILKKEGPKSLFKGAGANILRAVAGAGVLAGYDKLQLIVFGKKYGSGGA

SEQ ID NO: 11499 - protein, 239 aa, Carica papaya
PDTGGQVVYILDQVRALETEMLQRIKQQGLNITPRILIITRLLPDAVGTTCGQRMEKVYGTEYSDILRVPFRTEKGIVRQWISRFEVWPYLETSTEDVATEISKELQGKPDLIIGNYSDGNIVASLLAHKLGVTQCTIAHALEKTKYPDSDIYWKKLEDKYHFSCQFTADLIAMNHTDFIITSTYQEIAGSKDTVGQYESHSAFTLPGLYRVVHGIDVFDPKFNIVSPGADMSIYFPYT

SEQ ID NO: 11500 - protein, 203 aa, Gossypium anomalum
  unsure (1)..(203): unsure at all Xaa locations
GYTPLFPRILGHEASGIVESVGEGVNDLKPGDHVLPIFTGECKECRHCLSEESNNMCELLRINCDRXVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 11501 - protein, 203 aa, Gossypium somalense
GYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 11502 - protein, 203 aa, Gossypium longicalyx
GYTPLFPRILGHEASGIVESVGEGVDDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 11503 - protein, 203 aa, Kokia drynarioides
GYTPLFPRILGHEASGIVESVGEGVDDLKPGDHVLPIFTGECKECRYCLSEESNNMCELLRINCDRGVMLADGKTRFSINGKPIYHFVGTSTFSQYTVVHVGQVAKISPTAPLDKVCPISCGICTGFGATVNVAKPKKGQTVTVFGLGAVGLAAAEGARVCGASRIIAVDLNPRRFEEAKRFGITEFVNPKDYDKPVQEVIVE

SEQ ID NO: 11504 - protein, 144 aa, Gossypium anomalum
LGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGFTEFVNPKDHNKPVQEVIAEMTGGGVDCSIECTGSTQAMVSAFECVHD

SEQ ID NO: 11505 - protein, 144 aa, Gossypium longicalyx
LGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVIAEMTGGGVDCSIECTGSTQAMVSAFECVHD

SEQ ID NO: 11506 - protein, 144 aa, Gossypium bickii
LGTSTFSEYTVVHVGQIAQINPQAPLDKVCVLSCGMSTGFGATVNVAKPKKGGSVAVFGLGAVGLAAAEGARFCEASRIIGIDLNPNRFEEAKKFGSTEFVNPKDHNKPVQEVIAEMTGGGVDCSIECTGTTQAMVSAFECVHD

SEQ ID NO: 11507 - protein, 143 aa, Kokia drynarioides
LGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVIAEMTGGGVDCSIECTGSIQAMISAFECVH

SEQ ID NO: 11508 - protein, 501 aa, Virgibacillus pantothenticus
MNKSTLNNPVFYVSAFVVFLLVIIGATLPNRFGAVAEKLFHFTTIHFGWFYLLAVFVFVVFLITLSLSKFGKIKLGATLTKPEYSFFTWIGMLFSAGFGAGLVFWGVAEPMSHFFKTPFPAVEAMSEEAARVAMGYAFFHWGVSQWSVFAIVGLVIAYLQFRKKRRGLISTSIQPIIGKNKFIADTVDSLAVIATVMGVATSLGLGILQMNGGLKSVFDVPTSIWVQMAIAGVMLITYLISSSTGLDRGIKWLSNINLGSLFIIIVFVFMAGPTVFILNTFVLGLGDYFSNFIGYSLRLTPYTGDTWVREWTIFYWAWSTAWSPFVGAFIARVSRGRSIRQYVLGVLVVSPAIACIWIAAFGGTAVYNDLMNGTSIAEAVNADIAVALFETYQHLPMTTILSILSIFLIFTFLVTSADSATYILGVMTSRGSLNPTLVTKIVWGLLITAIAVVLLLAGGLEALQTASLISALPFTVILLLMMASFTRMLSKGEKKAEQDKE

SEQ ID NO: 11509 - protein, 494 aa, Arabidopsis thaliana
MVLTKTATNDESVCTMFGSRYVRTTLPKYEIGENSIPKDAAYQIIKDELMLDGNPRLNLASFVTTWMEPECDKLIMDSINKNYVDMDEYPVTTELQNRCVNIIARLFNAPLEESETAVGVGTVGSSEAIMLAGLAFKRKWQNKRKAEGKPYDKPNIVTGANVQVCWEKFARYFEVELKEVNLSEGYYVMDPDKAAEMVDENTICVAAILGSTLNGEFEDVKRLNDLLVKKNEETGWNTPIHVDAASGGFIAPFIYPELEWDFRLPLVKSINVSGHKYGLVYAGIGWVVWRAAEDLPEELIFHINYLGADQPTFTLNFSKGSSQIIAQYYQLIRLGFEGYKNVMENCIENMVVLKEGIEKTERFNIVSKDQGVPVVAFSLKDHSFHNEFEISEMLRRFGWIVPAYTMPADVQHITVLRVVIREDFSRTLAERLVADISKVLHELDTLPSKISKKMGIEGIAENVKEKKMEKEILMEVIVGWRKFVKERKKMNGVC

SEQ ID NO: 11510 - protein, 428 aa, Arabidopsis thaliana
MTKQIGGPMHQLAAKVDEYARGMISGTGSSLFEELGLYYIGPVDGHNIDDLVAILKEVKSTRTTGPVLIHVVTEKGRGYPYAERADDKYHGVVKFDPATGRQFKTTNKTQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEADLFNMVATAVAIDDRPSCFRYPRGNGIGVALPPGNKGVPIEIGKGRILKEGERVALLGYGSAVQSCLGAAVMLEERGLNVTVADARFCKPLDRALIRSLAKSHEVLITVEEGSIGGFGSHVVQFLALDGLLDGKLKWRPMVLPDRYIDHGAPADQLAEAGLMPSHIAATALNLIGAPREALF

SEQ ID NO: 11511 - protein, 161 aa, Arabidopsis thaliana
MTPSPVSGHSSIPADSNNGSRISPGPSPSRSSQSPKSPEASSLPEAIKSKLAAASAKYKESISKSKQGLKEKLLARNNSVKELSKGVQREMNAGIAGVARMIERMDFSSKRFGGSAHVSTSTATASGFNFSFKGKRVEANSKSNNNGDKTEPQKLQGGETC

SEQ ID NO: 11512 - protein, 485 aa, Arabidopsis thaliana
MALLVEKTSSGREYKVKDMSQADFGRLEIELAEVEMPGLVSCVAEFGPSQPLKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKNGTFPDPTSTDNPEFQIVLSIIKDGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMLGLETYPGVKRITIKPQTDRWVFPDTNSGIIVLAEGRLMNLGCATGHPSFVMSCSFTNQVIAQLELWNEKSSGKYEKKVYVLPKHLDEKVAALHLGKLGARLTKLTKDQSDYVSIPVEGPYKPVHYRY

SEQ ID NO: 11513 - protein, 256 aa, Sinorhizobium meliloti
MYDAPFYKGSDKLKDKVALITGGDSGIGRSVAVLFAREGADVAIVHLDESQDADDTKAAVEKEGRKCLVIKGDVKDASFCRKAVEKTVMQLGRLDILINNAAFQVHTRDIEDLTDEHFDETLKTNLYGYFYMAKAAIPHLKNGSAIINTGSVTGLTGSKELLDYSMTKGGIHAFTRALSGHLVPKGIRVNAVAPGPVWTPLNPSDKEAEDVEKFGSQTPMKRAAQPEEIAPAYVFLASPQMSSYITGEILPIVGGY

SEQ ID NO: 11514 - protein, 504 aa, Sinorhizobium meliloti
MLSNFIAPDSNDPRLRIKSRYQMLVDGKSVDAASGSTIDRVSPGHAGEVVGTWPEASADDVRKAVAAARKAFDAGPWPRMSGAERSRLMFKVADLILARQEELALIESLEVGKPIAQARGEIGFCADLWSYAAGQARALEGQTHNNIGDDRLGLVLREPVGVVGIITPWNFPFIIASERVPWAIGSGCTVVLKPSEFTSGTSIRLAELAREAGIPDGVFNVVTGYGDPAGQVLAEDPNVDMVAFTGSVRVGTKLGEIAARTVKRVGLELGGKGPQIVFADADLDAAADGIAYGVYHNAGQCCISGSRLLVQEGIRDALMERLLDISRKVAFGDPLNERTKIGAMISEAHAEKVHSYVTAGITSGAELLLGGERIGREAGLYYAPTVFAGVTPDMSIAREEIFGPVLSTLTFKTADEAVALANATEFGLSASVWSTNLETALQTIRRIRAGRCWINSVIDGTPELPIGGYKKSGLGRELGRYGFDEYSQFKGVHVTLGRPAPWFT

SEQ ID NO: 11515 - protein, 253 aa, Sinorhizobium meliloti
MSKRFDGKVAIVTGGGSGIGAAIANRLLEEGASVMMSGRTEKRLSDVASKMPADRSGIFVANVSSRPDCDALVAATVERFGRIDTVVNAAGMNFVGTIQETSDQDWDECIASDLSGVFYMSRAAVPHLKETKGSIVNIGSVSSLGGGWSHAAYNAAKGGVANLTRSAACDLGKFGVRANTVAPGLTVTGMVEAIMDDDALLEKAWDRIPLRRAGQPASAVAFLASDEAAWITGIVLPVDGGQTCTDGGPEWGK

SEQ ID NO: 11516 - protein, 258 aa, Sinorhizobium meliloti
MSTSNILDGKVVIVTGASSGIGRAIAIRAAEHGAKAVIVSDVVEAPREGGEPTASEIRKLGAESVFVKADVSRKVDNDALVAAAEEFGGVDVMVANAGITLKTDGAEVPEDDYRRLMSVNLDGPLFGAQAAARQMKALNKQGSIVLMASMGGISGAGITVAYSTSKGGVVLMAKSLADALGPDGIRVNAVAPGTIDTELLRTSPGIAQASEGFRQRTPLRRLGKPAEVGDAVAFLGSDLSSYVSGTALLVDGGLLAVI

SEQ ID NO: 11517 - protein, 257 aa, Sinorhizobium meliloti
MSSLFSNKVVTVTGAGSGIGRAIALGLARDGATVHLADRDADGLTQTAELIRAEDGRAFTTELDVASELQVVGWIEQIGSTSGRLDAAFNNAGITGPAKRIEDYPLEDFQRVIAVNLQSVFLGMKYQIPLIKRNGGGSIVNTASIAALTGPGGMSAYAASKHGVQGLTRVVAMENAAHGIRVNAIAPGWTETPMVAANSQQNPAFAALAQNAIPAKRGGKPEEIAAAAIWLASDAASYVTGHMLTVDGGMTIGGFEL

SEQ ID NO: 11518 - protein, 298 aa, Sinorhizobium meliloti
MSHISTADIEQVILPSSRDLGGFSVRRALPAPMRQMVGPFIFLDSFGPVRFGEGEGIDTRPHPHIGLSTLTYLLEGELTHRDSERYVQAIRPGEVNVMVAGAGIVHSERTPEHQRATGGKLAGLQSWIALPKKSEETAPLFQHLDAGSLPTVSGEGIGMKLLAGNLHGRQSPATVFSDLFAAEVHLEAGARYRIDGEHVERAIFVVAGALEIVGQDGNFGQDRLLVFKPGSEIVVKATGPARFLAFGGEPLPEKRFIRWNFVATDQERIRHAADLWRERGFPGVPDDDEFIPLPENFR

SEQ ID NO: 11519 - protein, 226 aa, Sinorhizobium meliloti
MAEAGAHVAVTARTVEGLAETRALIEKTGRRAVALAQDVRDVEACASVTRAAAEGLGGLDILVNNAGFENVRPSFDVDEALWDTIVSTNLKGAFFCAQAAGRIMADANGGAIVNLCSLTSYVGIPTAVPYGASKSGLLGVTRALATEWAAHNIRVNAIAPGYFRTAMTAGFYEDEDWQSRMLEKIPQRRFGKESDIGGVAVFLCSDAAAYITGHCIPADGGYLASI

SEQ ID NO: 11520 - protein, 251 aa, Sinorhizobium meliloti
MSTELFDLTGKRALVTGSSQGIGYALAKGLAATGAEIILNGRDAAKLAAAARDLGAGHTLAFDATDHQAVRKAVDAFEADVGAIDILVNNAGMQHRTPLEDFPADAFERLLKTNVSSVFNVGQAVARHMIKRGAGKIINIASVQTALARPGIAPYTATKGAVGNLTKGMATDWARYGLQCNAIAPGYFDTPLNAALVADPSFSDWLERRTPAGRWGKVEELVGACIFLSSDASSFVNGHVLYVDGGITASL

SEQ ID NO: 11521 - protein, 245 aa, Sinorhizobium meliloti
MFELTGRKALVTGASGAIGGAIARVLHAQGAIVGLHGTQIEKLETLATELGDRVKLFPANLANRDEVKALGQRAEADLEGVDILVNNAGITKDGLFLHMADPDWDIVLEVNLTAMFRLTREITQQMIRRRNGRIINVTSVAGAIGNPGQTNYCASKAGMIGFSKSLAQEIATRNITVNCVAPGFIESAMTDKLNHKQKEKIMVAIPIHRMGTGTEVASAVAYLASDHAAYVTGQTIHVNGGMAMI

SEQ ID NO: 11522 - protein, 258 aa, Sinorhizobium meliloti
MSRGSTSTIAVVTGGTSGIGLATARHLLERGNRCAIFGQRPINVESAAEALSQDFGSERVFARSVDLAEPTQITSFFRELDERWGRAEILVCNAGISPKGPDGPTPFQEITLEEWNAVLSVNLTGTMLCCQAALPGMVAQNFGRVVLVGSIAGRALPKIAGTAYVASKAALAGFARSLIARYAGQGITVNVVAPGRIATEMAGPRDSLVNRAAVARIPAGRMGEPEEVAAAIGFLTSDKAAFINGAIIDVNGGEFVPL

SEQ ID NO: 11523 - protein, 449 aa, Sinorhizobium meliloti
MFNRRQLLGASAALVSTAAWAKTSNMGLPDAAVMETAETQGPLKPTSGPDYNPVVTLNGWTLPHRMNNGVKEFHLVAEPVEREMAEDMTAYLWGYNGQSPGPTIEAVEGDRVRIFVTNKLPEHTTIHWHGMILPSGMDGVGGLSQPHIPVGKTFVYEFDLVKSGTFMYHPHSDEMVQMAMGMMGFFVIHPKDPKFMPVDRDFVFLLNAYDIDPGSYVPRIMEMTDFNMWCWNSRIFPDISPLVVSKNDRVRVRVGNLTMTNHPIHMHGYDFEVTCTDGGWVRPEARWPEVSIDIPVGAMRAYEFDAKYAGDWAIHCHKSHHTMNAMGHDIPTFIGVDKSKVAEKIKKLRPEYMPMGTKGMADMGEMEMEIPENTIPMMTGWGPHGPIEMGGMFSVVKVREGISAGDYADPGWYENPPGTQAWEWTGELPDWTKAKDAKTQITPKHKNHG

SEQ ID NO: 11524 - protein, 403 aa, Sinorhizobium meliloti
MLTQKTKDIVKATAPVLAQHGYAIIQHFYKRMFQAHPELKNIFNMAHQERGEQQQALARAVYAYAANIENPESLSAVLKDIAHKHASLGVRPEQYPIVGEHLLASIKEVLGDAATDEIISAWAQAYGNLADILAGMESELYERSEERAGGWAGWRRFIVREKNPESDVITSFVLEPADGGPVADFEPGQYTSVAVQVPKLGYQQIRQYSLSDSPNGRSYRISVKREDGGLGTPGYVSSLLHDEINVGDELKLAAPYGNFYIDVSATTPIVLISGGVGLTPMVSMLKKALQTPPRKVVFVHGARNSAVHAMRDRLKEASRTYPDFKLFIFYDEPLPTDIEGRDYDFAGLVDVEKVKDSILLDDADYYICGPVPFMRMQHDKLLGLGITEARIHYEVFGPDLFAE

SEQ ID NO: 11525 - protein, 277 aa, Sinorhizobium meliloti
MGGPMSVYFEKSYQRGFGTYPLKGEPLKAAVREAITVGYRAFDTAQMYGNEAETGEALAESGLARDELCITTKVHPDNYSEEAFLPSVEASLKALRVDQADVLMLHWPEINGENARSLRLLQKAFDIGLARNIGVSNYTAPMMREAQSIVEAPLVTNQVEFHPLIDQSRLLDAAEETKIALSSYCSVARGEVFKHPVFAEIGARYGKTAAQTVLRWILQKGVSMNTMSTKPENIRANFEILDFALSPHDMKRIDAMNATNYRILKAGMLPWVPDWDR

SEQ ID NO: 11526 - protein, 498 aa, Sinorhizobium meliloti
MDQLNNFLSPPAAPRDFGFFVDGKWQSGHDFFVRHSPGHGVAVTRTAKCSVDDLNAAVAAARRAFEDRRWSGLPGGSRASVLLRVAEILRTRRDELAYWETLENGKPIAQARGEIDHCIACFEVGAGAARLLHGDSFNSLGDGLFGMVLREPIGVVGLITPWNFPFLILCERVPFILASGCTMVVKPSEVTSATTLILAEVLAEAGLPDGVYNVITGSGRTIGQAMSEHPDIDMLSFTGSTAVGRSCVHAAADSNFKKLGLELGGKNPIIVFADSDLEDAADGAAFGISFNTGQCCVSSSRLIVERSVAREFEALLAEKMKRIRVGDPLDETTQVGAITTEAQNTTILDYIAKGKTEGAELVTGGTAIDLGRGQYIAPTLFSGVSREMAIARDEIFGPVLCSMTFDTVEQAVELANDTVYGLAASVWTKNIDKALTVTRRVRAGRFWVNTMMAGGPEMPLGGFKQSGWGREAGMYGVEEYTQVKSVHVEIGKRTHWIS

SEQ ID NO: 11527 - protein, 256 aa, Sinorhizobium meliloti
MYQASKESAPMTEECRYMLLTGASRGIGHATVKLFQSKGWRILTVSRQPFAEECAWPSARESHIQADLADLTQIDRLAATVRERLPNGRLHALVNNAGISPKGPGKNRLGVLDTDADVWTQVLNVNLVSTALIARALMSELEAAKGSIVNVTSIAGSRVHPFAGVAYAASKAALASLTREMAHEFGQRGVRANAIAPGEIETSILSPGTDELVAAEVPMRRLGEPREVAETIFFLCTEPSSYINGAEIHINGGQHV

SEQ ID NO: 11528 - protein, 375 aa, Sinorhizobium meliloti
MDARAAVAIQAGKPLEVMTVQLEGPRAGEVLVEVKATGICHTDDFTLSGADPEGLFPAILGHEGAGIVIDVGPGVTSVKKGDHVIPLYTPECRACPSCLSRKTNLCTAIRATQGQGVMPDGTSRFSLNGDKIHHYMGCSTFSNFTVLPEIALAKVNPDAPFDKICYIGCGVTTGIGAVINTAKVEIGATAIVFGLGGIGLNVIQGLRLAGADMIIGVDLNNDKKPWGEKFGMTHFVNPKEVGDDIVPYLVNLTKRGADQIGGADYTFDCTGNTRVMRQALEASHRGWGKSVIIGVAGAGQEIATRPFQLVTGRTWMGTAFGGARGRTDVPKIVDWYMEGKIAIDPMITHTMPLDDINKGFELMHSGESIRSVVLF

SEQ ID NO: 11529 - protein, 494 aa, Sinorhizobium meliloti
MQNLPKLSMYIDGQWVAPASGEYIETVDPFTARPWALVPRGNAEDADRAVRAAHRAFSQGPWGKMHPTERGRIIQRFAALIEEHADALADIEVRDNGRLLAEMTHQIRYIPRWYHYYAGFADKIEGTLHPCDKPALSFSRHEPLGVCVGIVPWNAPLLLFSLKAAPALAAGNTLVMKPAEFTSATALKLMELVEKAGFPTGVINVVTGYGPEVGEPLVTHPLTRHVGFTGSTKTGAHLYSLAAKDVKRVSLELGGKSPNIVFGDADLDNAVRGVVGGIFGAVGQTCIAGSRLLVHRSIHDEFLEKLAVFTKTARIGDPRKVETQIGPIANSMQFEKVLGYIDIARREGAELILGGGRPDLEECGTGYFIEPTIFAGVSNDMRIAREEVFGPVLSAIVFDEPEEALAIANDSEFGLGAGVWTSDMRLALKMSERLEAGSVWVNTYRDISYTTPFGGYKKSGIGRENGVAGIYEYLQTKAVWLSTAEEIANPFVIG

SEQ ID NO: 11530 - protein, 198 aa, Sinorhizobium meliloti
MARDMRVRWALEEVGQPYGVRLLSFKAMKEPAHLALHPFGQIPTYQEGDLALFESGAIVFHIAERHAGLLPDDANARARAITWMFAALNTVEPPIVDREVAEYLEDETWYEQRLPFIDERIRKRLGELSGRLGNADWLDGAFSAGDLLMVTVLRRLEGSGILEEYPNLSAYVARGKARPAYKRAFVAQLAVFTAAPTA

SEQ ID NO: 11531 - protein, 203 aa, Sinorhizobium meliloti
MKLYHHPLSGHAHRARLFLSLLGIEHELVVVDFARREHKQADFLKLNSFGQVPVLDDAGTIISDSNAILVYLAKKTGRPDWLPEDAVGAAAVQRWLSVAAGQIAHGPAQARLINVFKAPYRPEEVIPRSHAILALIEQELEGRGWIAADRPTIADVALYSYVARAPEGDVDLQPYPEIRAWLARIEALPGFVEFEKTPVGLAA

SEQ ID NO: 11532 - protein, 285 aa, Sinorhizobium meliloti
MEKFPHPPFPRQTQEMPGTTDRMQPLPDHGENSYQGSGRLKDKRAIITGGDSGIGRAVAIAYAREGADVLISYLSEHDDAMATKALVEEAGRKAVLAAGDIQSSDHCRRIVETAVRELGGIDILVNNAAHQATFKNIEDISDEEWELTFRVNMHAMFYLTKAAVPHMKKGSAIINTASINADVPNPILLAYATTKGAIHNFSAGLAQMLAERGIRVNVVAPGPIWTPLIPSTMPEDTVADFGKQVPMKRPGQPVELASAYVMLADPMSSYVSGATIAVTGGKPFL

SEQ ID NO: 11533 - protein, 375 aa, Sinorhizobium meliloti
MRTRAALAVQAGKPLVVTEVELEGPRAGEVLVEVKATGICHTDDFTLSGADPEGLFPAILGHEGAGIVVDVGPGVTSVKKGDHVIPLYTPECRSCPSCLSRKTNLCTAIRATQGQGLMPDGSSRFSINGDKIHHYMGCSTFSNFTVLPEIALAKVNPDAPFDKICYIGCGVTTGIGAVINTAKVEIGATAIVFGLGGIGLNVIQGLRLAGADMIIGVDLNNDKKPWGEKFGMTHFVNPKEVGDDIVPYLVNLTKRGADQIGGADYTFDCTGNTKVMRQALEASHRGWGKSVIIGVAGAGQEISTRPFQLVTGRTWMGTAFGGARGRTDVPKIVDWYMEGKIEIDPMITHTMPLEDINKGFELMHSGESIRSVVLY

SEQ ID NO: 11534 - protein, 349 aa, Sinorhizobium meliloti
MSGATLEAYLASCTARGDDLSRDVAAVIQRLAKAALDIRKLVNQGALGTAFNGTHGGSNTDGDLQKDLDILCDDQFLTCLQGAPVACYASEELENPVLLDPSARLAVAIDPLDGSSNIDNNVSIGTIFSVLPAAKGPDVDPSQSFLQPGNRQLAAGFFIYGPQTALVLSLGKGTEIFIFSSRLGCFVEAYKSAIIPERAHEFAINMSNYRHWEEAIRLYVDDCLAGSEGPRERDFNMRWIASLVAETYRILIRGGIFLYPADGRKGYSQGRLRLVYEANPIAFIIENAGGAATTSIDRILDLVPENLHQRVPLVFGSRREVARITRYHVDPNMIGERAPLFGKRGLFRA

SEQ ID NO: 11535 - protein, 621 aa, Sinorhizobium meliloti
MQTAILSGFGWLYLLSVAVFLFSMLFLAFSRYGELKLGPDDSEPEFRYLSWIAMLFAAGMGIGLMYFAVGEPMTHFASPPEAEPLTIAAQREAMSVTFFHWGVHAWAIYSVVGLSLAYFGYRYNLPLTVRSGLYPLLKEGIHGPIGHVVDIFAICGTMFGLATSLGFGILQINSGLNYLLGIPQSIYVQLLLVTVVTAIATISVVTGVEKGVRILSETNLFLAVLLMLFVLVVGPTGTLMRDFVQNIGLYLDSLVLRTFNIYAYEPRPWIDSWTLFYWAWWISWSPFVGMFIARISRGRTVREFVTAVLFVPAMFTFLWMTVFGNTAIYVDTTIANGELARDVKADLSVALFQFFEYLPWPAVTSTLAVLLVSIFFVTSSDSGSLVIDTIASGGETATPALQRIFWCSLSGIVAAVLLSTGGLTALQSATISTALPFSLVMLILVWSLFVGMRADLARTQSPGSLGPRAYPASGVPWQRRLAMTLSTPDRRAVEKFLQASVLPALEAVARELTRRSRPASVGRDAETGALTLTVPAEGHRDFVYGVQMSEHKLPAFTAYDATVADVRYEARTFFSDGSRGYDIMGMADNQIINDVLFQFERYTGFVRSPESSLLATSPEER

SEQ ID NO: 11536 - protein, 917 aa, Sinorhizobium meliloti
MSALGHELRSTEAARPAKRLDSRITDLPISARVAALTAAGLISLVLSSLFLTQALYRSAERMAETRELFDRAASAASAHVAFGDLRYWLTDLSVSLLMNSQRNADEARERLQEQLAGLAKHAPEAVEAIRTEVDAYVETALQAADSYTQDNRIVGNALLAKARTHSGKVDADLNRLVEQVKAEAEAARNEVVVQTEKTATTAAILVGGVVLIGSLLTLLVLRSIVGPLRRLNRVIGDLTEGRYDVDIPEEGGDELGAMARTLSLFRESAIEKKKLEDEAERQRRTIAAALEVISDGFVLYDSEDRILVANSKYCEIFPSHKPNTLRGRSFREIVEQNLEMGQVDLEGKSPQEWVDERVRLHRDPAGLVDEKRFGDKWVRISKRKIPDGGTVAVYTDITQLKQRQVELERAKSHAESANEAKSRFLASMSHELRTPLNAIIGYSEMLIEEARDHEDEELVPDLDKIASAGRHLLSLINDILDLSKIEANKMEVFLETFSVADLLRDVAATVAPLMARNGNEFTQDFEADLGEMHSDQTKLRQNLFNLLSNAAKFTNGGRVTLRVRREQRPDRDWLVFQVTDTGIGMSPEQQERLFNAFTQADASTTRNYGGTGLGLSITRSFCRMIGGVVTVESEVGKGSVFTMEVPAQCEREADGSPAEPVPQVGSGRTALIIDDEPAARSLIAKALAEAGLASIEASNGQEGLAAARKHRPDAIILDIIMPHQDGWSVLRALKNDPELCTIPVILATILADRELGLSLGAVEYLTKPIDTDKLVRTIETFGGGKHDVLVVDDDQASREFLRRILVKRKWTVHEAGDGIRGLEMMKRILPRLVLLDLLMPEMDGFQTLSEMQRIPELQNIPVVVVTSKDLSASELKWLRDRAVAVVNKGANSRSQLVAALERQIGSGASVGKALADG

SEQ ID NO: 11537 - protein, 520 aa, Sinorhizobium meliloti
MTAGNDFQHQAIAAHVAQRLAGPARAILGFQELLVEQARDLGLIHIKGDLDRIGAAARQLNGFIDRLLEGAACPLEEGEAEAEARLRHDLRTPLNAIIGYSEMILEEASDAPEHALKEDLHVILSAAAELLTQVDAIASLSRGETVEMLQPGERAEIDAAGLERLLFKAQEVACPEQGGRILVVDDVASNRDLLSRRLRREGHRVVTAESGLSALARLAEDEFDLILLDILMPDMNGIEMLSRLKSEERWQHVPVIMISGLSDVTAVARCIEAGADDYLTKPFNPILLRARINSTLEKKRWLDREHRYLQQIKTEKLRADSLIRAILPDQIVARLQDGEEIIADRFDEVSILFADIVGFSPIAASLTASDLVRRLDRMFRRFDLLTEQHRVEKIKTIGDAYMAACGIPEPAPDHADRIVALGKSMLRSLQDMEAGPDRFRVRIGIHTGPVVAGLIGRLRFVYDVWGETVNIASRLESQGVADVIQISEATRRALRGPWTLERRCALELRGIGAVETYLVR

SEQ ID NO: 11538 - protein, 208 aa, Sinorhizobium meliloti
MMKLYGLGPTRSLRARWALQELDAEFEFVAVNILAGEAHHPDFLRLNPAGKLPVLVDGDFVLTESAAIVMYLAEKYGGKGLMPADLKERAQAYRWSLFAVTELEQPLWRMAKHTFLYPEEKRLPEDIALAKEEFLAMAAVLEQHMKGREFIVGDRISIADCVTAYVLDWGNENGLLDDFPNLRAYLERMYARPKAPQRIAEAFASLQS

SEQ ID NO: 11539 - protein, 259 aa, Sinorhizobium meliloti
MSDRLKGKRIMVTGAAQGIGLAIAEAFLSERAALFLLDRDGPLLEKEAKRLQRQGQSLAYAEADITDAEAIESTLSAAASSIGPINALVNNAGVNVFSEPLEMSNADWQRCFDINLRGAWNCCKAVLPSLIEQGGGAILNIASTHAFTIIPHTFPYPVAKHALIGMTKALGIEYASKGVRVNALAPGYVLTQKAYDYWNSFPDPAAAEAATLKLHPGGRIATAEEIARAAVFMISDECPFMNATCLTVDGGLSVLHHPA

SEQ ID NO: 11540 - protein, 416 aa, Sinorhizobium meliloti
MKLVYVGQPYDRLFPPVQNSIGLIVYNTALHLSNSLHITVYGRHYRDDRVPADLPFALRRAPVRRDRLLQKVIREFPRPARWTQLDRKADDHSQYRNEIRRYLALDRPDVVHLMNYWKWSRALKPPGSSHRLVLEMQCEWLSQRDRDQVASQLEVVDAVVAVSDHIAETFRSAFPDYPGAVASVGNGVDVFHFRPSEAGASGDARTGRVILFVGRISPEKGLHTLVEAFSEVALRFPDVELRIAGPYSPLPVDFLTSLSSDPRVLDLKRFYDQWNRCRYQQHLDELMDRHRLRHRIRFLGNVSHKELVAAYHDADIVVNPSLSESFGISVVEGMACGIPVVGTRVGGMCESILDGHTGMLVEADAPGELSQALITVLDDPARARGMGTEGRERAVALYSWEARAERLRSVYERVSR

SEQ ID NO: 11541 - protein, 258 aa, Sinorhizobium meliloti
MPKSVAIVTGAAGDIGRAIAARLGDGHDTVLVADINTEAAERTARELGGTERFLAVPCDVTDVASVAAMAQAAASVGTVRTLVNNAGAARAVSLHDTTQDIWRMDNALNLEAAFLCFRAVEEMLKESRGSVVNIASVNGMNVFGHPAYSAAKAGLLHLTRLIAVEYGKFGIRANAVAPATVRTQAWEARAAANPQVFEEAKRWYPLQRIVDPKDVAEAVHFLASPAAGAISGICLPVDCGLTAGQAEVARTFSQSIHY

SEQ ID NO: 11542 - protein, 254 aa, Sinorhizobium meliloti
MSVPSRFSLAGRRVVVTGANTGIGQGIAVSIARAGGTVIGVGRSAMDETEKKVTDAGGTFIPAHADLADREATRSLIDGLWNAHGPLQGLVNNAGIIRRADAVDFTEADWDDVIDVNLRSLFFLSQAFGRRIIAEESRGKIVNIASLLSFQGGIRVASYTASKHGALGITRLLACEWAAKGINVNAVAPGYVVTNNTEALRADEKRSASILERIPAGRWGTPDDIGDAAVFLLAPASDYMHGAVVPVDGGWLAR

SEQ ID NO: 11543 - protein, 258 aa, Sinorhizobium meliloti
MTKTAVITGSTSGIGLAIARTLAKAGANIVLNGFGAPDEIRTVTDEVAGLSSGTVLHHPADMTKPSEIADMMAMVADRFGGADILVNNAGVQFVEKIEDFPVEQWDRIIAVNLSSSFHTIRGAIPPMKKKGWGRIINIASAHGLVASPFKSAYVAAKHGIMGLTKTVALEVAESGVTVNSICPGYVLTPLVEKQIPDQARTRGITEEQVINEVMLKGQPTKKFITVEQVASLALYLAGDDAAQITGTHVSMDGGWTAQ

SEQ ID NO: 11544 - protein, 306 aa, Sinorhizobium meliloti
MLARLAPAIFVLLWSTGWVVAKYAAIFADPLIFLALRYSFAILLFIGFCLLSGARWPRSATAIGHAVVSGIFLHGLYLGAVWWAIGQGVPAAISGIIAGLQPLMTAAVAPWLIGEKLAGQQKLGLILGFCGIALAVAPKMLTIDATATPIHLLPLAVNVLGMAAVTYGTLYQKRYLQTGDIRSIAALQYVGALLVTIPLALMLEDLRVTWNIELVAALAWSVLGLSMGAIALLLYLIRRGQVSRAASLIYLVPPLAAGEAALFFGEALTWPMIIGTVIAVTGVYLTNRKAAGGTAASEPAKEMPAV

SEQ ID NO: 11545 - protein, 268 aa, Sinorhizobium meliloti
MMDGASNAAPRIRGLPALFDLSGRVALITGSSGGLGLTMAHALCEAGASVILNGRDEARLAGARAELEEHGFTVGTSAFDVTKSAEIGRAVADILAERGRIDILVNNAGIQHRTPLHEFPEDAFRRVIETNLTSAFLVGQAVVQGMIERREGTIINICSVQSELARPSIAPYAASKGGLKMLTKGMALDWGRYGIRVNGLAPGYFKTELNSALVSDEKFSTWLEQRTPLGRWGDTGELAAAAVFLASAASSFVTGHILYVDGGITSCL

SEQ ID NO: 11546 - protein, 298 aa, Sinorhizobium meliloti
MTHQPISLSAPRHHRLLWPMMATLLVVGWSSGFVGIRYASEEAGVMLVLFWRTLLSGVILLPFALTIGPLLRMRGIAEQMLFGVMSVFLYLGGFALAIEQRVPTGLVALISDLLPLAIAALSQPVLGERLSARQWFGTAIAVFGVLIVSFDSLSFGAAPLWAYGLTVGSMLVFALASVLHKRRRTQHMPVHQSLCIHTLTGSVLFGLCAMMQGDLAPPLTRAFAVGMVWLVLIATFAAYSIYYTSLRLFPVAQVSAAIYLSPPVTMLWAWALFSEPLTAATFIGLTATLVGVWMTSRS

SEQ ID NO: 11547 - protein, 249 aa, Sinorhizobium meliloti
MFDLSGKAALVTGGGRGLGLEMAKALAGAGAWTVINGRNGQGLEEARKRLKGDGIEIGIAAGDITRDAPAIIAAAVEKTGGLDILIHAVGERDRRGTEAMEPHEFAALLNTDLTAAYAVAKTALPYLRRSAAGRLIFVTSIAAFAARAGDPAYTAAKGGLAALTRSLAVELGADNLTVNAIAPGWFATETNAHLAADPALKAFVDIRIPLKRWGRPEEIAPAAVFLASPAASFVNGITLTVDGGMTVQM

SEQ ID NO: 11548 - protein, 1126 aa, Sinorhizobium meliloti
MAARQRIIPVRREYNRWVANQTLEDYALRFTAKSARRFSSARISQTAIGAISFLALEAIGGAITMSYGTTNAIVAILVASLMILIVGLPISRYAIRHGVDIDLLTRGASFGYIGSTITSLIYASFTFILFAIEASIMSGALELALGIPLWIGYIVSAVMVIPLVTHGVKLISRFQLVTQPFWIVLNVLPFAFIAFADWEKVGLWLAYAGIHHTSGPPGTLASFHLVEFGAASAVIFALTAQIGEQVDFLRFLPPDGERKLRHRIAVFLAGSGWVIVGAPKLLAGSFLVVLALSTGVPSTRAADPAQMYYTAFGYIFPSDTAALLLMAAFVVVSQLKINVMNAYAGSLAWSNFFSRLTHSHPGRVIWLVFNVAIALLLMELGIYRLLEETLGIFSIVAMAWLSTISADLFVNKPLGLAPPGIEFKRAHLYDINPVGLGTMGVSTLFALVAHFGAAGEIAASLAPYIALVTAFVVSPLIAWWTEGKFYLARKPRKSWLAESEITCSICEHPFEPEDMAWCPAYAAPICSLCCSLDSRCHDMCKPKARLNTQVATVAKAVLPETVVAKLATRLGRYAISAVISITGIGVILAMIAHQTTAASPETAEVVERTIAIVFFVFAILAGVVSWFYVLAHDSRVVAEEESSRQNTALLKEIAAHKKTDAALQDAKERAESANRAKSRYVVGLSHELRTPLNAVLGYAQILERDETIPPPRQGAIKAIRRSADHLSGLIDGLLDISKIEAGKLQVYSNEINIQDFLDQIVDMFRPQAQAKGIAFEHNRAASLPQYVRTDDKRLRQILVNLLSNALKFTERGHIRFDVAYRSQVASFTIEDSGRGISEKDLPRIFEPFQRGEAEYRMPGLGLGLTITRLLTQTLGGEISVTSEKDKGTAFKVRLMLSAVDRPAALKDPVRNIKSYHGPRRTIIVVDDNADHRDLMRELLAPLDFTVLAAASGAACLALAEHTEPDLFLIDISMPGMSGWDLVTRLREAGQSAPAIMLSANIGDGSAAGAIGHDDALAKPFGLRQLTDKLAIHLKLEWIYDDGPKETSGTDKTTAVASPGHHHLKELIELGEIGYVRGIEAKLTEIALNPDNRAFAEAARAYVGAFDLAGYDAFLKRLLAGEANARA

SEQ ID NO: 11549 - protein, 296 aa, Bos taurus
WKSPPGKVTEAVKVAIDLGYRHIDCAHVYQNENEVGLALQAKLQEKVVKREDLFIVSKLWCTYHDKDLVKGACQKTLSDLKLDYLDLYLIHWPTGFKPGKDFFPLDEDGNVIPSEKDFVDTWTAMEELVDEGLVKAIGVSNFNHLQVEKILNKPGLKYKPAVNQIECHPYLTQEKLIQYCNSKGIVVTAYSPLGSPDRPWAKPEDPSILEDPRIKAIADKYNKTTAQVLIRFPIQRNLIVIPKSVTPERIAENFQVFDFELDKEDMNTLLSYNRDWRACALVSCASHRDYPFHEEF

SEQ ID NO: 11550 - protein, 242 aa, Haemophilus influenzae Rd
MQGKIALVTGSTRGIGRAIAEELSSKGAFVIGTATSEKGAEAISAYLGDKGKGLVLNVTDKESIETLLEQIKNDFGDIDILVNNAGITRDNLLMRMKDEEWFDIMQTNLTSVYHLSKAMLRSMMKKRFGRIINIGSVVGSTGNPGQTNYCAAKAGVVGFSKSLAKEVAARGITVNVVAPGFIATDMTEVLTDEQKAGILSNVPAGRLGEAKDIAKAVAFLASDDAGYITGTTLHVNGGLYLS

SEQ ID NO: 11551 - protein, 378 aa, Haemophilus influenzae Rd
MEIKQINSTIKSRAAVAFAPNQPLQIVEIDVEMPRKGEVLIRNTHTGVCHTDAFTLSGSDPEGVFPVVLGHEGAGVVVAVGEGVLSVKPGDHVIPLYTAECGECEFCRSGKTNLCVSVRDTQGKGLMPDCTTRFSYQGQPIYHYMGCSTFSEYSVVAEVSLAKINPEANHEQVCLLGCGVTTGIGAVHNTAKVQEGDSVAVFGLGAIGLAVVQGARQAKAGRIIAIDTNPAKFELAKQFGATDCLNPNDYDKPIKDVLLDINKWGIDHTFECIGNVNVMRQALESAHRGWGQSIIIGVAGAGQEISTRPFQLVTGRVWKGSAFGGVKGRSELPQMVEDSMKGDIQLEPFVTHTMPLDKINEAFELMHEGKSIRTVIHY

SEQ ID NO: 11552 - protein, 488 aa, Haemophilus influenzae Rd
MSLRIKQEALTFDDVLLVPAHSTVLPNTANLSTQLTKEIRLNIPMLSAAMDTVTETKLAISLAQEGGIGFIHKNMTIERQADRVRKVKKFESGIVSEPVTVLPNLTLAELAEMVKKNGFAGYPVVDGENNLIGIITGRDTRFVKDLSKTVSQVMTKKEDLVTVKEGASREEILELMHQHRVEKVLVVNDSFKLKGMITVKDFQKAEQKPNACKDEFGRLRVGAAVGAGAGNEERIDALVKAGVDVLLIDSSHGHSEGVLQRVRETRAKYPNLPIVAGNVATAEGAIALADAGASAVKVGIGPGSICTTRIVTGVGVPQITAIADAAAALKDRGIPVIADGGIRFSGDIAKAIAAGASCVMVGSMFAGTEEAPGEIELYQGRAFKSYRGMGSLGAMAKGSSDRYFQSDNAADKLVPEGIEGRIPYKGYLKEIIHQQMGGLRSCMGLTGCATIDELRTKAEFVRISGAGIKESHVHDVAITKEAPNYRMG

SEQ ID NO: 11553 - protein, 163 aa, Haemophilus influenzae Rd
  unsure (1)..(163): unsure at all Xaa locations
MTNIHYHKILILDFGSQYTQLIARRVREIGVYCELWAWDVTEQXIREFAPELYQGRAFKSYRGMGSLGAMAKGSSDRYFQSDNAADKLVPEGIEGRIPYKGYLKEIIHQQMGGLRSCMGLTGCATIDELRTKAEFVRISGAGIKESHVHDVAITKEAPNYRMG

SEQ ID NO: 11554 - protein, 281 aa, Haemophilus influenzae Rd
MDKETQMMLVPQGSIEGYIRAANEYPMLTAEEEKELAERLYYHEDLDAAKKLILSHLRFVIHVARGYSGYGLPQADLIQEGNIGLMKAVKRFNPEVGVRLVSFAVHWIKAEIHEYVLRNWRIVKVATTKAQRKLFFNLRKTKQRLGWFNENEVDMVANELGVSKEDVIEMESRMSGADVGFDLPTDDAETETYSPALYLEDKSSNFAAELENENFESQATEQLGAALQSLDARSQDIIKARWLDDNKATLHDLAAKYNVSAERIRQLETNALKKLKSAVNF

SEQ ID NO: 11555 - protein, 112 aa, Haemophilus influenzae Rd
MKKIEAMIKPFKLDDVRESLSDIGISGMTITEVRGFGRQKGHTELYRGAEYMVDFLPKVKLEVVVPDELVDQCIEAIIETAQTGKIGDGKIFVYHVERAIRIRTGEENEDAI

SEQ ID NO: 11556 - protein, 306 aa, Haemophilus influenzae Rd
MRKTLTVLGSINADHVISVPYFTKPGETLTGQNYQIAYGGKGANQAVAAARLGAKVAFISCIGSDSIGKTMKNAFAQEGIDTTHINTVSQEMTGMAFIQVAKSSENSIVLASGANSHLSEMVVRQSEAQIAQSDCLLMQLETPLSGVELAAQIAKKNGVKVVLNPAPAQILSDELLSLIDIITPNETEAEILTGVEVADEQSAVKAASVFHDKGIETVMITLGAKGVFVSRKGKSRIIKGFCVQAIDTTAAGDTFNGGFVTALLEEKSFDEAIRFGQAAAAISVTKKGAQSSIPTRQETLEFLEHA

SEQ ID NO: 11557 - protein, 629 aa, Haemophilus influenzae Rd
MEKNQQSTAEQYSEQIEQLMELGRTQGYLTFAEINDLLPEDAIDPEYYDKLLQTLQNDAGIPVLDEAPESDDMMLSDTIPDEDAVEEATQILSNVESEIGRTTDPVRMYMREMGTVDLLTREDEISIAKRIEGGIDEVQTSISAYPEALNGLLKNYDDVEKGNFRLTDLITGFVDPNAEIEEHNGLDEDFSDEDDEEESSNADVEDNEDEEDNESESTSDSSDSDNSIDPEVAREKFQQLREQHSKTLAVIEKHGRSGKRAQDQIALLGEIFKQFRLVPKQFDLLVLSMKEMMKRVRYQERQLQKILVDIAGMPKDDFEKIITTNGSNSEWVAKALKSSKPWAKRLIKYEDRIYEALNNLAITEENTKLTITQMRDICDAVARGEQKARRAKKEMVEANLRLVISIAKKYTNRGLQFLDLIQEGNIGLMKAVDKFEYRRGYKFSTYATWWIRQAITRSIADQARTIRIPVHMIETINKLNRISRQLLQEMGREATPEELAERMGMPEDKIRKVLKIAKEPISMETPIGDDDDSHLGDFIEDSTLELPLDSATAQSLKVATHEVLEGLTPREAKVLRMRFGIDMNTDHTLEEVGKQFDVTRERIRQIEAKALRKLRHPSRSETLRSFLDE

SEQ ID NO: 11558 - protein, 633 aa, Haemophilus influenzae Rd
MYLGLKVGVTFASSIPAAVISMAVLKFFKDSSILENNMVQTQASSAGTLSSVIFVLPGLLMMGYWQDFPFWQTMLICAAGGTLGVLFTIPLRRAMVVNSNLPYPEGVAAAEILKAGNHADGDSGVKDIAYGGVLAGLVAFLTNGLRVMADGASAWIQTGKAAFQLPMGFSLALLGAGYLIGIVGGIAMLIGVILTWGVAVPYFTMSEDIAADASLIDSAMTVWKTKVRYIGVGTIGIAAIWTLLILMKPMIEGMVHSFRMLKGGQEASEHRIDIDLSPKTMIYILIATVALIVISLHHFIAAAPISPELSILLVVVCTFLAVFIGFFVAAASGYMAGLVGSSSSPISGIGIISVIVISLVLVSIGNASGLFETVDGQKFLTALTLFTASIVITTACISNDNLQDLKTGLLVEATPWRQQVALIIGCFVGALVIAPVLEILYHAYGFSGALPRPDMDPSQALSAPQATLMTAISQGIFTNKLEWTYILTGVGLGAVLITIDAFLKKVSNKVFSLPVIAVGIGIYLPPSINTPVIVGAFLAWIMARHIAKLGNKEVSAKAERFGTLFSAGLIVGESLMGVILAFIIAASVTTGGSEAPLSLNLENWDTIGEWFGLIVFIVGIVIFASRVLRAKKI

SEQ ID NO: 11559 - protein, 267 aa, Haemophilus influenzae Rd
MTLDVWQHIRQEAKELAENEPMLASFFHSTILKHQNLGGALSYLLANKLANPIMPAISLREIIEEAYQSNPSIIDCAACDIQAVRHRDPAVELWSTPLLYLKGFHAIQSYRITHYLWNQNRKSLALYLQNQISVAFDVDIHPAAKIGHGIMFDHATGIVVGETSVIENDVSILQGVTLGGTGKESGDRHPKVREGVMIGAGAKILGNIEVGKYAKIGANSVVLNPVPEYATAAGVPARIVSQDKAAKPAFDMNQYFIGIDDGMNLNI

SEQ ID NO: 11560 - protein, 333 aa, Haemophilus influenzae Rd
MNRALAIEFSRVTEAAALAAYTWLGRGDKNAADDAAVKAMRYMLNLIHMDAEIVIGEGEIDEAPMLYVGEKVGSGLGELVSIAVDPIDGTHMTAMGQSNAISVLAAGGKNTFLKAPDMYMEKLVVGSNVKGIIDLNLPLEQNLRRIASKLGKSLSDLTVMVLAKPRHDAVIKQIHNLGAKVLAIPDGDVAGSVLCCLPDAEVDLLYGIGGAPEGVAAAAAIRALGGDMQARLIPRNEVKSDTEENKKIAANEIQRCAALGVKVNEVLKLEDLVRDDNLVFTATGITNGDLLKGISRKGNLASTETILIRGKSRTIRKIQSIHYLDDLYKILNI

SEQ ID NO: 11561 - protein, 415 aa, Haemophilus influenzae Rd
MNFFQYKHNKLYAEDMPVQQLAEQFGTPLYVYSRATLERHWHAFDSAFGNRPHLICFAVKSCSNIGVLNIMAKLGSGFDIVSQGELERVLAAGGDASKVVFSGVAKSREEIMRALEVRIRCFNVESVSELKHINQIAGEMGKIAPISLRVNPDVDAHTHPYISTGLKENKFGVSVNEAREVYKLASTLPNIKITGMDCHIGSQLTELQPFLDATDRLIVLMEQLKEDGITLKHLDLGGGLGVTYTDETPPHPSDYANALLEKLKNYPELEIILEPGRAISANAGILVAKVQYLKSNESRNFAITDTGMNDMIRPALYEAYMNIVEIDRTLEREKAIYDVVGPVCETSDFLGKQRELSIAEGDYIAQCSAGAYGASMSSNYNSRARTAEVLVDGDQSYLIRRRETLQELWALESTI

SEQ ID NO: 11562 - protein, 397 aa, Haemophilus influenzae Rd
MQKQNIVILGSTGSIGKSTLSVIENNPQKYHAFALVGGKNVEAMFEQCIKFRPHFAALDDVNAAKILREKLIAHHIPTEVLAGRRAICELAAHPDADQIMASIVGAAGLLPTLSAVKAGKRVLLANKESLVTCGQLFIDAVKNYGSKLLPVDSEHNAIFQSLPPEAQEKIGFCPLSELGVSKIILTGSGGPFRYTPLEQFTNITPEQAVAHPNWSMGKKISVDSATMMNKGLEYIEARWLFNASAEEMEVIIHPQSIIHSMVRYVDGSVITQMGNPDMRTPIAETMAYPHRTFAGVEPLDFFKIKELTFIEPDFNRYPNLKLAIDAFAAGQYATTAMNAANEIAVQAFLDRQIGFMDIAKINSKTIERISPYTIQNIDDVLEIDAQAREIAKTLLRE

SEQ ID NO: 11563 - protein, 436 aa, Haemophilus influenzae Rd
  unsure (1)..(436): unsure at all Xaa locations
MAKIVKVIGREIIDSRGNPTVEAEVHLXGGFVGLAAAPSGASTGSREALELRDGDKSRFLGKGVLKAVAAVNNEIAQAIVGKDATNQAEIDQIMIDLDGTENKSNFGANAILAVSLANAKAAAASKGLPLYAYIAELNGTAGVYSMPLPMMNIINGGEHADNNVDIQEFMIQPVGAKTLREALRIGAEVFHNLAKVLKAKGMSTAVGDEGGFAPNLASNADALACIKEAVEKAGYVLGKDVTLAMDCASSEFYNKENGMYEMKGEGKSFTSQEFTHYLEELCKEYPIVSIEDGQDESDWEGFAYQTKVLGDRVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAAFPGLKAVKGQA

SEQ ID NO: 11564 - protein, 625 aa, Haemophilus influenzae Rd
MTNNMNNYPLLSLINSPEDLRLLNKDQLPQLCQELRAYLLESVSQTSGHLASGLGTVELTVALHYVYKTPFDQLIWDVGHQAYPHKILTGRREQMSTIRQKDGIHPFPWREESEFDVLSVGHSSTSISAGLGIAVAAERENAGRKTVCVIGDGAITAGMAFEALNHAGALHTDMLVILNDNEMSISENVGALNNHLARIFSGSLYSTLRDGSKKILDKVPPIKNFMKKTEEHMKGVMFSPESTLFEELGFNYIGPVDGHNIDELVATLTNMRNLKGPQFLHIKTKKGKGYAPAEKDPIGFHGVPKFDPISGELPKNNSKPTYSKIFGDWLCEMAEKDAKIIGITPAMREGSGMVEFSQRFPKQYFDVAIAEQHAVTFATGLAIGGYKPVVAIYSTFLQRAYDQLIHDVAIQNLPVLFAIDRAGIVGADGATHQGAFDISFMRCIPNMIIMTPSDENECRQMLYTGYQCGKPAAVRYPRGNAVGVKLTPLEMLPIGKSRLIRKGQKIAILNFGTLLPSALELSEKLNATVVDMRFVKPIDIEMINVLAQTHDYLVTLEENAIQGGAGSAVAEVLNSSGKSTALLQLGLPDYFIPQATQQEALADLGLDTKGIEEKILNFIAKQGNL

SEQ ID NO: 11565 - protein, 202 aa, Haemophilus influenzae Rd
MNHLIIFAHPNSVRSFGRAIANRIEQISQENGVNVFFRDLYEMNFNPILSHEELQNANNGIIPEDIQQEHDFILQADLITLVYPLWWMGFPAILKGYLDRVLSHGFAYKTENGESVGLLKNKQMQQFITIGSNVDKYKEFGVDKSLNHCLINGLFNYCGIENVEFELFGDIHLIDDKARKAMIELAAQKTQAKLTALLKEKE

SEQ ID NO: 11566 - protein, 464 aa, Haemophilus influenzae Rd
MNFRLLSQYHADIKKLIKISLPILLAQIAQNSMGLADTIMAGRVSSTDMAAISIGASIWMPLMFFGQGLLLALPPTISYLNGSGQHHRIAHQVRQGIWLVLGVSIPLGLLIYFCEIPLQYMQMESKMSDLARDYLHAMLWGLPAYLMLINFRCLNDGIEKTKPAMVITFLGLLINIPLNYIFIYGKFGMPAFGAVGCGIATAIVNWAMCLMMIFYSYTNTQERSLKVFSQLIEMPNPKTLKKLLRLGLPIAIAICCEVALYALTSLMLSPLGATIVASHQITLNTSSFIFMFPMSIGMATTILVGQALGAGSPQNAKKIGYAALLLGLTVTIVTALITIFFRYEIASIFVTDEIVIAMAANLLLFAALYQFSDTIQMVVGGILRGYKDTKVILYITLFSYWVIGVPLGYTLGRTDWLVPHIDAKGFWIAFVVSLTFAAFLLSLRMKKMQAMNDNAILQRLEKLK

SEQ ID NO: 11567 - protein, 333 aa, Haemophilus influenzae Rd
MKTLSEFIVERQAEYPNAKGELSGILSSIRLLAKIIHRDINKAGLTNILGQSGIENVQGESQMKLDLFAHNTMKAALMAREEVAGFASEEEESFIAFDTERGRNAKYIILTDPLDGSSNIDVNVSVGTIFSIYRRVSPIGSPVTLEDFMQPGNKQVAAGYIVYGSSTMLVYTTGNGVNGFTYDPSIGTFCLSHENMQMPKEGKIYSINEGQYLKFPQGVKKYIKYCQEEDKATHRPYVSRYIGSLVADFHRNLLKGGIYIYPSATNYPNGKLRLLYEGNPIAFLAEQAGGVATDGYRRILDIEPTALHERVPLFVGSEDMVKKAQEMMEEFKE

SEQ ID NO: 11568 - protein, 575 aa, Haemophilus influenzae Rd
MISGILASPGIAFGKALVLKEEKIVLDTQKITDDQIDAEVARFYEGRNAAVEQLNSIRERALISLGEEKAAIFEGHLMILEDEELEEEILDYLRSNKVNAGVAASKILDQQVTMLSEIDDEYLKERAGDIRDIANRLVKNILGMYIVDLGDIQEESILVAYDLTPSETAQLNLEKVLGVVTDIGGRTSHTSIMARSLELPAIVGTNKVTKLVNTGDYLILDAINNQVYINPTASQIDELKALEAKISEEKAELAKLKDLPAITLDGHKVDVVANIGTIRDCDGAERNGAEGIGLYRTEFLFMDREQLPTEEEQFIAYKQVVEAMNGRLTVIRTMDIGGDKELSYLDLPKEMNPFLGWRAIRIALDRREILNAQLRAVLRASAFGKLAVMFPMIISVEEIRELKAVIETLKAELREEGRLFDNNIQVGVMVETPSAAVNAKFLAKEVDFFSIGTNDLTQYTLAVDRGNEFISHLYNPMHPSVLGLIKQVIDASHAEGKWTGMCGELAGDERATLLLLGMGLDEFSMSAISVPRIKKLIRNVNFQDAKVLADTALQKPTAAEIDQLIEEFLLENSLN

SEQ ID NO: 11569 - protein, 128 aa, Xenopus laevis
MAGGKAGKDTGKAKATSITRSSRAGLQFPVGRIHRLLKNRTTSHGRVGGTAAVYTAAILEYLTAEVLELAGNASKDLKVKRISPRHLQLAIRGDEELDALIKATIAGGGVIPHIHKSLIGKKGQQKTV

SEQ ID NO: 11570 - protein, 123 aa, Narcissus pseudonarcissus
QPMSVFWLVPQFFLVGAGEAFCYIGQLDFFLRECPKGMKTMSTGMFLSTLSLGFFLSSALVTIVHKVTGESGQGAWLPDDLNRGKLYDFYWLLAVLSAVNLVAFLVSARWYVYKENRMATDDG

SEQ ID NO: 11571 - protein, 107 aa, Eranthis hyemalis
TTNRQVTYSKRRTGIVKKARELTILCDAEVSLIMFSSTGKLSEYISPSTTTKKIYDAYQQVTGVDLWISSYEKMQETLKKQKESNMKLRKEIRQRIGEGLDNLSFEE

SEQ ID NO: 11572 - protein, 106 aa, Eranthis hyemalis
STNRQVTYSKRKNGILKKAKEITVLCDAEVSLVIFSSTGKMSEFCSPSIPLIKILENYHKSSGRKLWDAKHEYLHSEVERIKKENDNMQIQLRHLKGEDLTSLNPK

SEQ ID NO: 11573 - protein, 855 aa, Rhizobium leguminosarum
MSGTHEPVDLTNCDREPIHQLGSVQPFGFLLAVSSDWIVIRASANLAEFLGVTEANALGRPVISLISPEALHAIRNKLTTLRGSDVVERIFGIALTPDQNSFDLAVHLNEGQVIIEGERCQEDRHDAASLSMRSMMSRLDHTETLEAFFREGARQARALTGFDRVMVYRFDESGSGEVVAEAARAGIGSFLGLHYPASDIPVQARALYLRNLFRIIADVDAVPVPILPPLDEHGQPLDLSMSVLRSVSPIHIEYLKNMGVGASLSISIVVDGKLWGLFACHHYGPRLPSAQSRSTAELFGQMFASRLESRERRLALDYETKARRIADRLLTSVADNASLLDDPAWLIEALADAIPADGIGVWINGRLALAGIGPDERSFAALVRHLNRNAAGRIYAVDRLAETYPDLEVDDAVAGMLAIPISRSPRDYVVLFRQELVRTVRWGGDPHKPVEYGPNGPRLTPRKSFEAWSELVRGRSLPFTEAERRVAETIRVTLIEVVLRLTDEVSMARQTANERQELLIAELNHRVRNILSLITGIIRQSQATSVSLGDYIRQLEGRIQSLARAHDQITRDHWAPASLRQLLLAETAAYLGKNAQRIQMGGEDVLLEPQAFSTAALVFHELMTNSAKYGSLSGTGSGTVQLRWHRDDEGNLRIGWREKDGPPVVEPKRHGFGSTIIRRSIPYDLGGKAEVRYVEDGLEADFSIPARHVVGPTSERSNPLPVGATGRKTIPDDQPLSGLNVLLVENNLIIAMDGEDILRRLGADVATAPSVTEAMEILAGQSFDLALLDVNLGDETSFGIADRLAADGVPFVFATGYGEGIAQANSHSDAPVLQKPYTMEGVTDILARVPLPRRE

SEQ ID NO: 11574 - protein, 197 aa, Gossypium anomalum
  unsure (1)..(197): unsure at all Xaa locations
VVEHVGLNVNGEPFVACHECNFPICKSCFEYDLKEGRKACLRCGXPYDENLLDDVEKATGDQSTMAAHLSKSQDVGIHARHISSVSTLDSEMTEDNGNPIWKNRVESWKEKKNKKKKPATTKVEREAEIPPEQQMEDKPAPDASQPLSTIIPIPKSRLAPYRTVIIMRLIILGLFFHYRVTNPVDSAFGLWLTSVIC

SEQ ID NO: 11575 - protein, 197 aa, Gossypium somalense
VVEHVGLNVNGEPFVACHECNFPICKSCFEYDLKEGRKACLRCGSPYDENLLDDVEKATGDQSTMAAHLSKSQDVGIHARHISSVSTLDSEMAEDNGNPIWKNRVESWKEKKNKKKKPATTKIEREAEIPPEQQMDDKPAPDASQPLSTIIPIPKSRLAPYRTVIIMRLIILGLFFHYRVTNPVDSAFGLWLTSVIC

SEQ ID NO: 11576 - protein, 197 aa, Gossypium longicalyx
  unsure (1)..(197): unsure at all Xaa locations
VVEHVGLNVNGEPFVACHECNFPICKSCFEYDLKEGRKACLRCGNPYDENLLDDVEKATGDQSTMAAHLSKSQDVGIHARHISSVSTLDSEMTEDNGNPIWKNRVESWKEKKNKKKKPAANKVEREAEIPPEQQMEDKPAPDASQPLSTIIPXPKSRLAPYRTVIIMRLIILGLFFHYRVTNPVDSAFGLWLTSVIW

SEQ ID NO: 11577 - protein, 197 aa, Gossypium bickii
  unsure (1)..(197): unsure at all Xaa locations
VVEHVGLNVNGEPFVACHECXFPICKSCFEYNLKEGRKACLRCGSPYDENLLDXVEKATGDQSTMAAHLTKSQDXGIHARHISSVSTLDSEMTEDNGNPIWKNRVESWKEKKNKKKKPATTKVEREAEIPPEQQMEDKPAPDASQPLSTIIPIPKSRLAPYRTVIIMRLIILGLFFHYRVTNPVDSAFGLWLTSVIC

SEQ ID NO: 11578 - protein, 291 aa, Homo sapiens
MLLPLPPQSSKPVPKKSQSSKIVPSHHDPSEKTGENCQTKISPSSLQESPSSLQGALKKRSAFEDLTNVSFEMTHETLYLAVKLVDLYLMKAVCKKDKLQLLGATAFMIAAKFEEHNSPRVDDFVYICDDNYQRSEVLSMEINILNVLKCDINIPIAYHFLRRYARCIHTNMKTLTLSRYICEMTLQEYHYVQEKASKLAAASLLLALYMKKLGYWVPFLEHYSGYSISELHPLVRQLNKLLTFSSYDSLKAVYYKYSHPVFFEVAKIPALDMLKLEEILNCDCEAQGLVL

SEQ ID NO: 11579 - protein, 472 aa, Homo sapiens
MATKCGNCGPGYSTPLEAMKGPREEIVYLPCIYRNTGTEAPDYLATVDVDPKSPQYCQVIHRLPMPNLKDELHHSGWNTCSSCFGDSTKSRTKLVLPSLISSRIYVVDVGSEPRAPKLHKVIEPKDIHAKCELAFLHTSHCLASGEVMISSLGDVKGNGKGGFVLLDGETFEVKGTWERPGGAAPLGYDFWYQPRHNVMISTEWAAPNVLRDGFNPADVEAGLYGSHLYVWDWQRHEIVQTLSLKDGLIPLEIRFLHNPDAAQGFVGCALSSTIQRFYKNEGGTWSVEKVIQVPPKKVKGWLLPEMPGLITDILLSLDDRFLYFSNWLHGDLRQYDISDPQRPRLTGQLFLGGSIVKGGPVQVLEDEELKSQPEPLVVKGKRVAGGPQMIQLSLDGKRLYITTSLYSAWDKQFYPDLIREGSVMLQVDVDTVKGGLKLNPNFLVDFGKEPLGPALAHELRYPGGDCSSDIWI

SEQ ID NO: 11580 - protein, 216 aa, Homo sapiens
MERASLIQKAKLAEQAERYEDMAAFMKGAVEKGEELSCEERNLLSVAYKNVVGGQRAAWRVLSSIEQKSNEEGSEEKGPEVREYRVFYLKMKGDYYRYLAEVATGDDKKRIIDSARSAYQEAMDISKKEMPPTNPIRLGLALNFSVFHYEIANSPEEAISLAKTTFDEAMADLHTLSEDSYKDSTLIMQLLRDNLTLWTADNAGEEGGEAPQEPQS

SEQ ID NO: 11581 - protein, 412 aa, Homo sapiens
MAAPSLLNWRRVSSFTGPVPRARHGHRAVAIRELMIIFGGGNEGIADELHVYNTATNQWFLPAVRGDIPPGCAAHGFVCDGTRILVFGGMVEYGRYSNELYELQASRWLWKKVKPHPPPSGLPPCPRLGHSFSLYGNKCYLFGGLANESEDSNNNVPRYLNDFYELELQHGSGVVGWSIPVTKGVVPSPRESHTAVIYCKKDSGSPKMYVFGGMCGARLDDLWQLDLETMSWSKPETKGTVPLPRSLHTASVIGNKMYIFGGWVPHKGENTETSPHDCEWRCTSSFSYLNLDTTEWTTLVSDSQEDKKNSRPRPRAGHCAVAIGTRLYFWSGRDGYKKALNSQVCCKDLWYLDTEKPPAPSQVQLIKATTNSFHVKWDEVSTVEGYLLQLSTDLPYQAASSDSSAAPNMQDQ

SEQ ID NO: 11582 - protein, 249 aa, Bos taurus
QLFVLAGSAEEGFMTAELAGVIKRLWKDSGVQACFNRSREYQLNDSAAYYLNDLDRIAQPNYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKKSPLTICYPEYAGSNTYEEAAAYIQCQFEDLNKRKDTKEIYTHFTCATDTNNVQFVFEAVTDVIIKNNLKDCGLF

SEQ ID NO: 11583 - protein, 319 aa, Solanum nigrum
MGSKYSKATNSINDASNSSYRVPFESLRVPFVDLQEATNNFDDKFLIGWGVFGKVYMGVLRNGTKVALKKHMPESSQGIEEFRTEIEILSLCSHPHLVSLIGYCDERNEMILIYEYMENGNLRSHLYGSDLPAMSWEQRLEICIGAARGLHYLHTSAVIHRDVKSINILLDDNFVPKITDFGLSKTGTELDQTHVSTAVKGTVGYLDPEYFIRGQLTEKSDVYSFGVVLFEVLCARPAIAHSHSREMISLAEWAVESHNNGQLEQIIAPNIAAKIRPESLKKFGETVVKCLALSSEDRPSMGDVLWKLEYALRLQESVI

SEQ ID NO: 11584 - protein, 663 aa, Synechocystis sp. PCC 6803
MGTSVSNPTAILQTMQGFLRKWWSEFNLQTRLMAAATLVVSLLMSGLTFWAVNTIQEDAQLVDTRFGRDVGLLLAANVAPMIADKNLTEVARFSSRFYENTSNIRYMIYADPSGKIFFGIPYSEETVQNSLTLERRIELPQIDPHNFDQPFVRQHHTPNGDVTDVFIPLQYQGKFLGVLAIGINPNPAAVNSSNLTRDVTIAVFISIWVMVILGAVFNALTITQPIKELLLGVKNIAAGNFKQRITLPFGGELGELIVNFNEMAERLERYEAQNIEELTAEKAKLDTLVSTIADGAMLVDTNLQLLLVNPTARRLFAWENKPIIGENLLENLPPEITAQLTQPLRELAADQGSLLFSPGHGPQEEEQDKTYAPEEFRISLTQPFPRTIRLMLTQVLDQNRENLRGIVMTVQDITREVELNEAKSQFISNVSHELRTPLFNIKSFIETLSEFGEDLSEVERKEFLETANHETDRLSRLVNDVLDLSKLESSKIYQLDAVDLYQLIEQSLRSYQLNAKDKQLQLEKILDPDLPFALGNYDLLLQVMTNLIGNSFKFTKAGGKIIVRAYPLHRSNLRAEDGPGLVRVEISDTGIGIDPEDQAAIFERFYRVENRVHTLEGTGLGLSIVKNIIAKHQSQIHLVSEVGVGTTFWFDLAVYQSMLMVVG

SEQ ID NO: 11585 - protein, 834 aa, Synechocystis sp. PCC 6803
MQINNHVFKGLADFRSVSWQRQIIVAIAIYGTIYISQLFITYAGTASSPIWIPTGMAVGFLSIWGYQVWPGMVGGLLLGEIMALHGLESAANFILTVAITGVVSLVNLFSVYLSDILTANNYLFSKIKNIIRFIVFVCFGSRLPAAIICPFLLYLFEKISFGLYSEIAYTWLLSDAFALLIVTPFIIACNHNFKVFIKLLQEQWLEAASIIFFILLIVKIIANGYPIEYLLIPFLLWSAFRFTEVGSSLLTIVVSALLVLILALDQEKAAIKDQLLLLQSILACISMTTLVLNAVLSENERSKNQLFTTNQILIEQNQKLQELYQQRELERAQREKILIEYNESLQKQVDLVRAKEIAESEAKAKSTFVANMSHELRSPLNAIIGFSQLMLRTKNLPMEQYENAGIIQRSGEYLLNLINNILDFSKIEAGKTHLNRHNFDLYLLLDDLEDMLHLKAANEGIELIFIRDHDLPRYVYGDEIKLRQILLNLLSNAIKFTTEGEVVLTSNFRNAEQQEVINPETSTEPKNKYWLDFTIKDTGKGISEVELSHLFEAFSQTESGRNAQEGTGLGLAITRQFIKLMGGDINVSSVVDQGTTFSFSILVDLGEITLSREPNSAKKVLALTPGQPVYKILVVDDKSVNRQLLIKLLAPFGFEIEEASNGQEAIALWESWEPHLIFMDMRMPVMDGYEATKYIKGQVKGNATAVVALTASVLEEEKAIVLSAGCDDFLRKPFRENTIFDSLTKHLGVTYVYESAPNKNDNHEDTALKPESFLIMSQDWLTQLSHYLLEADTEQVMKLIAEIPASESELEQNLTKLVRRFEFEKILDLIEPLS

SEQ ID NO: 11586 - protein, 147 aa, Synechocystis sp. PCC 6803
MMENKPGRIRQFASDPGLQCQAERTFMNAVLLVEDSSSQREMISGILKDHGWQVTIACDGVEALEKLQNFSPDLVVLDIVMPRMNGYEVCRRIKSDPKTKNVPVIMCSSKGEEFDRFWGMRQGADAYIAKPFQPMELVGTIKQLLRN

SEQ ID NO: 11587 - protein, 1462 aa, Synechocystis sp. PCC 6803
MVISATVISMKSPLRRLLLSPVLPILIGAGLSVMTVHTWLFLYNQVQERLKQVLTNRLTNIHEQIENQLNIHVRQLEQMAGRWERSPTGTEQTDWRLDARAQAEGFDGYQTIQWVDPKFVVRWVEPLPDDEHDIDYANQYPHQIQSLELAARQKNTILSGVVDLDQGEKGFLVYVPLFIGDRFDGFVVGVFQLDQFIGSVRPLSGNKPDQDSGLRSFGLRIFEGNQLIYNDVPDDWEQDIVVTQELAWANSLPQAEAMTSRWQLQLVPGPILLDQYGSSQWILFSGLLMAWAVAIAVYYLQKSSKHSEQLSESIKQQQKVEEFLKSTLQELAVQKTALDEAAIVAITDTEGVITYVNDKFVEVSGYSREELIGNTHRLVSSGYHSPEFFQQFWQTIRAGKVWHGQINNRAKAGNTYWVDSTVVPFLDDNGNPYQYLAIRFEITSSKQAEKSLRESEARFRMMADTSPIMLWVADQDKKMTFVNQSWLEFRGATLAEESGNGYLEGIHPDDKGHYLGVYSQAFGDRRRFELEYRYRRVDQQYRWIVNVGVPRYLEDGKFMGYVGSCLDITDRKQAQDILQKKLNQILLMRKISQEIRRSLQPTLIFQTAARQVGNVFAVSRCLIHNYSEATTLQVPVVAEYLGGQFTSLLAGEIAVEQAYDPTIIQGDRAMAVVDLDQDLNSTHTKAFYQRFQVKSFLAVRTSYQGKANGIIALHQCDRQRVWTADEIELLEAIAEQMGIALAQAALLEKERERRRELAQKNLELEKATWAAEAANRAKGEFLAMMSHEIRTPMNGVIGMTELLIMTDLNLQQLDYVQTIRQSGETLLTIINDILDFSKIEADKLVLETQAFELRPLIETVLEMFGPIARAKHLELTYGIDPQTPARILGDQVRLRQILSNLIGNALKFTEKGEVVLTVKGEPFDPAESYHTILNLPHPSHRICFNLRDTGIGIPLDRQDRLFKSFSQVDSSTTRKYGGTGLGLVISQRLTQMMGGVLTVTSEPGVGSNFRFCILTTAQAPALAEADSVQQMKGKQVLIVDDNETNRRILQDQCQAWGLVCHCFTSGESALDWFARCPDLDAAILDLQMPNMDGITLAHHLRQFAQGKDLPIILLSSGLVAGADELSVFQTVLNKPVRQSLIFDSLVNIFQGSIGLADYAPQFDQLDLPEFVPDGDGLPTEDNATSLQPALQILLAEDNLVNQKVAHQMLNNLGYPVAIANNGQEVIDALEKKFYDLVLMDMQMPVMDGITACRHIRQTLPLERQPRIVAMTANAMPGDRQECLDAGMDGYISKPISINQLRKVLQDTSALITSPQAREDIVTLGDKITVVEEQTMVKPTDVTESPLDPTAIAFLRDDLCGGDLTLFGEMVACYCQESQKLIEELVQGLEVDDFAVIRRTAHSLKSSSASLGAQQLSTFCQQLEKNAGSGNLGLGSPPQLVDRCRQLHIAVVEALAPFTIPSP

SEQ ID NO: 11588 - protein, 467 aa, Synechocystis sp. PCC 6803
MVHKKIDLNQLSEAESLLTPTYAARGLANSVSKYEMPETEMLPAIAYNLIHDELGLDGNSRLNLATFVTTWMEPEARQLMADTFDKNMIDKDEYPQTAEIELRCVNILSRLWNAPASAEATGCSTIGSSEAAMLGGMAMKWKWRQRRQAAGKPGDRPNLVMGINVQVCWEKFCRYWEVEPRFVPMEGDRYHISPEEAVKLIDENTIGVIGILGSTFDGSYEPIEALNDALETLNQRTGWQVPLHIDAASGGFIAPFLDPDLRWDFRLPWVKSINTSGHKYGLVYPGVGWIIWRDKEELPEELIFHCNYLGGDLPNFALNFSRPGNQVVAQYYNFLRLGKEGYRKIQQTCRDTALYLSGKIAQLGPFELLTDGGDIPVFAWRLKDEVLANTCYTLYDMADKLRERGWLVPAYRMPKNREDLVVQRIVVKEGFSRDMADLLLADMERAIAYFASQPDHKPKQEGSHFSH

SEQ ID NO: 11589 - protein, 640 aa, Synechocystis sp. PCC 6803
MHISELTHPNELKGLSIRELEEVSRQIREKHLQTVATSGGHLGPGLGVVELTVALYSTLDLDKDRVIWDVGHQAYPHKMLTGRYHDFHTLRQKDGVAGYLKRSESRFDHFGAGHASTSISAGLGMALARDAKGEDFKVVSIIGDGALTGGMALEAINHAGHLPHTRLMVILNDNEMSISPNVGAISRYLNKVRLSSPMQFLTDNLEEQIKHLPFVGDSLTPEMERVKEGMKRLVVPKVGAVIEELGFKYFGPIDGHSLQELIDTFKQAEKVPGPVFVHVSTTKGKGYDLAEKDQVGYHAQSPFNLSTGKAYPSSKPKPPSYSKVFAHTLTTLAKENPNIVGITAAMATGTGLDKLQAKLPKQYVDVGIAEQHAVTLAAGMACEGIRPVVAIYSTFLQRGYDQIIHDVCIQKLPVFFCLDRAGIVGADGPTHQGMYDIAYLRCIPNLVLMAPKDEAELQQMLVTGVNYTGGAIAMRYPRGNGIGVPLMEEGWEPLEIGKAEILRSGDDVLLLGYGSMVYPALQTAELLHEHGIEATVVNARFVKPLDTELILPLAERIGKVVTMEEGCLMGGFGSAVAEALMDNNVLVPLKRLGVPDILVDHATPEQSTVDLGLTPAQMAQNIMASLFKTETESVVAPGVS

SEQ ID NO: 11590 - protein, 369 aa, Synechocystis sp. PCC 6803
MKSRAAVAFEVGKPLQIVEIDVAPPQQGEVLVKITHTGVCHTDAFTLSGDDPEGLFPVVLGHEGAGIVVEVGEGVTSVQLGDHVIPLYTAECGKCLFCRSGKTNLCVAVRATQGKGVMPDGTSRFSYNGQSLYHYMGCSTFSEYTVVAEVSLAKINPEANHEHVCLLGCGVTTGIGAVHNTAKVQPGDSVAVFGLGGIGLAVVQGARQAKAGRIIAIDTNPAKFELAKQMGATDCINPKDHDQPIQQVIVEMTGWGVDHSFECIGNVEVMRSALECAHRGWGQSVIIGVAGAGQEISTRPFQLVTGRKWMGTAFGGVKGRSQLPGMVEQSMRGEIQLAPFVTHTMELKDINQAFDLMHDGKSIRSVIHY

SEQ ID NO: 11591 - protein, 974 aa, Synechocystis sp. PCC 6803
MVIIGLLLVKVYVNYCNTFLRNVTMSPSSHGTAVQQAIADQLLEMILQSQDLHNAYRLVVEGLQRGLGVDRVLLVQNAVFPNRQSRLVAQAIAPARDIMLLDEPCADCRWLHLLGQLPHYGLWTVWEGEGEFVQLDPVQGEFCRTLGIKSLLHLPLVINQRHWGVLSLQYLHQARPWPLEDQQFAQRIAHLFCLGLMKTELWIHCQNHKNALQTVVAEGQVQRETYLKSAQRERAIADVIDKIRFALDLRSLFQTTVTEVRKLLVADRVMIIKVRQNKNFSWGEIQAEAQTDDKLCLLPPKERVPLSSRWIDHFAKGLILAMDDTDDQRADFDQSMLALAKANLVVPLFSGDRLWGVLSVHQCDGPRVWESSDIEFALKIALNLGVALQQAELLTESQRRSTALQSALGEVEAQKDYLARIAEEERALTRVIEGIRQTLELQNIFRATSDEVRHLLSCDRVLVYRFNPDWSGEFIHESVAQMWEPLKDLQNNFPLWQDTYLQENEGGRYRNHESLAVGDVETAGFTDCHLDNLRRFEIRAFLTVPVFVGEQLWGLLGAYQNGAPRHWQAREIHLLHQIANQLGVAVYQAQLLARFQEQSKTMENTLADLTAIVDNLADGLLVIDLFGRITRYNPALLAMFDLEGLELLGAGVDAYFPETLNQLLAKPEREEQKLVTADVELSQGRQGQALITSITSHENGCEYPQCLGAVIMIRDVTHEREVERMKTDFLATVSHELRTPLTSILGFATVIQDKLNRVIIPELDLAQPHLGKATERVMRNLAIIESEAQRLTVLINDVLDIAKMEAGQESWQEQPCAIGPIIERAIATITPQAQKKNISLQGDLEPGLPDFIGDENRILQVVLNLLSNAVKFTPKGLITARSHFHQNYLWVEIIDHGPGIHPADQEKIFEPFQQGGGDVLTDKPQGTGLGLPICKKIVEHHGGTIGVNSSLGRGSTFYFSLPVPVPAVETSPAV

SEQ ID NO: 11592 - protein, 998 aa, Synechocystis sp. PCC 6803
MGKFLDLLQKYWLLPCLLLAGYGGNYFKLHIFFGVDFLFGSIATLLVLVCYSLPWGLVSAAIAGSHTLIIWRHGYGILIIILEALVVGLMLRRRQTNLVLINSLFWLLIGIPLVYIFYRWGLNMTSVTTSLITLKQATNGIFNSLIASFLITGFGLSKQKFSPSTNPAFFPWKKLSFEQTLFNLLVAFVFFPLFFITVVNGQEAFVQMEKQTVQELTALSIPIQNSVEDWYQSHLEGAEVFATEILPLVAAINQGNGAQLPALSLMTHTIQTAFTGFSNIYVGDRQGQIIASSPEFNEVGESRLGLIQAEKIAGFSIPSQIQVSPLHRTNVNVDPHVAITIPLVANNSFEGFINASLNLAKMKDLLYANRVSKELNITLINGQNQVVASTIANVLPLEIYQPFEGGDPRDLGSSNYHWYPDTPANPTIRWRDSYYYHILPLDKINDWQLVLGLPARESIEKLQAQSVQKLGLLLFLSLVGLVVAIGVSKRVANPLLTLAKITTDIPTKMQYQGLTPIALRSEVSEVITLNENFNEMLITLQNQFKIIKQAKDNLEMRVAERTHTLIVINKQLAGEIEERQRIEIKLREAKESAELANRVKSEFLANISHEIRTPMNAILGFCDLLLQKDLSLSQTKKYLNAIGSSSKILLALIDDILDISKIEAGKLVIHLEPVDLRVIIREIKQIFDYKAESKSLLLTIQIDETLNQAIYFDAVRLRQILFNLVGNALKFTEEGQVFIYIGVEGIQVRSQGTYISLAIEVTDTGIGIAPEDQAKIFDVFTQSQGQSTRKYGGTGLGLTITRRLTALLGGEISLSSRLGEGSTFILHFPAVRLVENSLKSDLTNGDGGNLTDRLGSMSSSSANTTEKLLPTRVGNMAPDNNSLGNHNGPSQGFPRAVPLIDQAQRQQLISLLEQEETNVWNKLRHTLISRQIRNFGDRLSSWGNEYGWEDLHTYGQSIIKALENFDSRRLEQLMGQFPQYRASLTEVSAGVDGKHASE

SEQ ID NO: 11593 - protein, 83 aa, Synechocystis sp. PCC 6803
MSIYVGNLSYQATEDDVLTVFSEYGTVKRVQLPTDRETGRMRGFGFVEMSSDKEEDAAIEALDGAEWMGRDLKVNKARPRTPR

SEQ ID NO: 11594 - protein, 247 aa, Synechocystis sp. PCC 6803
MTALTAQVALVTGASRGIGKATALALAATGMKVVVNYAQSSTAADAVVAEIIANGGEAIAVQANVANADEVDQLIKTTLDKFSRIDVLVNNAGITRDTLLLRMKLEDWQAVIDLNLTGVFLCTKAVSKLMLKQKSGRIINITSVAGMMGNPGQANYSAAKAGVIGFTKTVAKELASRGVTVNAVAPGFIATDMTENLNAEPILQFIPLARYGQPEEVAGTIRFLATDPAAAYITGQTFNVDGGMVMF

SEQ ID NO: 11595 - protein, 318 aa, Synechocystis sp. PCC 6803
MTARTSPDSVRAYLREIGRVPLLTHEEEIVYAKQIQQVVSLNEIKKSLAEGKDGEPVSPSEWAKAADLSIRELEKAIKEGERAKRKMVEANLRLVVSVAKKYLKRNLDLLDLIQEGTIGMQRGVEKFDPTKGYRFSTYAYWWIRQAITRAIAEKSRTIRLPIHITEKLNKIKKAQRQLSQEKGRAASIAELAEHLELTPKQVREYLERSRHPLSLDLRVGDNQDTELGDLLEDDGPLPEDFATYASLQLDLDSLMAELTPQQREVLILRFGLNDGQPLTLASIGSMLSISRERVRQIEREALNKLRKRKSMIQEYLAS

SEQ ID NO: 11596 - protein, 369 aa, Synechocystis sp. PCC 6803
MSDMSSLSTPNTSAVDQWQALDGLADGQAIANDDPPAIEVTLGDGQQGSFNKAVSEDTVGAFFKEMARYPLLSAAEEVELARQIRLLVSAEDVRQQLTQQLERTPSLQEWGQALEFPQVRQFEIWLYQLRAAKRRMIRSNLRLVVSIAKRYLNRGVPFLDLIQEGAIGLNRAAEKFDPDKGYKFSTYAYWWIRQAITRTIANDARTIRLPIHVVEKLNKIKKAQRSLKQELKRNPNEGELAAALDITPAQLRQLLQLRRQSLSLNHRVGKGEDTELVDLLEDQQLQLPEDLMNESMLRREIVEVLAEVLTEREMEVICLRYGIASHQSYTLEEVGNMFNLSRERVRQIQSKAMRKLRRPQVARRLKGWL

SEQ ID NO: 11597 - protein, 164 aa, Synechocystis sp. PCC 6803
MDQPLPTHEDWMQMAIALAEEAGNVGEIPVGAVVVNAMGEVLATGQNRKQRDQNPIAHAEMLAIQTACRRLGHWRLNECTLYVTLEPCPMCTGAIIQARLGLLVYGTPDPKTGTIDSVFDLAASAASNHHLQSLGGVCQEQCREQLQDWFAQHRARKKQQSLVS

SEQ ID NO: 11598 - protein, 363 aa, Synechocystis sp. PCC 6803; identical to SEQ ID NO: 1138

SEQ ID NO: 11599 - protein, 469 aa, Synechocystis sp. PCC 6803; identical to SEQ ID NO: 786

SEQ ID NO: 11600 - protein, 1014 aa, Synechocystis sp. PCC 6803
MSPSQPHPPIATFEPESFLILVVDDVKENIYVISELLEGEGYSTTFVTSGPEALQRVTQAQPDLILLDLMMPGMDGLEVCDRLKQDPQTRDIPVIFLTASNEKQDLLQAFAKGAVDYVTKPFSPPELLARVKTHLELKQTRDNLHHTLLEQARTAEALACTSTRLGILVQNMQAGVLMTDAQGTIVVVNPEFARLFNLGFPADLLLGKNLTAIAPRINGLISHGQGVTHNFLAIESPEPLLKVELALEDGRFFERDYVPIMLGDSSQGHFWLYRDISQRKQVEMIQGQSLEMERRMRQQLAEQNQELVAATTAAEAANRSKSEFLATMSHEIRTPMNAIIGMTGLLLDTDLTTQQKYFAQTIRNSGETLLTLINDILDFSKIEAGKLDLEVYPFDLGQCLEEALDVVVPSARQKSLTLIRRFLTPIPPNLQGDVTRLRQILVNLLSNAVKFTEAGQVKVTVEVVDHDAAKGEYQICFAVQDTGIGIAPNQQQALFQAFSQGNSSITRRFGGTGLGLAICVRLTALMGGTIWAESNGCVVGNPPELWQIGQPTIEGSTFYFTVNLTVLPSCAYSVHNLRHSLFIGRSVLVADYDEGRGTRMRNLLASWRLQAEQITFSSPAKLGEDLKSRLTQKNYGALILHCPYPEGRGKQFTDFDLGKITTWAPTEQDIPVLVATDIYLSPGERYSGDKPPVQAWIKSPINPDELENTLVDVLGQTEPPTLVSTEAISGPLFPYSSSNLTILLAEDNLINQQVAKLLLKKLGYPVDVVNNGQEALSALAKGDYDVVLMDVEMPEMDGLTATEHIRRSQGRSERPWIIAVTAYSMEGDRERCLASGMNDYVSKPIRLEALQQALQVAATALQSTSQDRMATVSCVSAFEAKPSPSSPCPEDPAGTTLPPIDQDIICSLRDLDRENGQLILREIIDIYCQTAPELLQRIKLAIANQDWGNLSSAAHTLGSSSANLGAVLLAQQAKTLENLTRQRDSRAMDPGHFPTLAASYERVQGELKTMLDRL

SEQ ID NO: 11601 - protein, 387 aa, Synechocystis sp. PCC 6803
MNITIGRGKTARRAYGIDEIALVPGVRTLDPALADTRWKVGAIEREIPIIASAMDGVVDSRMAVLLSELGALGVVNLEGIQTRYEDPNPILDRIASVGKTEFVGLMQELYAEPIKPELITKRIQEIQAAGGIAAVSLTPVGASKYASTVAEAGADLLFIQATVVSTAHLSPESVESLDLVKLCQEMPMPVVLGNCVTYEVSLELMRAGAAAVLVGIGPGAACTSRGVLGVGVPQPTAIADCAAARDDYLQETGRYVPVIADGGIITGGDICKCIACGADAVMIGSPIARAAEAPGRGFHWGMATPSPVLPRGTRINVGTTGTIREILVGPAKLDDGTHNLLGAIKTSMGTLGAKDMKEMQQVDVVIAPSLLTEGKVYQKAQQLGMGK

SEQ ID NO: 11602 - protein, 527 aa, Synechocystis sp. PCC 6803
MDTAVNESLSISYNLEQFLIVLSVSLSIATLSKTVPILRKIPYTLLLVIVGMALAFVDVKLINLSPELIMEIFLPPLLFEAAWNLQWRNLKENWFPITLFATLGVVICVVGIAFPLSYWGGMELAIAFLAAAALSATDPVSVIALFKELGASKKLNTLMEGESLFNDGVAVVVFLILVGIPLGTSTFDLSVTLARFVTVIGIGVGCGLVIGFSLSLLTQRFDLPFVEQSLTLVSAYGAYILAENLGGSGVIGVVVVGMVLGNYGSRIGMNPRTRLIVSIFWEFVAFFVNSIIFLLIGDQIGLSSLSDHLNLILIAIAAVVVTRLVSVFGLSLISNKVSDQISSTHITLQEQTVLWWGGLRGSVAIAVALSVPQAIAERQAIIDIVFGVVLFTLLVQGLTTQFVLKGLDLIGDQPQRLEYAELVSRQIALRRVLAELEKTDEFPDINPERLRYKQELVQGQLQSVTDKLKLLLQEYPLLQEVANKKFDQTVLDIEAETYADLIRMGRLEENIMPLLVTLEGENVAEPS

SEQ ID NO: 11603 - protein, 402 aa, Synechocystis sp. PCC 6803
MVKGKRILIGVGGGIAAYKICEVVSQLFQQGAEVRVILTAEAEKFVTPLTFTTLARHPAYGDADFWQPIHHRPLHIDLGEWADIFLIAPLTAHTLAKLGHGFADDLLSNTVLASSCPILLAPAMNTDMWEQEAVQRNLQQLLGDRRYHLLAPNGGLLACDRRGVGRLAEPAQIMHRLQALLFTGGQEDLRGKRILITAGGTQEYLDAVRFIGNPSTGKMGLALAQSAGDRGARVTLIHGPIGDLPIPMGVISMAVVNAEQMEQALAQQAPLADWIVMAAAVADVKPAQTWTGKIAKQDLPDSLPLAPVPDLIAQVSKQKRPHQLLVGFAAQAGDIVTPAKEKLQRKNLDVIVANPIDQPQSGFGTDSNQAVIIDRHGSQTAIAPCSKLAMAHRIWQYLLERI

SEQ ID NO: 11604 - protein, 345 aa, Synechocystis sp. PCC 6803
MDSTLGLEIIEVVEQAAIASAKWMGKGEKNTADQVAVEAMRERMNKIHMRGRIVIGEGERDDAPMLYIGEEVGICTREDAKSFCNPDELVEIDIAVDPCEGTNLVAYGQNGSMAVLAISEKGGLFAAPDFYMKKLAAPPAAKGHVDIDKSATENLKILSDCLNRSIEELVVVVMDRPRHKELIQEIRNAGARVRLISDGDVSAAISCAFSGTNIHALMGIGAAPEGVISAAAMRCLGGHFQGQLIYDPEVVKTGLIGESREGNLERLASMGIKNPDQVYNCEELACGETVLFAACGITPGTLMEGVRFFHGGVRTQSLVISSQSSTARFVDTVHMKESPKVIQLH

SEQ ID NO: 11605 - protein, 1261 aa, Synechocystis sp. PCC 6803
MFWQPVSPLNADQLNYQGSYDPKLVLLSVAIAIFTAYMAFLMASSALSLPGRWSRKIALALSGTVMGLGIWAMHFIGMLGFELPCPISYDPLITFISVIPAIAASIYALNFLSFQAPTAKNLMVGAIWFGLGIGTMHYSGMAALELHGNIYYELPLFVLSLVIAVMLAFVALLFRFHSAKIFHTTHGPALGSSALVMGLSTSGMHYTAMTATHFICRPWGEFFIQGIDIQEVAIAVTISITLLTGGVMLFVLREISIQNQQQKILVATESWYRQIIEYAPEGIMVLDAQGNIILANTSIEKLFGYSQTELIGQSIALLGLAELLQQSLHLLQEGEDVGPTCPLDQEEFEILGTRYDGSEFPIEVSLTSLPSLSQREMNIFASVRDISARQEAQQQILRQREHLQSVLDSAPVGVAITVNGITQFANPHIGELVDLKVGDSPQKIYVDLGDRQQMLEELTQFGRSQSRVYKMYNPRGEIRDILATFLATDYEGQKGILGWLADITPIKAAEAEMKRAKELAEEASRIKADFLANMSHEIRTPMNAVIGMTHLALKTDLTPRQREYLHKIRFSGQHLLGVINDILDFSKIEAGKLPMESIDFDLDKVLDNVATLISEKATNKGLELLFDIDRNLPRHFIGDPLRLGQILINYANNAVKFTEQGDITIVVRLQEYRDQDVVLYLAVKDTGIGIKPEHIANLFNSFQQADSSTTRNFGGTGLGLAICKRIAELMGGEVGVESEYGQGSTFWAKVCLQKSNVIPHRLVLSKDLEGKRVLVVDDNDHARLVMKDLLEQMKFVVETVESGPEALNFLAEADRENHPHSIVFIDWQMPNMDGLEVARRLKAMGLNHQPSIFIVTAYGREELFVKAKSLGIDDVLVKPISPSVLFDSLARVLGDPTALAQEMRQSSGIGAEDLALEKLRRIRGARILLVEDNEINQEVAAELLRDVGFNVDVAANGLIALERLNNNAYALVLMDMQMPEMDGIEATIAIRQNPRYAQLPIVAMTANVMQGDRERCLQAGMNDHLGKPIEPEELWNKLLHWIPVDSPLAPETIEESAINTSDPEISIPHIPGLNSDDGLRRVLGKKSLYLKMLHKFVASQSSFLPEITQALGEKDYGFAERLAHTLKGVAGNIGAQELQQEAAELEKAIKEQWPQPEVENLLTNLGDRLDNLIAQLTSNLPPEPATVAITLDQGQLEEICDHLAQLLGEDDAEAADLLQNHGDLLRQAFPDHYSAIAAGINNFDFEAALAALTTARQFSQP

SEQ ID NO: 11606 - protein, 950 aa, Synechocystis sp. PCC 6803
MKSFFLNTFSPLRSTARFWVLVALLTSMELSASQLRDTEQAVAIEESKCTDCVEGRGTGIVRGESFAQVETVPTEAKVEQIKPMIERISPHLGLVGFGLAFIGVLWLTYLLKKDRQTKAQLAFQARRSDVLLELPQYADRLSEVEFLQRGQEFAEELTKSKIAFIHFVNDDEQTIELVAWSRATLANYCRVVAASHYPVEEAGIWADALRLRRPVLINDYATHQGKKGLPEGHAYLARLISVPVIDDGKVVMLTGVGNKDVFYTDQDVETVQLISNEIWRIARSRRLVKKLTESENRYRLAQAIAKIGNWELDYATNVLFWSPEVFNLFEIAPQDFAGTYEAFLNLIHPGDRELVDEAYQCHLQKYQPYDIVHRLLMPDGRIKYVQEQCNTVFDKNNLPLLSRGTIQDVTELQEAQISLEHLNEKLEQRIQERTQELENSQESLLEAKLVAEGATKAKSEFLANMSHEIRTPMNAIIGMSELVLQTDLTSQQRNYLQKVQYAGELLLGIINNILDFSKMEAGKLELEQKPFSVEEVMGNLHSILGIQAEAKGLTLNFHLDPRIPPILVGDRLRLSQILINLGNNAVKFTNQGEITIRGQLLKTENEQTKLQFSVTDTGIGLTPDQQSKLFQWFNQGETSTSRQYGGTGLGLAISKSLTELMGGDIWLESVVGQGSTFHFTVCLGTASPAVAQDYLVSRVSILEAKPSVTQAITQLEGASILLVEDNEINREFAHDLLTSKGLRVQVANNGQEALTLLTSNTYDAILMDIQMPMLNGYDATRAIRQQEYHRNLPIIAMTANAMAGDQEKALDAGMNDHLTKPIKPDLLFQTLAHWIPPNSAREKKNPSSNLKADLSFSSMTGINQQIGMQYIENVELYHRLLVKFGDRYSNFADQFRTEQASDDPTAATRYAHSIKGAAALLGIENVHHTAQQLEDSCREHESPEMIDRHL

SEQ ID NO: 11607 - protein, 249 aa, Synechocystis sp. PCC 6803
MKPVVLITGIAGGIGQATAELFAQQGWLVTGIDRQADPKCPYIDHYQQADCGDPKALAAAFDNLVGETQNLHSLINNVALQICQPILETSLDDWDQVMAVNLRAAFLLAKMSHPYLQQTHGSIVNISSVHALATSANIASYAASKGGLIALTRAMAIEWAADQIRVNALLPGAVNTPMLREGLSRGHLVEQSPQHQLQELGSKTVMGRVGQPSEIAQAIAFLADNEQSSFMTGQTITIDGGAIARLSTE

SEQ ID NO: 11608 - protein, 425 aa, Synechocystis sp. PCC 6803; identical to SEQ ID NO: 670

SEQ ID NO: 11609 - protein, 399 aa, Synechocystis sp. PCC 6803
MMLKVCVDATAIRGQLSGIGFYNLSLLRALNELQHSQQFQGQFSLQIYYQPGLKDWCQGNWQKKHHLAEFTDCTCLPLPVTLSDRLVNFPNPILNLLEKRLDKPDLIHGIDHYIFPSQKAINLLTIHDLTFLKFPEFVPPIVQRYHQRILRCLPFAQGILTFAESTKREINEYYQFPLERIFVTPQASRYRGSQLSTEPSSPKNKFINESLLATIPYNFAVPYFLFVSTLEPRKNVVGLIEAFNLFKQVTKAHHQLVLIGQLGWKYEPILTAIANSAYQDQIHRLAYVPNQWLGEFYQRATAFVYPSFYEGFGLPVVEAMNFGLPIITAGAGSLPEVMGDSGVLVDPQDTQALALALEKIVSDTDWRDHLRQKSLTRSKDFSWENTARKTLEVYQSLIA

SEQ ID NO: 11610 - protein, 633 aa, Synechocystis sp. PCC 6803
MRFAIEQLGLLFGCQRVHVIYHDPAKDCLHMAEEWCAVGIAPRLSTFQGVPVATYPWLWANLQDSEGVLVRDVEQMPPEAEMDKVSLQFDLVKSILVVPMVKDAQVLGYISMVHLHDNYGWNPEELNLAKLVGQFLAIAQARHQAETTLTQAKEAADAANRAKTEFLASISHELRTPLNAIIGFSQLLHRDPSLAPHRPTLDIINRSGEHLLELINDILEMSKIEAGRTTLNEKIIDCHRLLDNLQALFQLRAQEKQLLLKVERSPEVPEWIKTDGGKLRQVLINLLANAIKFTAQGGVTLKVKCLTAPQTDEGQGASIWLHFLVSDTGPGIAAHEMDELFVPFAQTETGLKSCQGNGLGLPISQKFVQLMGGQIQVRSKVDQGSAFFFAIPVQVMAAPKPTPETSAVTLPPLDQYNQKVLVVDDRPESRLLLRQLLTSLGFVVQEAENGEMAIALWESWHPQVILMDMQMPVLDGRSTTQKIKASPQGQHTIIIALTASAFEGERAEILSAGCDDFLSKPFRPEELIALLAKHLAVALPSQGQPPASPLRPFPVITAPSLSEQLAKTPQSWRQKMAKMALECNDDDLITLVESLPTLSPSLAHLLATWAREYRFEQIFLVVESSFGAVTLAG

SEQ ID NO: 11611 - protein, 249 aa, Synechocystis sp. PCC 6803
MLNSLIADFRIIFERDPAARNWLEVLFCYPGLQALLIHRFSHRLYTLGLPFFPRLMSHLARFFTGIEIHPGAQIGQGVFIDHGMGVVIGETAIVGDYSLIYQGVTLGGTGKESGKRHPTLGENVVVGAGAKVLGNIAIGDNVRIGAGSVVLRDVPADFTVVGVPGRMVHPSGERVNPLEHGKLPDSEGKVIRLLLERIELLEQQVATLQQQQSEQAWESDYRSCSETDREPVLCRLGDREIEEFLGGTL

SEQ ID NO: 11612 - protein, 750 aa, Synechocystis sp. PCC 6803
MLPAFSPIFRRLLPAVTFERLLRFWRTLAQQTGDGVQCFVGDLPSSLKPPPGPSVLEAEVDHRFALLVSPGQWALLEGEQISPHHYAVSITFAQGIIEDFIQKQNLPVVAEAMPHRPETPSGPTIAEQLTLGLLEILNSDSTSFSPEPSLQDSLQASQVKLLSQVIAQIRQSLDLSEILNNAVTAVQKFLFVDRLVIYQFHYSQPSLTPLEENQIPAPRPRQQYGEVTYEARRSPEIDTMLGIMTENDCFSQVFSYEQKYLKGAVVAVSDIENHYSSSYCLVGLLQRYQVRAKLVAPIIVEGQLWGLLIAHQCHHPRQWLDSEKNFLGQIGEHLAVAIVQSLLYSEVQKQKNNFEKRVIERTKELRDTLMAAQAANLLKSQFINNISHELRTPLTSIIGLSATLLRWFDHPASLPPAKQQYYLLNIQENGKKLLDQINSIIQLSQLESGQTALNCQSFSLHTLAQTVIHSLLGVAIKQQINLELDYQINVGQDQFCADQERLDQILTQLLNNALKFTPAEGTVILRIWKESNQAIFQVEDTGIGINEQQLPVLFEAFKVAGDSYTSFYETGGVGLALTKQLVELHGGYIEVESSPGQGTIFTTVIPQQNFPPTTKGQVQDKLDAAMPFNSSVIVIEQDEEIATLICELLTVANYQVIWLIDTTNALQQVELLQPGLIIVDGDFVDVTEVTRGIKKSRRISKVTVFLLSESLSSAEWQALSQKGIDDYLLKPLQPELLLQRVQSIQQEPLR

SEQ ID NO: 11613 - protein, 432 aa, Synechocystis sp. PCC 6803
MGQPSDLTESTLRFSSLDPLHPPVISQLTAIAKRIRRNSLHLPTIWQEAVDSIGSTLGVSRCLLLTKDFQSRHLQIEAEFCQPTVTAFAALIVPEESEIWRQLFEQHQPITLYNVQFQGEDLGGLWIFPTLYQDQANGYLCLQQVGPAPGPWHPETEALLQELAEQTGTAIAHATLYQELTQATKAAEEASRLKSEFLASTTHELRTPLNGIIGFLRLILDDMADSEAEKHEFVEEAYQSALLLLNLINDILDLAKIEAGRVGIELEVVDFSEVLQATENFALPQAQNKGLSFNLTAPNQGPLLVYGNQRWLLQVMLNIVGNAIKFTHEGGITVAVEVMPRTVLWEGVQKPGLLKVSVGDTGIGVSLEQQSKLFKKFVQIDGSHSKAYGGTGLGLVISQKLVETMGGKVAFFSMGEGLGSTVTFTVLLEELP

SEQ ID NO: 11614 - protein, 674 aa, Synechocystis sp. PCC 6803
MVSIIKSVRRSLLLKFVLSYFCLSSVVVASIFLVANYRAVKGIESQTFNRLNISNNLKEYQLEQWMEGQKDTLFLLSDINSIQANTELLKNTSVSDPQYKIIQKRLIEELREIDLFLPHIEAINILNTGGIVVASNNLDEIGVYKGIGNQTTYFANINSNFKTVPNFYFSKVYNRPSMTFATNIKHDITRERLGYLSIDINLNAVDDLIRKRTGLGDTGETFLVGEINNQVSFIASDENKKLTANGSKPNFNSLGINSVMAGNSGQGSYVNYAGTPVLGVYQWIEKYNLALITEISEVEALELARRFTRMLVLVGLVSTALLLIAVYLLSIKITKPILLITKAAIDISSGDREARAPVLGEDELGILAKSFNLMTNELRESNSSLEKKNQELELAQKQLAVANSCLEEKVQQRTEELENTVKALELASSEAEAANATKSIFLANMSHELRTPLNAIIGYSEMLIEEAEDLDSEELVPDLDKILRSGKSLLALINDLLDISKIEAGKMELYLETFNLKELIAGILDTISPLLKNNNNKLEVEISLESEEVYGDLIKLRQGILNLLSNASKFTKDGIISFIVEEFKVDEKDWLSFQVKDTGIGLTEEQMSKLFQPFTQADSSTTRKYGGTGLGLAITRKFCQMMGGDIYLTSEIGVGSSFTIKLPKYAQLNSAKND

SEQ ID NO: 11615 - protein, 357 aa, Synechocystis sp. PCC 6803
MSALSSHSQVLSMLRTTPINFNHWYVVAQAGELGQGPLGIVLWEKAIAIYRDQDGQVRAVEDRCPHRQVKLSEGKVLGNNLECAYHGWQFDAQGHCAKIPYFSEDQKLPPCRLRTYPVQEKDGFIWLYPGDLDHLASHGPEPLAIPEWHHLNHIGSFAAFDCPGHFSYLIENLMDMYHGHLHDNYQAWASASLREIETNGDQVVVDYNAQSYYKIDKIWSISQLFFPTLRRLHPENLRVSYIYPHWSSTLGADFKIYCLFCPISANKTKAYLVHFTSLEAFPKLHKLPVAFRSFLKNWLSGTARPLLEGLIDQDIRMISQEQAAFEQNPDRQNVEVNPALAKVQQLIRQQALASENA

SEQ ID NO: 11616 - protein, 990 aa, Synechocystis sp. PCC 6803
MVAQIDSQQQYEQATQAIAKELLAQTREKRSLWDKIGDNLRLDDKLLDWTMGHPGLRVQLFKFIDCLPALQSNSEIANHLQQYMSEEEVELPEALKKLLNFADAHSTPAQIAAGTVSKATEQLAFKYIAGETIAQVIKTVERLRKEKMGFTIDLLGEAVITESEAAEYWQNYLDLMAQLSQQAKSWSKVPQIDQADGEILPQVQVSVKLTAFYSQFDPLDPAGSKAKVCERIRELLRRAQELGVAVHFDMEQYHYKDLILNILKELLVEEEFRSRTDVGITMQAYLRDSTEDLEALIPWAKHRGYPVTVRLVKGAYWDQETIKAQQNHWQIPVYVEKAQTDANYERMTRLLLENHEYLYAAIGSHNVRSQALACAIAEELNIPKRRYEMQILYGMGEPLARAIVKRGHRVRVYAPYGRLLPGMAYLIRRLLENTANSSFLRQNLEERPIEELIAPPQVKGINDLPTKGYGNAPDTDYADADLRQQAFQALTRVKQQLGKTYLPYINGEYVETANYIDSVNPCRPSQAIGKVGLISVEQADHALEIAKAAFPAWKKTPVRERCGILRKAADIMEERRHELNAWICLEVGKIIPQADAEVSEAIDFCRYYADEMERLDQGVNLDIPGETNRYFYQPRGIALVISPWNFPMAIAVGMTVAALVTGNCTLLKPAETSTVIAAKIAEILIAAGVPPGVFQYVPGKGSVVGSHMVNHPDVHLIAFTGSREVGCRIYADAALVQPGQKHLKRVIAEMGGKNAIIVDESADLDQAVAGAVYSAFGYTGQKCSACSRVVVLSPVHDAFVERFVEATRSLNVGPTDDPSTQVGPVIDAKAQARIQEYIEQGKAECELAIACDAPSEGYFVGPTVFKNVDRHATIAQEEIFGPVVTIIRAANFDEALEIANGTDYALTGGLYSRTPDHINRAAAEFEVGNLYINRTITGAIVSRQPFGGFKMSGVGSKAGGPDYLLQFLEPRHVTENIQRQGFAPIEGADQ

SEQ ID NO: 11617 - protein, 327 aa, Synechocystis sp. PCC 6803
MQSFNRINSMKYFPLSNGEQIPALGLGTWKSSPQVVGQAVEQALDLGYRHLDCAAIYGNEAEIGATLANAFTKGVVKREELWITSKLWSNAHHPDAVLPALEKTLQDLGLDYLDLYLIHWPVVIQPDVGFPESGDQLLPFTPASLEGTWQALEKAVDLGLCHHIGVSNFSLKKLEMVLSMARIPPAVNQVELHPYLQQSDLLTFANSQNILLTAYSPLGSGDRPAAFQQAAEPKLLTDPVINGIAAEQGCSAAQVLLAWAIQRGTVTIPKSVNPERLEQNLRAADITLTDSEMAKIALLDRHYRYVSGDFWTMPGSPYTLQNLWDEI

SEQ ID NO: 11618 - protein, 347 aa, Synechocystis sp. PCC 6803
MTVSEIHIPNSLLDRDCTTLSRHVLQQLNSFGADAQDLSAIMNRIALAGKLIARRLSRAGLMADVLGFTGETNVQGESVKKMDVFANDVFISVFKQSGLVCRLASEEMEKPYYIPENCPIGRYTLLYDPIDGSSNVDINLNVGSIFAIRQQEGDDLDGSASDLLANGDKQIAAGYILYGPSTILVYSLGSGVHSFILDPSLGEFILAQENIRIPNHGPIYSTNEGNFWQWDEALRDYTRYVHRHEGYTARYSGALVGDIHRILMQGGVFLYPGTEKNPDGKLRLLYETAPLAFLVEQAGGRASDGQKRLLDLIPSKLHQRTPAIIGSAEDVKLVESFISDHKQRQGN

SEQ ID NO: 11619 - protein, 244 aa, Synechocystis sp. PCC 6803
MRQLLLISDLDNTWVGDQQALEHLQEYLGDRRGNFYLAYATGRSYHSARELQKQVGLMEPDYWLTAVGSEIYHPEGLDQHWADYLSEHWQRDILQAIADGFEALKPQSPLEQNPWKISYHLDPQACPTVIDQLTEMLKETGIPVQVIFSSGKDVDLLPQRSNKGNATQYLQQHLAMEPSQTLVCGDSGNDIGLFETSARGVIVRNAQPELLHWYDQWGDSRHYRAQSSHAGAILEAIAHFDFLS

SEQ ID NO: 11620 - protein, 490 aa, Synechocystis sp. PCC 6803
MVTSPPTSSPSQRSYSPQDWLRGYQSQPQEWDYWVEDVEGSIPPDLQGTLYRNGPGLLEIGDRPLKHPFDGDGMVTAFKFPGDGRVHFQSKFVRTQGYVEEQKAGKMIYRGVFGSQPAGGWLKTIFDLRLKNIANTNITYWGDRLLALWEGGQPHRLEPSNLATIGLDDLGGILAEGQPLSAHPRIDPASTFDGGQPCYVTFSIKSSLSSTLTLLELDPQGKLLRQKTETFPGFAFIHDFAITPHYAIFLQNNVTLNGLPYLFGLRGAGECVQFHPDKPAQIILVPRDGGEIKRIPVQAGFVFHHANAFEENGKIILDSICYNSLPQVDTDGDFRSTNFDNLDPGQLWRFTIDPAAATVEKQLMVSRCCEFPVVHPQQVGRPYRYVYMGAAHHSTGNAPLQAILKVDLESGTETLRSFAPHGFAGEPIFVPRPGGVAEDDGWLLCLIYKADLHRSELVILDAQDITAPAIATLKLKHHIPYPLHGSWAQT

SEQ ID NO: 11621 - protein, 480 aa, Synechocystis sp. PCC 6803
MTATLSRAAWASNFSQNAVEFDRTGLELISGQIPAELKGSLYRNGPGRLSRGSEKVGHWFDGDGAILAVHFGEGQAQGLYRYVQTQGYAEEEKAGRYLYGNYGMVDPQGVWHYWKSLLTQTDVLKNASNTSVMALPDRLWTLWEAGHPYALDLENLATLGTEDFGGAFQPGQPFSAHPLRDPVTGEIFSIGVDFQFNLNLYRLDRQGNLLKHRRLKLSRTPFCHSFCMAGRYLVLFLPPITLNQFSLLLGNVAYADALGWDAQGGTKIVVFDRQTLEIVSKGETESWFQWHYGNGCELDDGNVRLDFVRFNDFAQTNEYLREVPTGAVKTSTDGQLWQAILNPQTAKIVELTNVLSRSGEFPVINPQRTGQPWRYTYMALQRPAEILGSQWFGEIARIDYHTGDVTTAKLGEHQYPVEPLYIPHPDDGGRGWIITVVYDGDRHGSEVWLWDADRLQAEPICRLALPQVIPFSFHGTWRSV

SEQ ID NO: 11622 - protein, 540 aa, Synechocystis sp. PCC 6803
MIKLPVLLADINIQSLPTEPELILNNLAITTLVENLIILLLVATLVALVARWLKIPYVIGLVLAGLAIPRGLSVGLNPELILNFFLPILIFEAAINTDISRLRSTIKPITVLAGPGVVISAAITAVLLKIGLGLAWVTAAGVSVILTITDTVSVIAAFRSVPVPRRLATIVEGESMLNDGVAMVLLSVITTIHIQGGFSAGEGIRQIFVAFVGGGLVGLGLGYLCVGLFRQLNDDLSDILLTVSVSLGTFQIGQMLGVSSAIAVVVAGLVIGNLALKQTSASIKVTLLSFWEYAGFGVNTLIFLLVGIEVYPSILLSTIPAALIAIVAYQIGRVFSIYPLLYLLSFFDRPLPLRWQHVLIAGNVKGSLSMALALALPLTLPGRDQVVTLVFSTVMVSLIGQGLSLPWVVKKLQLSKPSPLAQKIAMLQLNLVTAKAAQGELKYLLEAGSLPKFLYEELFADYQARIANSEQELREFYNQRNLIFSEGEVEKKYIDGLYRRLYIAEKSAINDALAKGILADDISDEYLQVLNEKLLALQDD

SEQ ID NO: 11623 - protein, 85 aa, Synechocystis sp. PCC 6803
MTVSEVRGFGRQKGQTERYRGSEYTVEFLQKLKIEIVVDEGQVDMVVDKLVSAARTGEIGDGKIFISPVDSVVRIRTGEKDTEAI

SEQ ID NO: 11624 - protein, 330 aa, Synechocystis sp. PCC 6803
MQIESKTNTNIRSGLTLIAPFFLWGTAMVAMKGVLADTTPFFVATVRLIPAGILVLLWAMGQKRPQPQNWQGWGWIILFALVDGTLFQGFLAQGLERTGAGLGSVIIDSQPIAVALLSSWLFKEVIGGIGWLGLLLGVGGISLIGLPDEWFYQLWHLQGLSINWSGSALGSSGELWMLLASLSMAVGTVLIPFVSRRVDPVVATGWHMIIGGLPLLAIALVQDSEPWQNIDLWGWGNLAYATVFGSAIAYGIFFYLASKGNLTSLSSLTFLTPIFALSFSNLILEEQLSSLQWLGVAFTLVSIYLINQREQLKIQLRDIWSLVRKPVIND

SEQ ID NO: 11625 - protein, 345 aa, Synechocystis sp. PCC 6803
MVTVTVILLLFIKESFRMPTANLSSPTSPPTFTADMVRSYLHEIGRVPLLTHEQEIILGKQVQQMMALLEHKKALADRLGREPSDPEWAEAADLSVTKLHRYLGQGERAKRKMIEANLRLVVAIAKKYQKRNMEFLDLIQEGSLGLERGVEKFDPTKGYKFSTYAYWWIRQAITRAIAQQGRTIRLPIHITEKLNKIKKTQRELSQQLGRSATPAEVAKALEIDPSQIREYLSLSRQPISLDVRVGDNQDTELSELLEDEGVSPDAYITQESMRQDLQNLLAELTPQQQAVLTMRFGLNDGQELSLAKIGQHLNISRERVRQLENQALAQLKRRRANMAEYIIAS

SEQ ID NO: 11626 - protein, 1244 aa, Synechocystis sp. PCC 6803
MDKGGKTYNLAMIPGDVVTPGTPFFAQMPWMNIWSRFKFPPMPWWVAKQRSLGGLSLTPSLWELERDNQERKPTATNLEHRQQREIDQLKRQLLEAEQAKEKLARELAQHQNSPSQPPPPVSGLQTALARLGQWGILSRDLYGFFDQATELIRTALGVDYCGLWELLPNRSALVLCAGDGWDKALVGNYTIDATNRSYAGYTIQHNGDRRMEDYEPIVELDLRISTKFRASPLLHNLGIVSGINLMVAGPRTAFGVLGVYSLTARKFTEEEIEFLKVASHILAAAIDRQEYEERLLLLQQAIDASSNGILITDALGSDNAVVYANQGFETITGFNREEVIGQNCRFLLNEDRQGEQNKQLEKLRTAIAHGQECEVVLKNYRKDGASFWNHLYLSPIYNQQNFLVNFIGIQTDVTQQKLAEQQLRASEEFFSSMIVTITDGLLIVDQEGIIQFVNPAAREMFKRQEGELLQQPFGIPFVADQATEITLTPLDGSMVVAEMRVSPIHWQKGKAFLVSLRDITEQHQARLALAESEKKYRYIVELTSEGIWILDQDQQTTFANQQLADMLGYSVQEILEKNITAFVLVIHHLPESQNSHQKTLQSFPRCVLPNHGQVYDVQFQRRDGSVLWGLVSRSAWYDQWGNYRGELAMLTDITKRKSAEQALSASEQRLEGILGSIQDVVWSADAVSFATLYLNPTTAMVYGQSLEVCYQSQNFWFEQVHPGDRLLLEYHLQLLMEKDQTELEYRIVQPGGKERWLFRRSQLVRDGEHQPLRIDSIDSDITERKLAAEKLHYNANHDSLTNLPNRSMFLDRLGHALQRNLRRRDLRFAVLFLDLDGFKIINDSLGHSCGDLLLQGIAHRLRQCLRPEDTLARLGGDEFTMLIENITCPEDVIAVAQRIHQELQKPFNLNGQEIFTNTSIGIALNHPHYGHPQDVLRDADTAMYRAKAAGKGRYAIFNQTMHHHAVQRLQRENDLRRAIDRQELQLHYQPIVCLKTGQLQGVEALVRWQHPEEGLILPEEFVAIAEETGLIVPMGDWILWEASRQILELKQSFPQLSHLQVSINVSSRQLRDQRLLKTVDEILSSTNLAPQDLKLEITESLLIDNLNLAADVLKSLRQRNIQISLDDFGTGYSSLSYLHRFPINTIKVDRSFVNTMEPNNQNTAIVHTIVTLAHTLGLDVIAEGIETERHLTQLHWLGCDAGQGYYFARPIPSEDLLDFLTIQIPRWSVPAVTECHGDRKEPFS

SEQ ID NO: 11627 - protein, 468 aa, Synechocystis sp. PCC 6803
MNPSSSPSQSTANVKFVLLISGVAALGGFLFGFDTAVINGAVAALQKHFQTDSLLTGLSVSLALLGSALGAFGAGPIADRHGRIKTMILAAVLFTLSSIGSGLPFTIWDFIFWRVLGGIGVGAASVIAPAYIAEVSPAHLRGRLGSLQQLAIVSGIFIALLSNWFIALMAGGSAQNPWLFGAAAWRWMFWTELIPALLYGVCAFLIPESPRYLVAQGQGEKAAAILWKVEGGDVPSRIEEIQATVSLDHKPRFSDLLSRRGGLLPIVWIGMGLSALQQFVGINVIFYYSSVLWRSVGFTEEKSLLITVITGFINILTTLVAIAFVDKFGRKPLLLMGSIGMTITLGILSVVFGGATVVNGQPTLTGAAGIIALVTANLYVFSFGFSWGPIVWVLLGEMFNNKIRAAALSVAAGVQWIANFIISTTFPPLLDTVGLGPAYGLYATSAAISIFFIWFFVKETKGKTLEQM

SEQ ID NO: 11628 - protein, 394 aa, Synechocystis sp. PCC 6803; identical to SEQ ID NO: 840

SEQ ID NO: 11629 - protein, 184 aa, Synechocystis sp. PCC 6803
MIKLYGAPQSRASIIQWYLEELSLPYEFVNVNLKEGEHRQAPYLAINPFGKVPAIADGNFHLWESGAILLYLAEKASTIPADAQARALVNQWILFANSTLANGLFIEAVREKEMPRLLQSLEKILGRSPFILGEKFSVVDVAVGSILAYVPIMLKLNFDDYPAVAAYVQGLVQRPAFQASIGAR

SEQ ID NO: 11630 - protein, 748 aa, Synechocystis sp. PCC 6803
MATTVQLSDQSLRQLETLAIHTAHLIQPHGLVVVLQEPDLTISQISANCTGILGRSPEDLLGRTLGEVFDSFQIDPIQSRLTAGQISSLNPSKLWARVMGDDFVIFDGVFHRNSDGLLVCELEPAYTSDNLPFLGFYHMANAALNRLRQQANLRDFYDVIVEEVRRMTGFDRVMLYRFDENNHGDVIAEDKRDDMEPYLGLHYPESDIPQPARRLFIHNPIRVIPDVYGVAVPLTPAVNPSTNRAVDLTESILRSAYHCHLTYLKNMGVGASLTISLIKDGHLWGLIACHHQTPKVIPFELRKACEFFGRVVFSNISAQEDTETFDYRVQLAEHEAVLLDKMTTAADFVEGLTNHPDRLLGLTGSQGAAICFGEKLILVGETPDEKAVQYLLQWLENREVQDVFFTSSLSQIYPDAVNFKSVASGLLAIPIARHNFLLWFRPEVLQTVNWGGDPNHAYEATQEDGKIELHPRQSFDLWKEIVRLQSLPWQSVEIQSALALKKAIVNLILRQAEELAQLARNLERSNADLKKFAYIASHDLQEPLNQVSNYVQLLEMRYSEALDEDAKDFIDFAVTGVSLMQTLIDDILTYAKVDTQYAQLTFTDVQEVVDKALANLKQRIEESGAEIEVGSMPAVMADQIQLMQVFQNLIANGIKFAGDKSPKIKIWGDRQEDAWVFAVQDNGIGIDPQFFERIFVIFQRLHTRDEYKGTGMGLAICKKIIEGHQGQIWLESNPGEGSTFYFSIPIGN

SEQ ID NO: 11631 - protein, 675 aa, Synechocystis sp. PCC 6803
MSNSPSVLTELLQALPNLRAQTYFKSSLTALSHAMEDQVLAESTAGNPLIIAAFQRERFYRQEAHRYRRIADKSSQVYVLSAPETEFKHNSGIYETIAFTPEDSLAQEWHLIVIGDRYASCLICRERPTQDKWDSNRRFEGVWTFDRQVSRVAAQLLLQRILAYRPELQAKIEEATQTWLQPSCTVPPRGIDDNPDPFVQRLITYLQAGQYKLIKANRNLQDKEERERLLNSITGAVRRSLDPEEIMQVAVEKLGQGLGICRCVIYRCSADDTVATINHEFLGSGVGSIKGYPWPLKDNPLFQEVVVLKEAIAIDNIDRDPRLGEPEPSTGEVKTLVKSCAILSWMLVPIFYRERLLGMMEFHHCGPAPTEWEDDALTLVEGVATQIGVALIQAESYANLQELNEQLAALDRTRSNLVAITGHELRTPLSTIQVCLESLATEPDMPQELRQVMLNTALEDAERMRKLVQDFLTLSQLESGRVEWNAEPISLEECVELSLSHIRAHNRGQEVPVIVNQVNGETPMVEADGEWLVELLTKLLDNAIKFTPTNGRISIAVDRPNPSQLEVTITDTGRGIEPNRLETVFDRFYQEEGALRRSRGGTGIGLAICRQIVSGWGGEIWAASDGKNHGTQFHFTVPIVMPENPNLGVEEVAPKKRKATSPRIASRSKKKQKFS

SEQ ID NO: 11632 - protein, 404 aa, Synechocystis sp. PCC 6803
MTKPSNDEPPLTNVRDLEAMLPLEEEDLTADSQDLEYTAVAHRQQFSTDLVRLYLQDIGRIPLLKRDEEVHIAQQVQSYLRLVEIQNRAAESDAAIDQYQTAIAVHDQLLVQLGHRPSYERWAKILGQTVATLKQTLKSGKKRWAELAGLTVEELENIEKQGITAKAHMIKANLRLVVSVAKKYQNRGLELLDLIQEGTLGLERAVEKFDPTKGYRFSTYSYWWIRQGITRAIATQSRMIRLPVHITEKLNKIKRAQRKISQEKGHTPKIDEVAEELGMTPEQVREVLTQVPRSVSLELKVGQDKDTELMDLLETDTQSPEDELMREALQNDMQEILLDLTPREQEVIALRFGFQDGVAHSLSEIGRILNLSRERVRQIEAKALQKLRHPRRRDRIRDYYENLG

SEQ ID NO: 11633 - protein, 417 aa, Synechocystis sp. PCC 6803
MGSNFPNRKSLQTAGDGFEQSIARLIASMIPVQEIYYWRLGASPETPEIIEIIPTLSMAFQTGHSPWPMAEKCLKFIGDRQGDLQRGKSLLTDLKQHWQEITSASFDSGAVQANTNDDLPYFFLPVFQQNQYVGGICLVWPHSQWRLEQYLFLQEVGNVFTYQYHGESETISPQKSFNGGDRHTSMTINLSHIHHEFRTPLTAIIGFARMLRDELYGKLNPKQHQYVQGTLNSAEHLLSLVNDFLDLSKIDARCEELFYEQVAVEDLCLAVISMVQTKAKEKQLALNLTIDDGVDFCYVDQRRWKQILINLLSNGVKFTPKGSVTLAVKATDKALIFSVIDTGIGIDPEDQRDLFQPFKQISHPPSFAEKGTGLGLALSRRLAQLHGGDIQLTSTPGVGSCFSAILPLKTSVKNYQT

SEQ ID NO: 11634 - protein, 1195 aa, Synechocystis sp. PCC 6803
MKSAFLDRIHSPDRPVLVFDGAMGTNLQVQNLTAADFGGAEYEGCNEYLVHTKPEAVATVHRAFYEAGADVVETDTFGGTPLVLAEYDLADQSYYLNKAAAELAKAVAAEFSTPEKPRFVAGSMGPGTKLPTLGHVDYDSLKDAYVVQVRGLYDGGVDLLLVETCQDVLQIKAALNAIEQVFAEKGDRLPLMVSVTMETMGTMLVGTEMAAALAILEPYPIDILGLNCATGPDLMKEHVKYLSEHSPFVVSCIPNAGLPENVGGQAFYRLTPMELQMSLMHFIEDLGVQVIGGCCGTRPDHIKALADIAKDLQPKQRQPHYEPSAASIYSTQTYAQENSFLIIGERLNASGSKKCRDLLNAEDWDSLVSLAKSQVKEGAQILDVNVDYVGRDGVRDMKELASRLVNNVTLPLMLDSTEWQKMEAGLKVAGGKCILNSTNYEDGEERFYKVLEIAKEYGAGIVIGTIDEDGMGRTADKKFEIAKRAYEAAIAFGIPATEIFFDPLALPISTGIEEDRENGKATVDAIRRIRQELPDCHILLGVSNVSFGLNPAARQVLNSIFLHECMQVGMDAAIVSANKILPLAKIDPEQQQVCLDLIYDRREFEGERCTYDPLTKLTTLFEGKTTKRDKSGDANLPVEERLKRHIIDGERLGLEEALNEALKLYAPLDIINIYLLDGMKVVGELFGSGQMQLPFVLQSAQTMKAAVAFLEPHMDKDDSADNAKGTFLIATVKGDVHDIGKNLVDIILSNNGYRVVNLGIKQPVENIIEAYKKHRPDCIAMSGLLVKSTAFMKENLEVFNQEGITVPVILGGAALTPKFVHQDCQNTYKGQVIYGKDAFADLHFMDKLMPAKNSHNWDDFQGFLGEYATENGHNVTTDDGAKTNFGIEEEKLIDASEQSREPEVIDTVRSEAVDPDLERPVPPFWGTKILQSSDISLDEVFPLLDLQALFVGQWQFRKPREQSREEYEQFLAEKVHPILAEWKGKVMAENLLHPTVVYGYFPCQSQGNTLLIYDPELVSQNNGQIPPDATAIAKFEFPRQKSGRRLCIADFFASKESGITDVFPLQAVTVGEIATEYARKLFAGDNYTDYLYFHGMAVQMAEALAEWTHQRIRQELGFGHLDPDNIRDLLQQRYQGSRYSFGYPACPNMQDQYTQLELLQTERIGLYMDESEQVYPEQSTTAIISYHPAAKYFSA

SEQ ID NO: 11635 - protein, 444 aa, Synechocystis sp. PCC 6803
MITSPTNLNSLPIPPGDFGLPWLGETLNFLNDGDFGKKRQQQFGPIFKTRLFGKNVIFISGALANRFLFTKEQETFQATWPLSTRILLGPNALATQMGEIHRSRRKILYQAFLPRTLDSYLPKMDGIVQGYLEQWGKANEVIWYPQLRRMTFDVAATLFMGEKVSQNPQLFPWFETYIQGLFSLPIPLPNTLFGKSQRARALLLAELEKIIKARQQQPPSEEDALGILLAARDDNNQPLSLPELKDQILLLLFAGHETLTSALSSFCLLLGQHSDIRERVRQEQNKLQLSQELTAETLKKMPYLDQVLQEVLRLIPPVGGGFRELIQDCQFQGFHFPKGWLVSYQISQTHADPDLYPDPEKFDPERFTPDGSATHNPPFAHVPFGGGLRECLGKEFARLEMKLFATRLIQQFDWTLLPGQNLELVVTPSPRPKDNLRVKLHSLM

SEQ ID NO: 11636 - protein, 806 aa, Synechocystis sp. PCC 6803
MVQEKPRFTRPLRYQLLAGCALILMITSAIAVVLTRQQLQEKSRINIITRAQRLTEGLEFAAEGLVETKDVYRLNRLAQNYATWPNVQTISIVDPNGILIAHGGEIKMVRGEKYAQVTPALFPIFEQVSISGIPQSLITQIEEEEVVVYALPFNTYSFPEQGESYRDQNSHRRGVAITILSKQELNREVNQGLLLVVGSFIIGIVVILLLLGLLIRYAVLLPLGKLHRALINYDNTEQFNLPPLPSNEIGFLGQTLVQTFNQLQIYQREALEIAERKYVEIAQRYELASQATRVWVWECQPKIHYFEVDPNLITWLGFEQPLEPADGDFFIHLGDRPMFWQAIEQSLEDPTMELSTELRLEAANGEIYHCLLRGQIHQEQGEAFVKIIGTIADITEIKKAEEQLKLSNKILAKATQLKDEFLANMSHELRTPLNSILGMIETLQNQVYGPLNGKQVQSLEIVENSGRHLLSLINDILDLSKIEAGRMDLDLNPTSVSALVNHSLTFVQQFAIQKQINLSSEIIPNLPDVLVDKRRLCQVLINLLNNAIKFTPEGGKVVVQADLIKEQGKENSQSPPQLSFTVFDTGIGIEADRLNNIFEPFVQIDSALNRRYDGTGLGLSLVKKIVELHGGSVTVTSKLNEGSRFKITIPCVFQDKDGPRHRGQLVEVTNHGSPTPIIITLISKNSAYATTLSSYFRAKGYQMQWLNCLYPTAAELTQLVKIGDQSCHVLVMDLANTGEEVKDKLDEIRKFFGSSPITIIALVDATEQTKSNIAQLEIATNELLVKPVRFHRLMEIVREETCPVPR

SEQ ID NO: 11637 - protein, 818 aa, Synechocystis sp. PCC 6803
MVSSVVEKTSVAHKETALILWFEEVGTHDVGLVGGKNSSLGEMIQQLTNKGVNVPSGFATTAYAYRYFIQEAGLEQKLRDLFTDLDVNDMANLQERGHLARQLILDTPFPQNLQTAIAEAYGAMCERYGQKMGRTGVDVAVRSSATAEDLPEASFAGQQETYLNVHSLSCVLESCHKCFASLFTDRAISYRHHNGFDHFAVALSVGVQKMVRSDLATSGVMFSIDTETGFKNAALITAAYGLGENVVQGAVNPDEYFVFKPTLKEGFKPILEKRLGSKAIKMVYDVGGSKLTKNVEVAEPEREKYCINDEEILQLARWACIIEDHYSGVRGVYTPMDIEWAKDGQTGELFIVQARPETVQSQKSANVIKTYELKDHSQVLATGRSVGAAIGQGKAQVIRNVSQINQFRPGEVLITNRTDPDWEPIMKQASAIVTNQGGKTCHAAIIAREMGIPAIVGCGDATDTIKTGEDVTICCSEGDEGSVYSGILNYEVHETELSNLPRTKTQILMNVGNPEQAFGFASYPADGVGLARLEFIIANHIKAHPLALMKFDELEDPLAKAEIAELTKLYAGDRPRFFVDKLAHGIAMIAAAFYPKPVVVRMSDFKSNEYANLLGGRQFEPKEENPMIGWRGASRYYDPNYREAYALECQALKRVRDEMGLTNVIPMIPFCRTPDEGRKVIAEMAKHGLKQGKNGLEIYVMCELPSNVILADEFSEVFDGFSIGSNDLTQLTLGLDRDSSLVAHLFDERNLGVKRMVKMAIETAKANGRKIGICGQAPSDYPEFAEFLVELGIDSISLNPDSVLKTVLRIAEVEKALG

SEQ ID NO: 11638 - protein, 720 aa, Synechocystis sp. PCC 6803; identical to SEQ ID NO: 673

SEQ ID NO: 11639 - protein, 101 aa, Synechocystis sp. PCC 6803
MSIYVGNLSYDVSEADLTAVFAEYGSVKRVQLPTDRETGRMRGFGFVELEADAEETAAIEALDGAEWMGRDLKVNKAKPRENRSGGGSFGGGRKSYGGSRY

SEQ ID NO: 11640 - protein, 333 aa, Synechocystis sp. PCC 6803; identical to SEQ ID NO: 667

SEQ ID NO: 11641 - protein, 469 aa, Synechocystis sp. PCC 6803
MLSTEMPLPTTGSTLLKTPASPSPNQNLLPLTAVINKNGELEIGGCSVPALVEQFGSPLYILDETTLRQAAQQYRQSFQAHYPGSSQVIYASKAWSCLAVVAIAAQEGLGFDVVSGGELFTTVSALKQLGWDEAEIAEKIYFHGNNKSVQELQEAIAINCTIIVDNWLELETLTKLAADSGAPVKIMLRLTPGIECHTHEYIKTGHLDSKFGFDPNQLEAVFTYIAQQPSLHCLGLHAHIGSQIFERQPHKDLGEVLVQWFTKGLTYGLPLTELNIGGGLGICYTESDDPPSIEEWAQVAAISVAKACDRQNIPYPKLIAEPGRSLVGSACVTAYRVGGRKVVPNIRTYISVDGGMSDNPRPITYQSVYRVALANRMNDEITETVTVAGKHCESGDILVKDVALPAAEPGDIMVVAATGAYNHSMASNYNRLGRPAAVLVNQGQANLILQRETYTDLLRQDCLPNRLLS

SEQ ID NO: 11642 - protein, 425 aa, Synechocystis sp. PCC 6803
MTQTKEPLTKAESAELEQEIELSQYINTDDIDDDDIDVEDLEQEVAATEGKEKKVRKIRKDAVKKKPYTEDSIRIYLQEIGRIRLLRAEEEIELARQIADLLELELIRDNLTLQLERQPSELEWGKQVWKLETAKQRLVGDKKKEPKKKDIDSYLANPDNELSLENEWSQQPNKNFAAFRRRLFLDRRAKDKMVQSNLRLVVSIAKKYMNRGLSFQDLIQEGSLGLIRAAEKFDHEKGYKFSTYATWWIRQAITRAIADQSRTIRLPVHLYETISRIKKTTKLLSQEMRRKPTEEEIAEKMEMTIEKLRFIAKSAQLPISLETPIGKEEDSRLGDFIEADGETPEDEVSKNLLREDLENVLDTLSPRERDVLRLRYGLDDGRMKTLEEIGQIFNVTRERIRQIEAKALRKLRHPNRNSILKEYIR

SEQ ID NO: 11643 - protein, 432 aa, Synechocystis sp. PCC 6803 [sequence omitted]

SEQ ID NO: 11644 - protein, 351 aa, Synechocystis sp. PCC 6803
MGGTTGGGSNPCGHESSTLSPSPFLVKTIIANDKLAVKMTNLPHQCEQIFLLDGGLETEMIFNRGFDLPAFAAHTLLSDPLGREALKNYFHGFLDLAKEKQFGFLIDAPTWRAQPFFAEELGVSLEEIRQANFRAVEFARALKQAYVNEIQPLLINGLIGPCGDAYGGEHFSNAEAAQVYHRQQISWLAEAGVDLLGAFTLTSVNEAIGIVRASQEFSLPVSISFTVETDGRLPTGTALSEAIAIVDEATNQGAAYFMVNCAHPDHFRAVIREEAWLSRLGGFRCNPSRRSHAQLDQANFLDIGNPVELAHSYWTLKQKVPSANVFGACCGSDLRHIREIAKVFDEKISKI

SEQ ID NO: 11645 - protein, 720 aa, Phytophthora cinnamomi
MSQVLQHPRVFTFVKGESKGNGSMKPLLGGKGANLCQMARNGVNVPPGLTITTEVCQEFYAVGGRLPDGLMDEVRKGVHLMEKTLGVTFADATNPLLVSVRSGAAISMPGMMDTVLNLGLNDEIVKGVAKRGGERFAFDCYRRLLQMFGDVVLEIPHDDFEAELSAMKQARHVTFDVELTASDLKELVHKYKKVYEKHGRSFPSDPWEQMRMGIEAVFRSWNIPRAVKYREINKITGLKGTAVNVQAMVYGNINDQSCTGVLFTRNPANGENKLYGEFLLNAQGEDVVAGIRTPQPISELAQKMPTVYKQLDETVHTLETHFKDVQDTEFTVQDGVLFMLQTRNGKRTGPAALKIAVDMWREKLITEEEAVMLVEPRHLDQLLHPSFANEKGYQKDVLCRGLPASPGAAVGKIVFTAADAEAWFARGENVMLVREETSPEDVGGMHAAEGILTSRGGMTSHAAVVARGWGKPCVCGCSALSIDANSKTMRVHTASGAEVVLREGDYISVNGTTGEVIKGEQELQKAAMSGDLAQFMKWVDAHRRMEVFTNADTPEDAREARAHGAQGIGLTRTEHMFFSSAQRIAAVRRMIGAVELDSPAQQEALDALCTFQQGDFEGIFRAMDGLPVTIRMLDPPLHEFLPHEGSALEELCETLAKEMKVSKATVQSRLAGLKEANPMMGLRGCRLGIVHPGITEMQAKAIAEAAVKVAGEGISVHPHI

SEQ ID NO: 11646 - protein, 900 aa, Phytophthora cinnamomi
MSQVLQHPRVFTFVKGESKGNGSMKPLLGGKGANLCQMARNGVNVPPGLTITTEVCQEFYAVGGRLPDGLMDEVRKGVHLMEKTLGVTFADATNPLLVSVRSGAAISMPGMMDTVLNLGLNDEIVKGVAKRGGERFAFDCYRRLLQMFGDVVLEIPHDDFEAELSAMKQARHVTFDVELTASDLKELVHKYKKVYEKHGRSFPSDPWEQMRMGIEAVFRSWNIPRAVKYREINKITGLKGTAVNVQAMVYGNINDQSCTGVLFTRNPANGENKLYGEFLLNAQGEDVVAGIRTPQPISELAQKMPTVYKQLDETVHTLETHFKDVQDTEFTVQDGVLFMLQTRNGKRTGPAALKIAVDMWREKLITEEEAVMLVEPRHLDQLLHPSFANEKGYQKDVLCRGLPASPGAAVGKIVFTAADAEAWFARGENVMLVREETSPEDVGGMHAAEGILTSRGGMTSHAAVVARGWGKPCVCGCSALSIDANSKTMRVHTASGAEVVLREGDYISVNGTTGEVIKGEQELQKAAMSGDLAQFMKWVDAHRRMEVFTNADTPEDAREARAHGAQGIGLTRTEHMFFSSAQRIAAVRRMIGAVELDSPAQQEALDALCTFQQGDFEGIFRAMDGLPVTIRMLDPPLHEFLPHEGSALEELCETLAKEMKVSKATVQSRLAGLKEANPMMGLRGCRLGIVHPGITEMQAKAIAEAAVKVAGEGISVHPHIMIPLVGSFEELEQQVKLVKSVVQDVIGKRGKSFDYKVGTMIEVPRGALQAGKLAEVAEFFSFGTNDLTQMTFGISRDDAQAKFLSYYVKHGVLEKDPFETLDQEGVGELVRLAVERGRATRPKIELGICGEHGGDPQSIEFFEKVGLKYVSCSPMRVMIARLAAAQAALKLKKSSPVPGA

SEQ ID NO: 11647 - protein, 900 aa, Phytophthora cinnamomi
MSQVLQHPRVFTFVKGESKGNGSMKPLLGGKGANLCQMARNGVNVPPGLTITTEVCQEFYAVGGRLPDGLMDEVRKGVHLMEKTLGVTFADATNPLLVSVRSGAAISMPGMMDTVLNLGLNDEIVKGVAKRGGERFAFDCYRRLLQMFGDVVLEIPHDDFEAELSAMKQARHVTFDVELTASDLKELVHKYKKVYEKHGRSFPSDPWEQMRMGIEAVFRSWNIPRAVKYREINKITGLKGTAVNVQAMVYGNINDQSCTGVLFTRNPANGENKLYGEFLLNAQGEDVVAGIRTPQPISELAQKMPTVYKQLDETVHTLETHFKDVQDTEFTVQDGVLFMLQTRNGKRTGPAALKIAVDMWREKLITEEEAVMLVEPRHLDQLLHPSFANEKGYQKDVLCRGLPASPGAAVGKIVFTAADAEAWFARGENVMLVREETSPEDVGGMHAAEGILTSRGGMTSHAAVVARGWGKPCVCGCSALSIDANSKTMRVHTASGAEVVLREGDYISVNGTTGEVIKGEQELQKAAMSGDLAQFMKWVDAHRRMEVFTNADTPEDAREARAHGAQGIGLTRTEHMFFSSAQRIAAVRRMIGAVELDSPAQQEALDALCTFQQGDFEGIFRAMDGLPVTIRMLDPPLHEFLPHEGSALEELCETLAKEMKVSKATVQSRLAGLKEANPMMGLRGCRLGIVHPGITEMQAKAIAEAAVKVAGEGISVHPHIMIPLVGSFEELEQQVKLVKSVVQDVIGKRGKSFDYKVGTMIEVPRGALQAGKLAEVAEFFSFGTNDLTQMTFGISRDDAQAKFLSYYVKHGVLEKDPFETLDQEGVGELVRLAVERGRATRPKIELGICGEHGGDPQSIEFFEKVGLKYVSCSPMRVMIARLAAAQAALKLKKSSPVSGS

SEQ ID NO: 11648 - protein, 747 aa, Homo sapiens
MEIPNPPTSKCITYWKRKVKSEYMRLRQLKRLQANMGAKALYVANFAKVQEKTQILNEEWKKLRVQPVQSMKPVSGHPFLKKCTIESIFPGFASQHMLMRSLNTVALVPIMYSWSPLQQNFMVEDETVLCNIPYMGDEVKEEDETFIEELINNYDGKVHGEEEMIPGSVLISDAVFLELVDALNQYSDEEEEGHNDTSDGKQDDSKEDLPVTRKRKRHAIEGNKKSSKKQFPNDMIFSAIASMFPENGVPDDMKERYRELTEMSDPNALPPQCTPNIDGPNAKSVQREQSLHSFHTLFCRRCFKYDCFLHPFHATPNVYKRKNKEIKIEPEPCGTDCFLLLEGAKEYAMLHNPRSKCSGRRRRRHHIVSASCSNASASAVAETKEGDSDRDTGNDWASSSSEANSRCQTPTKQKASPAPPQLCVVEAPSEPVEWTGAEESLFRVFHGTYFNNFCSIARLLGTKTCKQVFQFAVKESLILKLPTDELMYPSQKKKRKHRLWAAHCRKIQLKKDNSSTQVYNYQPCDHPDRPCDSTCPCIMTQNFCEKFCQCNPDCQNRFPGCRCKTQCNTKQCPCYLAVRECDPDLCLTCGASEHWDCKVVSCKNCSIQRGLKKHLLLAPSDVAGWGTFIKESVQKNEFISEYCGELISQDEADRRGKVYDKYMSSFLFNLNNDFVVDATRKGNKIRFANHSVNPNCYAKVVMVNGDHRIGIFAKRAIQAGEELFFDYRYSQADALKYVGIERETDVL

SEQ ID NO: 11649 - protein, 529 aa, Neurospora crassa
MAMSTVAAALGKLLFVAVVTLVISVANALSSVPELSDWEQDQYLTLQLTVPLGSGDAKPIRHRVVPLTEAVGMNQSVIARESITIKGTMVPTEESGWLEFIDSNSIAYLNCDNSNSTSFFDQLMSKAPKAILLFSLAGAGCRRDSTDDWNYTTLFTMTDQIDARDTLNLTMSGSLATITGDYEEPDDDDDEDRTGHGSPIAMNILYSITGVITLLFLAIIATGAIRAHRYPERYGPRPGYGGRPSQSRAKGLARAVLETLPIVKFGEKSPAKPDPDFQLEQQPSRSSQDPTPRAKLSAIQEAVPSIAKSQGPMTVASVEASEQASSATVYGAQTGMTNTAGDIENTTPDDINLGCPICTEDFTIGEDVRVLPCNHRYHPACVDPWLVNISGTCPLCRLDLRPHSSTESTTGPGDNHSVSLPTAAGDNAQQPGTSGSPMPSTTPRERRRSLRILDLHRLRAASIEERMEILRRHRSQQQQRRHVTGSSLTGDPDTGESADPTHRARLAERFRGRFRASRPPGRRSHNQQR

SEQ ID NO: 11650 - protein, 214 aa, Medicago sativa
MATIKVHGSPISTATMRVTATLYEKELEFEFVSINMRNGEHKKEPFISINPFGQVPAFEDGDLKLFESRAITQYIDHEYADKGTKLTSSDSKKMAIMSVWSEVESLHYDKVASILVWELGIKTLFGIPLDSKVVEENEAKLDSILDVYEKRLSESKYMGGECFTLVDLHHLPSLHYLMKSQSKKLFESRPYVNAWVDDITARPAWSKVLAMIPN

SEQ ID NO: 11651 - protein, 208 aa, Mycoplana dimorpha
MVLAAIFFGGTPILATAMAYPLAICAACVITSIIGTFFVKLGTNNSIMGALYKGLIVTGALSILGLGAATSFTIGWGSIGTVGGIEVRGGNLFVCGLIGLVVTALIVVITEYYTGTNKRPVNSIAQASVTGHGTNVIQGLAVSLESTALPAIVIVGGIIATYQLAGLFGTAIAVTAMLGLAGMIVALDAFGPVTDNAGGIAEMSHLSP

SEQ ID NO: 11652 - protein, 225 aa, Mycoplana dimorpha
AIGSAGLGALVLFAAYSNDLSYFAANGDKYPYFANIGEISFDLSNPYVVAGLIFGGLIPYLFGGIAMTAVGRAAGSIVEEVRRQFKEKPGIMQGKDKPNYGRAVDLLTKAAIREMIVPSLLPVLAPLVVYFGVLLISGSKASAFAALGASLLGVIVNGLFVAISMTSGGGAWDNAKKSFEDGFVDKDGQRHMKGSEAHKASVTGDTVGDPYKDTAGPAVNPAIKI

SEQ ID NO: 11653 - protein, 392 aa, Glycine max; identical to SEQ ID NO: 1827

SEQ ID NO: 11654 - protein, 224 aa, Oryza sativa (japonica cultivar-group)
MGRGKIEIKRIKNATNRQVTYSKRRTGIMKKARELTVLCDAQVAIIMFSSTGKYHEFCSPSTDIKGIFDRYQQAIGTSLWIEQYENMQRTLSHLKDINRNLRTEIRQRMGEDLDGLEFDELRGLEQNVDAALKEVRHRKYHVITTQTETYKKKVKHSYEAYETLQQELGLREEPAFGFVDNTGGGWDGGAGAGAAADMFAFRVVPSQPNLHGMAYGGNHDLRLG

SEQ ID NO: 11655 - protein, 629 aa, Homo sapiens
  unsure (1)..(629): unsure at all Xaa locations
MGERRRKQPEPDAASAAGECSLLAAAESSTSLQSAGAGGGGVGDLERAARRQFQQDETPAFVYVVAVFSALGGFLFGYDTGVVSGAMLLLKRQLSLDALWQELLVSSTVGAAAVSALAGGALNGVFGRRAAILLASALFTAGSAVLAAANNKETLLAGRLVVGLGIGIASMTVPVYIAEVSPPNLRGRLVTINTLFITGGQFFASVVDGAFSYLQKDGWRYMLGLAXVPAVIQFFGFLFLPESPRWLIQKGQTQKARRILSQMRGNQTIDEEYDSIKNNIEEEEKEVGSAGPVICRMLSYPPTRRALIVGCGLQMFQQLSGINTIMYYSATILQMSGVEDDRLAIWLASVTAFTNFIFTLVGVWLVEKVGRRKLTFGSLAGTTVALIILALGFVLSAQVSPRITFKPIAPSGQNATCTRYSYCNECMLDPDCGFCXKMNKSTVIDSSCVPVNKASTNEAAWGRCENETKFKTEDIFWAYNFCPTPYSWTALLGLILYLVFFAPGMGPMPWTVNSEIYPLWARSTGNACSSGINWIFNVLVSLTFLHTAEYLTYYGAFFLYAGFAAVGLLFIYGCLPETKGKKLEEIESLFDNRLCTCGTSDSDEGRYIEYIRVKGSNYHLSDNDASDVE

SEQ ID NO: 11656 - protein, 512 aa, Rhodococcus sp. RHA1
MTFQVALSFEDGITRFIKCDGDETVADASYRARINIPLDCRDGACGTCKSLCESGTYDGGDYIEEALTDEEAEHGYCLPCQMMPESDLVLQIPTTSDVAKTAAGTFTSTVTEIRKFSDTTIGFTIEIANRDDLVFLPGQYVNITVPGTEATRSYSFSTGPTSKELSFLVKITDGGLMSEYLRSRAQVGDTLEFTGPMGSFFLREQKRRALLLAGGTGLAPLLSILDKMRTDAADHPVHLVYGVSSDADLVELDKLEEYTKSLPQFTFDYCVSDPASSAPNKGYVTGLFEPAHLNDGDVDVYLCGPPPMVEAVRDHLKSEGVTPANFYFEKFNNAATPSGSEASAPPAAETVEAAPEYEIGEEHQPLSESDAQFDARMALELGAMELTIGRMTQEQLSEYRILAETSCESIENDHFTDAGAFTDTNAAFHEFLFRCTANDVLLEAYNRLEVTQLMTKVLRTADWVDEHIQHDHLDIVTAFEKGDRAAAHDLIVSHSAHAKATMCRAIERSAVA

SEQ ID NO: 11657 - protein, 264 aa, Rhodococcus sp. RHA1
MSGLVTPHRFDGKVVAVTGAAQGIGLTVATRLAAEGASLILIDRAEIVHEVAKGLRENGTDAHSITADLEQFADAEAAIDEARQQHGRLDVLINNVGGTIWAKPYEHYTAEQIQAEVQRSLFPTLWTCRAVLPHLIAQQSGTIVNVSSVATRGVNRVPYAASKGGVNALTASLALEAAQYGIRVVATAPGGTEAPARRVPRGPGAETDQEKAWYQQIVDQTVDSSLLKRYGTLDEQAAAIVFLASDEATYITGTVLPVAGGDLG

SEQ ID NO: 11658 - protein, 460 aa, Homo sapiens
MAGYLSESDFVMVEEGFSTRDLLKELTLGASQATTDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKKPSTEQPLYSSSLWGPAVDGCDCVAEGLWLPQLHVGDWLVFDNMGAYTVGMGSPFWGTQACHITYAMSRVAWEALRRQLMAAEQEDDVEGVCKPLSCGWEITDTLCVGPVFTPASIM

SEQ ID NO: 11659 - protein, 506 aa, Yersinia pseudotuberculosis
MRYAHPGTPEALVSFKATYGNYIGGEFVEPLGGQYFMNTSPVNGSDIAQFPRSDARDIDAALDAAHRAADAWGKTSVQHRSNLLLQMADRIEANLEYLAVAESWDNGKPIRETLNADLPLAVDHFRYFAGCLRAQEGGVAEIDEKTVAYHFHEPLGVVGQIIPWNFPLLMAAWKLAPALAAGNCVVLKPAEQTPLGITLLLELVGDLFPAGVLNVVQGYGREAGEALASSKRIAKIAFTGSTPVGRHIMACAAENIIPCTVELGGKSPNIYFADVMEAEPEFIEKAVEGLVLGFFNQGEVCTCPSRALIHESIYAPFMARVMAKVANIRRGDPLDTETMIGAQASRQQFDKILSYIDIARKEGGEILTGGARATMTPALDAGFYIQPTLIKGDNLMRCFQEEIFGPVIGVTTFKDEAEALAIANQTQFGLGAGIWTRDTHLAYRMGRGIKAGRVWTNCYHVYPAHAAFGGYKQSGVGRETHKMALNQYQQTKNLLVSYDTAPLGLF

SEQ ID NO: 11660 - protein, 500 aa, Citrus sinensis
LLLIPLLLILKKLKAQNKQQLPPSPPKLPVIGNFHQLGELPHQSLWQLSKKYGPVMLLKLGRVPLVVISSAEAARDVLKVHDLDCCSRPPLIGSGKFTYNYSDIAFSPYSDYWRELRKISVLEVFSLRRVQSFGFIREEEVALLMNSISESSSSASPVDLSEKMFALTGSIVFRMAFGRRFRGSNFDNHSFQELVHAVESLLGGFAAAECFPYVGWIIDRLNGYHAKLERVFQELDTLFQQIIDDHLKPAETTKQEHVQQDIIDVMLKIERDQAESHESEAWLTKNHIKAVLLNIFLGGVDTSAITVIWAMAELCKNPRLMKKAQAEIRNHIGNKGRVTEADIDQLQYLKMVIKETLRLHPPAPLLIARDTLYRFKVNGYDIYPKTLIQVNAWAIGRDSKYWESPEEFIPERFIDKPVDVKGQDFEYLPFGSGRRICPGINLGLIMSELALANLLYCFDWKLPNGREEDCVNMNMEEATGVSLTLSKKTPLILVPVNYLQ

SEQ ID NO: 11661 - protein, 264 aa, Streptomyces purpurascens
MSSRFTPTSRVAVVTGATSGIGLSVTRSLAAVGHRVFLCARDADRVALTVKELRAEGHDVDGAACDVRDVAQIESLVSAAVERYGPVEVLVNNAGRSGGGPTHTIADELWDDVMATNLDSVFRVTRAVLTTGRMREGGWGRVVNIASTGGKQGVVLGAPYSASKHGVVGFTKALGLELAKTGITVNAVCPGYVETPMAVRVRQGYAAAWETSEEEVLDRFQAKIPLGRYTTPDEVAGMVGYLLTDAASSVTAQAINVCGGLGNY

SEQ ID NO: 11662 - protein, 274 aa, Hyoscyamus niger
MAGESEVYINGNNGGIRWSLKGTTALVTGGSKGIGYAVVEELAGLGARVYTCSRNEKELQQCLDIWRNEGLQVEGSVCDLLLRSERDKLMQTVADLFNGKLNILVNNAGVVIHKEAKDFTKEDYDIVLGTNFEAAYHLCQLAYPFLKASQNGNVIFLSSIAGFSALPSVSLYSASKAAINQITKNLACEWAKDNIRVNSVAPGVILTPLIETAIKKNPHQKEEIDNFIVKTPMGRAGKPNEVSALIAFLCFPAASYITGQIIWADGGFTANGGF

SEQ ID NO: 11663 - protein, 98 aa, Nicotiana tabacum
WFITRGLNPTFDAFDCQLHEFHTEENKLVGNLSWRIRTPDGGFFTRSAVQKFVQDPKYPGILYNHDNEYLHYQDDWYILSSKVENSPEDYIFVYYKGR

SEQ ID NO: 11664 - protein, 292 aa, Oryza sativa; identical to SEQ ID NO: 3209
  unsure (1)..(292): unsure at all Xaa locations

SEQ ID NO: 11665 - protein, 422 aa, Cyanidium caldarium
EFGTRKDVQVYFIQVLLYLYKEECQEITTAKDIFLIRWISIKMIAVQPQPKKTPVAEYLQTSQDTPTSLTRYLLEVAKQNKDMGDMVALINGIQFACKKIASLVGKAGVTDLMGIYQQGIVNVHGEEQKKLDVLSNEVLKNALKYSGKMAVIASEEEDVPIMVEESYSGNYVVVFDPLDGSSNLDAGLPTGTIFGVFQQQFSCLIHDYEESIDNMELACLQNTLQPGRRLIAAGYCIYSSSTMLVLSLGNGLHCFTLDTEVGEFVLTRANIQIPQRGNIYSFNESNFYQWDKGVQDYIERLKKGNNQTNCRYSARYVGSMVADVHRTILYGGIFGYPADKKNVSGKLRLVYECAPMAYLVEQAGGKATTGIENILDLTPKDIHERKPLILGSPADIEEFLQVYGMSRVDREDMHMWDNLSSL

SEQ ID NO: 11666 - protein, 167 aa, Oryza sativa
MGMASFTRQPFYCKSLACHHQQNPASTIVAIDKNLDTSTPDTYRAPPTPLPYDVGLVLKDNPDLEKTGIKRKIHEHKESLMMDDNESLQKCVSEDKPDEEDVCPICLEVFRYSPEYDEENPRSMTKCEHHFHLCCILEWMERSETCPVCDQGKLVVDLKLKNTNFDV

SEQ ID NO: 11667 - protein, 278 aa, Rhizobium sp. NGR234
MERFEGKVAVVTGAGAGIGKACALAIAREGGRVVVADLDGSAAIACTAQIAAEAGNALAMAMDIADAQAVAALFETAERHFGGVDLLVNNASAMHLTPRDRAILDLDLAVWDQTMATNLRGTLLCCRQAIPRMIARGGGAIVNMSSCQGLSGDTAQTSYAVSKAAMNMLSASLATQYGHAQIRCNAVAPGLIMTERLLAKLDKCMQRHLSRHQLLPRVGHPEDVAALVAFLLSDDASFITGQVVCIDGGMLAHMPTYADGGNSCAGRTAGDTAETARC

SEQ ID NO: 11668 - protein, 345 aa, Rhizobium sp. NGR234
MRRSKYERPAHLIGNAERPRLTTSAMIASIAGADQPTRPAPFGHALSALAEKDDRVVGLSADLAKYTDLHVFRAAHPDRFYQMGMAEQLLMMSAAGMAREGLQPWVTTYAVFASRRAYDFICLAIAEEMLDVKVVCALPGLTTGYGPSHQATEDIAMFRGMPNLTIIDPCDASEIEQAVPAIAAHEGPVYMRLLRGNVPLVLEEYGYRFELGKAKLLRDGRDTLIISSGLMTMRALEAAEELRKNGIDAGVLHVPTIKPLDEATILAECARQGRLVVVAENHTVIGGLGEAVAATLMRSAVRPAAFRQIGLPDAFLEAGALPTLHDMYGISTTKIVAQIKEWLDE

SEQ ID NO: 11669 - protein, 253 aa, Rhizobium sp. NGR234
MLLKGKTAVISGAASKRGIGRATAELFASHGARVAILDINADEAKAAAGDLPPVEHGAHIGLRCDVADRASCTSASDEVLSAFGVANILINNAGITQPVKTLDISDADWQRIVAVNMTGVLNLSQVFIPNMRQNGGGSIACMSSVSAQRGGGIFGGPHYSAAKAGVLGLAKAMAREFGPDSIRVNCVTPGLIQTDITGDKLSAEMRADIVKGIPLSRLGDARDVANIYLFLASDLSAYVTGAVIDVNGGMLIH

SEQ ID NO: 11670 - protein, 491 aa, Rhizobium sp. NGR234
MTLTSALTRHLKCPELFRNLANEPHPSVAGQRQRFSVFNPSTGELLAEVPDMGAADAHAAIERADAAQEPWSGLTARARSDILWKWHRFILEHSDDLAAILTAEMGKPLGEAKSEVQHAAAYLQWYAEEANRIYGETISAPSTDRRMLVIKQPIGVVGAITPWNFPASMVARKISPALAAGCTVVLKPAEQTPLVAGAMFALAKLAGFPDGVLNLVYASEGDAIGRELCTNPKVRKISFTGSTEVGRLLMRQCSDQIKRISFELGGNAPFIVFDDADIDAAVDGAIQAKFRNAGQTCVSANRIYVQSGVYAEFAEKFTERVRTLKVGDGFDPNVAIGPLINQEALKKIELHISDAVQKGARVRSGGRRTGSSGTFFEPTVVTDVSKTMRLAEEETFGPLAPLLRFDDADHVVREANDTIYGLAAYFYASNLKRVWRVAEALEYGMVGINTGRMSSEAAPFGGVKQSGIGREGSRHGLEDYLDMKYLCVGGL

SEQ ID NO: 11671 - protein, 512 aa, Rhizobium sp. NGR234
MDAGRRRLVINDCMKPERGRRSPLPRRPTRPPDERSSGIGNLAMTPAKLHMTTSLAPIAVHSPYDGSLLGSVEATDPADIDRLLATARRGAEISRNLPRHKRASILEGAAQMVESRHDAFAEIIVREAGKTIVQARKEVLRCVNTLKLSAEEAKRNAGEIVPFDAYTGSEQRQGWFTRDPLGIITAITPYNDPLNLVAHKLGPAIAGGNAVMLKPSNLTPFSAIKLVGALREAGLPEEVITISHGDRELVTAMIAAREVRMVSFTGGFATGEAISRAAGLKKLAMELGGNAPVIVMNDCDFDKAVEGCVSGAFWAAGQNCIGAQRILIQSELYGRFRDAFVAATKKLKAGDPLQEDTDVGPMISKQVAERTEAAVNEAIKAGATLLCGNYREGSLYHPTVLEGTPLTCRLWHEEVFAPVVMLAPFDTLDKGIEMANDPDYSLHAGIFTNDLNVALEAANRIEVGGVMINDSSDYRFDAMPFGGFKYGSMGREGVRFAYEDMTQPKVVCINRG

SEQ ID NO: 11672 - protein, 548 aa, Rhizobium sp. NGR234
MDDRQVQPGRVIVVTGAAGGIGRALVDIFAANGDVVVAVDLPDSGVIELGQNLGEPHLGLEVDVSREDDVVALRALLEKRFSRIEVLVNNAGIGPTMAATADTALEDFQRALAINLVGAYSVACETAKLMKPGAAIVNVASLAGLLGNPKRSAYAASKAGLISITKSLACRWASRGIRVTAVAPGHVRTPMVAELERAGKLDVSAIRRRVPLGRIARPDEIARAVRFLASAQASYITGSTLVVDGGWMSVNQPGGAHQAQDRTPGAEFMRPVEDTDARTVIVMGGATGVGAAIARRFAENGDTVVIADGDGEEAVKLAGLLGDKHLSRRVDRTVETEVVSLFEELRERFGHLDVFVNGMNEILVPNTEESPEVLKRILDVNLTGAFTCVREAAISMRSGSVILNLGASLSLSPLAPSHAYGAYNAGIDMLTRCTAAELGPLGIRTATVAPGYIRTCAANRLAAVAGMDSASLRQRIPLGRVGDAEEVAEAAYFLASFDASYINGSILHVDGGLISSREAGWGSEVDGAISAEMRPQRRPAARWRLLSP

SEQ ID NO: 11673 - protein, 311 aa, Trypanosoma cruzi
MTTLTTLPSRPLSSNTREQFERYNRMDILGEGTYGVVYRAVDKITGQIVALKKVRLDRTEEGIPQTALREVSILQEIHHPNVVNLLDVICTDGKLYLIFEYVDYDLKKAIEKRGCTFTGVTLKKLVYQLLDGLFFCHRHRIVHSDLKPANILITSDNVLKLADFGLARTFQIPMHTYTHEVVTLWYRAPEILLGEKHYTPAVDIWSVGCIFAELARGKVIFRGDSEIGQLFEIFQILGTPMDNEGSWPGVSSLPDYRDVFPRWAGKPLAQVIPQLDSEAIDLISRMLKYSPAERISAKEALQHSWFSEIRT

SEQ ID NO: 11674 - protein, 229 aa, Magnolia praecocissima
MARGKIQIKKIDNVTARQVTFSKRRRGLFKKAEELSILCDAEVALIIFSATGKLFEYSSSSMKEIIERHTMHSKNLQKLDQQPSLELQLENSNYNRLSKQVAEKSHLIRQMRGEDIQGLTVEELQKLEKTLETGLSRVMERKAEQIMKEISGLQIKGVKLMEENMRLRQRIIEMSRGDSKGDRQIIESEIVVNEDGQSSDSVTNACNSGAPQDYESSDTSLKLGVPFSS

SEQ ID NO: 11675 - protein, 208 aa, Magnolia praecocissima
NRQVTFCKRRNGLLKKAYELSVLCDAEVALIVFSSRGRLYEYANNSVRNTIDRYKKACADSSSLGCVSEANSQYYQQESSKLRQQIALLQNANRHLMGEALSSMTVKELKQLENRLEKGISRIRSKKNELLFAEIEYMQKREVDLQNDNMYLRAKITENERAQQQMGMLPAPEYDVMPGFDSRNFLQVNLMDSSHHYSHQEQTALQLG

SEQ ID NO: 11676 - protein, 231 aa, Magnolia praecocissima
ENKINRQVTFSKRRNGLLKKAYELSVLCDAEVALIVFSSRGKLYEFGSAGINKTLERYQRCCYTFHDANITDRDTQGWYQEVSKLNAKCDSLQRSQRHLLGEDLGPLSVKELQKLERQLESALTQTRQRKTQIMLEHMEALREKERQLGDINKELKNKLEAKGQGAFRAMQASWESGPLVGNNGFPMHPSQSAAIECEPTLQIGYHSFAAPEANIPRTVVAESNFMHGWIL

SEQ ID NO: 11677 - protein, 173 aa, Magnolia praecocissima
  unsure (1)..(173): unsure at all Xaa locations
KKAYELSVLCDAEVALIVFSPRGKLYEFGNAGMQKTIDRYLKHSKDTNINKAAVEQNVQLWKYEAAHMSKKIEILEDSKRKLLGESLESCSIEELQHIENQLERSLKNIRGRKSQLYVEQIKQLKEKERILSEENTVLIEKCGLRPQEPSTIQREIVPYDQGTQDQEVELXCT

SEQ ID NO: 11678 - protein, 214 aa, Magnolia praecocissima
MGRGKIEIKRIENSTNRQVTYSKRRGGIMKKAKELTVLCDAQVSLIMFSSTGKFSEYCSPSTTTKNIFDRYQQASGISLWNSHYERMQSHLIKLKEENNNLRREIRQRIGEDLEDLEIEELRGLEQNLESSIKVVRDRKYHVITTQTETYKKKLRSLRDEHAKLIRQLEGQAENGAYGLVDNGGPDYESALVLANGGVHSLHDTGFGIHDLRLA

SEQ ID NO: 11679 - protein, 180 aa, Magnolia praecocissima
ELSVLCDAQVSLVIFSSTGKMSEYCSPSTELVKILDRYHKNAGVQKLWDAKHEHLSNELERIKKENDSMHIKLRHLKGEDINSLHPKELIPIEEALENGLACVRSEQMQCLKTLKKNERSLEEDNRRLSYILQHQQQLAMDVNVREMDHGYHQREREYHPQMPFAFRVQPIQPNLHQNNK

SEQ ID NO: 11680 - protein, 187 aa, Magnolia praecocissima
  unsure (1)..(187): unsure at all Xaa locations
ELTVLCDAEVALIVFSPRGKLYEFASSSMHKTIDRYERHAKDISIANKTVEQNVQQWKFEAAHMAKKIEHLEVSKRKLLGEGLGSRPIEELQQIESQLERLSSIRARKTLLFTEQIQQLKEKERFLTEENAILSKKADDLSVQPLQQLSPTQKEIVPYDDETRXPEVETELFIGRPERGKKRYPMKV

SEQ ID NO: 11681 - protein, 231 aa, Magnolia praecocissima
ENKINRQVTFAKRRNGLLKKAYELSVLCDAEVALIIFSNRGKLYEFCSSSSMLKTLERYQKCNYGAPELPVSTRETQSYHQEYLKLKARVEALQRSQRNLLGEDLGPLSGKELETLERQLDISLRQIRSTRTQCMLDQLGDLQRREHMLSEANKTLTRRLEEGAQANQNQVWEPNAHAVDSYNRQQPQQQGDGFFHPLECEPTLHIGYQPDQITIAAPGPSVNNYMPGWLV

SEQ ID NO: 11682 - protein, 240 aa, Magnolia praecocissima
MGRGRVQLKRIENKINRQVTFSKRRMGLLKKAHEISVLCDAEVAVIVFSTKGKLYEYSTDSRMSRILERYERYSYAERELVLSGPESEGSWCLEYGKLKAKVESLQRNLRHFTGEDLDTLSLKELQQLEHQLDAALKHIRSRRPIMLIHCGASKKEKSLREQNNMLEKEIQEKEKAMAQQAQWEQQNQSQSSHPSWLASPLPTLNIGTYHQGNEVEEEGARPPARTNSLMPPWMLRHVNE

SEQ ID NO: 11683 - protein, 489 aa, Homo sapiens
MADYLISGGTGYVPEDGLTAQQLFASADGLTYNDFLILPGFIDFIADEVDLTSALTRKITLKTPLISSPMDTVTEADMAIAMAKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 11684 - protein, 816 aa, Oryctolagus cuniculus
MLLWSAVRGLSPPRIVPSLLVVVALAGLLPGLRSHGLQLSPTDSTTPDSQPSRERSIGDVTTAPPEVTPESRPVNRSVTEHGMKPRKAFPVLGIDYTHVRTPFEISLWILLACLMKIGFHVIPTISSIVPESCLLIVVGLLVGGLIKGVGEKPPFLQSEVFFLFLLPPIILDAGYFLPLRQFTENLGTILIFAVVGTLWNAFFLGGLMYAVCLVGGEQINNIGLLDNLLFGSIISAVDPVAALAVFEEIHINELLHILVFGESLLNDAVTVVLYHLFEEFANYDHVGIVDIVLGFLSFFVVALGGVFVGVVYGVIAAFTSRFTAHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSEEPQLIAFYHKMEMKQAIELVESGGMGKIPSAVSTVSMQNIHPKALPAERILPALSKDKEEEIRKILRNNLQKTRQRLRSYNRHTLVADPYEEAWNQMLLRRQKARQLEQKINNYLTVPAHKLDSPTMSRARIGSDPLAYEPKADLPVITIDPASPQSPESVDLVNEELKGKVLGLSREPRVAEEAAEEDEDGGIVMRPKEPSSPGTDDVFSPAPSDSPSSQRMQRCLSDPGPHPEPGEGEPFIPKGQ

SEQ ID NO: 11685 - protein, 296 aa, Rhodococcus ruber
GSGHDATLPLPGHPGREWPGPLRSDGPAWHDGPAVNETTDTLTVLAVDDEPPALDELAYLLRRREEIGHVHTAGEATTALRLLRDGGIDAVFLDINMPGLDGLELAGILRNFANPPAVVFVTAHDDRAVAAFDLGAVDYLLKPLREERLAEAVRRIAERRRTRETESAAAGAAASDEVIPVELGGVTTLVPRSSVQWVEADGDYARLHTGTGSHLVRIPISTLESRWADAGFLRVHRSYLVALPLVTGIRSVGSGLVVCLRAEEGKPAVELPVSRRHTRELKDRLIRGPMQTWTSR

SEQ ID NO: 11686 - protein, 365 aa, Homo sapiens
MELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKKPSTEQPLYSSSLWGPAVDGCDCVAEGLWLPQLHVGDWLVFDNMGAYTVGMGSPFWGTQACHITYAMSRVAWEALRRQLMAAEQEDDVEGVCKPLSCGWEITDTLCVGPVFTPASIM

SEQ ID NO: 11687 - protein, 626 aa, Homo sapiens [sequence omitted]

SEQ ID NO: 11688 - protein, 320 aa, Homo sapiens
MTSPPAYKVGDKIATQKTYGLALAKLGRANERVIVLSGDTMNSTFSEIFRKEHPERFIECIIAEQNMVSVALGCATRGRTIAFAGAFAAFFTRAFDQLRMGAISQANINLIGSHCGVSTGEDGVSQMALEDLAMFRSIPNCTVFYPSDAISTEHAIYLAANTKGMCFIRTSQPETAVIYTPQENFEIGQAKVVRHGVNDKVTVIGAGVTLHEALEAADHLSQQGISVRVIDPFTIKPLDAATIISSAKATGGRVITVEDHYREGGIGEAVCAAVSREPDILVHQLAVSGVPQRGKTSELLDMFGISTRHIIAAVTLTLMK

SEQ ID NO: 11689 - protein, 781 aa, Xenopus laevis
MGKKVFLNYCGYIFILALIPIVFSESSYLLNPVTLASRTSTIPLMISNMNRHDSTNHSQGGGHHGKKKAFPVLDLDYTRIRMPFEIALWILLASLMKLGFHVIPTLSNVVPESCLLIVVGLLVGGLIKAVGETPPVLNSDVFFLFLLPPIILDAGYFLPLRPFSENLGTILMFAVVGTLWNAFFLGSLLFAVCQIGGEDLRNVGLLANLLFGSIISAVDPVAVLAVFEEIHINELLHILVFGESLLNDAVTVVLYHLFEEYASLEQITFRDISLGFLSFLVVALGGVFVGLVYGIIAAFTSRFTSHIRVIEPLFVFLYSYMAYLSAELFHLSGIMALIATGVVMRPYVEANISHKSHTTIKYFLKMWSSVSETLIFIFLGVSTVAGPHKWNWPYVISTLIFCFVSRVLGVLGLQWFLNKFRIVKLTPKDQFIIAYGGLRGAIAFSLGYLLDSNHFPREMFLIAIITVIFFTVFVQGMTIRPLVELLAVKKKQESKRSINEEIHSEFLDHLLTGIEDICGHYGHHHWKDKLNRFNKTYVKKCLIAGERSTEPQLIAFYHKMEMKQAIELVEGGGIGKIPSTVSTVSMQNIQPKPKLAERFIPTLSKGKEEEIRKILRTNLQKTRQRLRSYNRHTLVADPYEDAWNQMLLRRQKVHQMEQRVTNYLTVPAHKLDSPTMSRARVGSDPLAYEPKPDSENIPTITIDPASPESVDTVNETQEEEEGITMTVREPPSPGADDVFIPQESPNSQRLQRCLSDPGPHPEEIQPFIPQKKKLIDFVKGL

SEQ ID NO: 11690 - protein, 907 aa, Carassius auratus
MDFRGNLQRQIKPKTQTEEERKVNSPQQVDFRAVLGKKGSQGPNPGLGSLVKTQANKTEAVDFRSVLGNKKKQPCLDRNGESQGDKDTRGKKNDVNCVDGGIKEKTKAAGKKELVFTQKLSDVRVLDGERLHLQCQLSSESPAKVTWTLDGKLIKPSKFIIIADEGGKCSLSIDKALPEDEGQYVCRAETNEGKTECSCMVLVDDPSVSTPADKRSRKPSTPTTENEARIKKPTPKTLPKQGAPPQILQFPDDMKIWRVRRSVCCRFTGAQPISCTWLKFRKPIQEGQGISIVSTDSSSQLTITEGQQEHCGCYTIELKNSCGVRQAALNLTIVDKPDPPARVPAASDIRKSSLTLSWYGPTYDGGSAVQTYNLEMWSSVDMKWTDLASCNSTSYNVQNLLPDRQYKFRVRAVNIYGVGEPSAESVPVQVGPEAEEENKDEAEPSDDESEKEPDYRSVTIRTDVKVKDLYDVEDRLGTGKFGAVFKLIEKSTKKVWAGKFIKAYSAKEKDNVRQEIAIMNDLRHPKLVQCVDAFEGKTDIVMVLEMVSGGELFERIIDEDFELTEREVIKYMLQIVDGVSFIHKKGIVHLDLKPENIMCVNKTGSKIKLIDFGLARRLENAGSLKVLFGTPEFVAPEVINYEAISYATDMWSIGVICYILVSGLSPFMGDNDNETLSNVTSATWDFEDEAFDEISDEAKDFISNLLKKDMKARLSCDQCFQHPWLKQDTTNMEVKKLSKERMKKYILRRKWQKTGHAVRAIGRLSNMALLAGVHAKKGSPTEEDKQFSAELVEKPLMKPTFSSVIKDVEVVEGSAARFDCKIEGYPDPEVVWYKDDQPIKETRHFQIDYDEDGNCSLVISEVSGDDDAKYTCKAMNSVGEATCTAELIVEVMGAGEEEEEEEEEEEE

SEQ ID NO: 11691 - protein, 353 aa, Drosophila melanogaster
MTTAQHQHYTVEVGDTNFTIHSRYINLRPIGSGAQGIVCAAYDTITQQNVAIKKLSRPFQNVTHAKRAYREFKLMKLVNHKNIIGLLNAFTPQRNLEEFQDVYLVMELMDANLCQVIQMDLDHDRMSYLLYQMLCGIKHLHSAGIIHRDLKPSNIVVKADCTLKILDFGLARTAGTTFMMTPYVVTRYYRAPEVILGMGYTENVDIWSVGCIMGEMIRGGVLFPGTDHIDQWNKIIEQLGTPSPSFMQRLQPTVRNYVENRPRYTGYSFDRLFPDGLFPNDNNQNSRRKASDARNLLSKMLVIDPEQRISVDEALKHEYINVWYDAEEVDRPLRSHMITAWTKGNTLWSSGRS

SEQ ID NO: 11692 - protein, 380 aa, Pichia angusta
MSTVGKTITCKAAVAWEAGKDLTIETIEVAPPKAHEVRVKIAYTGVCHTDGYTLSGNDPEGQFPVIFGHEGAGVVESVGEGVTSVKVGDHVVCLYTPECRECKFCKSGKTNLCGKIRATQGKGVMPDGTSRFTCKGKTLLHYMGCSTFSQYTVLADISVVAVDPKAPMDRTCLLGCGITTGYGAAINTAKISEGDNIGVFGAGCIGLSVIQGAVKKKAGKIIVIDVNDAKKDWAFKFGATDFVNPTKLPEGQSIVDKLIEMTDGGCDFTFDCTGNVQVMRNALEACHKGWGESIIIGVAPAGKEISTRPFQLVTGRVWRGCAFGGIKGRTQMPDLVQDYMDGEIKVDEFITHRHPLNDINQAFHDMHKGDCIRAVVTMDE

SEQ ID NO: 11693 - protein, 164 aa, Pisum sativum
SSQINRVRNGELYRVICDTKGAFVQPAVYEAFGLTVVEAMATGLPTFATLNGGPAEIIVHGKSGFHIDPYHGEGAADLLVEFFEKVKSDPSHWDKISLKGGLQRIEEKYTWQIYSQRLLTLTGVYGFWKHVSNLDRLESRRYLEMFYALKYRKSAESVPLAVEE

SEQ ID NO: 11694 - protein, 539 aa, Sus scrofa
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSVGRQSSAPASPAASAAGLAGQAAKSLLNKKSDGGVKPQSNNKNSLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 11695 - protein, 491 aa, Escherichia coli
MMSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCKAAFEQKILARVERIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 11696 - protein, 345 aa, Mycobacterium tuberculosis
MGTQSPALSLNPMTVQADREVAMADAPTRATTSRVDSDLDAQSPAADLVRVYLNGIGKTALLNPAGEVELAKRIEAGLYAEHLLETRKRLGENRKRDLAAVVRDGEAARRHLLEANLRLVVSLAKRYTGRGMPLLDLIQEGNLGLIRAMEKFDYTKGFKFSTYATWWIRQAITRGMADQSRTIRLPVHLVEQVNKLARIKREMHQHLGREATDEELAAESGIPIDKINDLLEHSRDPVSLDMPVGSEEEAPLGDFIEDAEAMSAENAVIAELLHTDIRSVLATLDEREHQVIRLRFGLDDGQPRTLDQIGKLFGLSRERVRQIERDVMSKLRHGERADRLRSYAS

SEQ ID NO: 11697 - protein, 338 aa, Homo sapiens [sequence omitted]

SEQ ID NO: 11698 - protein, 490 aa, Aspergillus fumigatus
MPTLGGLLKKRRTKDSHTLSKELESSSSPAAAQTQTSPNSADHDHHYQHYDQTHHHQHSASSNPSNNSATPSAAQPHRSSNDNPNRSSGTDQKSEGQTASMQFAVTQPHPSTHHNPRLHHLQQQQQQPQQQSHTSRLHNILHPSHHASSQASTEGHAHSQQANQTEARTTKGKYSLDDFTIQRTLGTGSFGRVHLVQSKHNHRFYAIKVLKKAQVVKMKQVEHTNDERRMLNRVRHPFLITLWGTWQDARNLYMVMDFVEGGELFSLLRKSQRFPNPVAKFYAAEVTLALEYLHSQQIIYRDLKPENLLLDRHGHLKITDFGFAKEVPDITWTLCGTPDYLAPEVVSSKGYNKSVDWWSLGILIFEMLCGFTPFWDSGSPVKIYENILRGRVKYPPYLHPDAVDLLSQLITADLTKRLGNLHGGSEDVKNHPWFAEVTWDRLARKDIDALYVPPIREGQGDASQYDRYPEETEQYGQQGEDVHGHLFPDF

SEQ ID NO: 11699 - protein, 162 aa, Dictyostelium discoideum
MSLVKLESSDEKVFEIEKEIACMSVTIKNMIEDIGESDAPIPLPNVTSTILEKVLDYCRHHHQHPSPQGDDKKDEKRLDDIPPYDRDFCKVDQPTLFELILAANYLDIKPLLDVTCKTVANMIRGKTPEEIRKIFNIKNDFTPEEEEQIRKENEWCEDKGGN

SEQ ID NO: 11700 - protein, 301 aa, Trypanosoma cruzi
MSTRYERQEKIGEGTYGVVYRARDTATGATVALKRIRLDTEEEGVPCTAIREISLLKELRHANIVKLLDVCHSESRLTLVFEYMELDLKKYMDQEEGNLDAATIQDFMRDLLNGVRFCHDRNVLHRDLKPPNLLISREKSLKLADFGLGRAFGIPVKKFTHEVVTLWYRSPDVLLGSTQYGTPVDIWSVGCIFAEMVIGAPLFAGKNDADQLLRIFRFLGTPNNQVWPSMNQYPNSTNMLFKPEFLQNLAAECETQFRTVPAYAKLGPGGIDLLRRLLKYEPSERLTAAQALEHPYFSVEF

SEQ ID NO: 11701 - protein, 283 aa, Leishmania donovani
MAGVDKAMVTLSNGVKMPQFGLGVWQSPAGEVTENAVKWALCAGYRHIDTAAIYKNEESVGAGLRASGVPREDVFITTKLWNTEQGYESTLAAFEESRQKLGVDYIDLYLIHWPRGKDILSKEGKKYLDSWRAFEQLYKEKKVRAIGVSNFHIHHLEDVLAMCTVTPMVNQVELHPLNNQADLRAFCDAKQIKVEAWSPLGQGKLLSNPILSAIGAKYNKTAAQVILRWNIQKNLITIPKSVHRERIEENADIFDFELGAEDVMSIDALNTNSRYGPDPDEAQ

SEQ ID NO: 11702 - protein, 591 aa, Solanum dulcamara
MGTPKEEATDEVFSENLEQKPDPDPATSKSELKETTSKSISGELQKRLSQCDKGINMSQSNQEAISLSRVQENQSENVQKQLGLKSEADASGSSQLSSLPKDSDAKSRGSESSVKDKVVSVLSGMASDSSDQMQTSNMEVFVSQSDQQRVSYQIKREKALDKLQPRRNPDTSVHGLTSDQGMTLSKAPEKPSEDGYNWRKYGQKLVKGNEFTRSYYKCTYPNCLAKKQVERSHDGHITDIHYIGKHEHPETLSVPQMSPELVLPLQMIQQDIPIITALEAEGEKSTTPRETCEPSKPSEVPLALDVVSACGGVKVTPLKQHKLENEVDKDDVPDSKRQKKDIVATDYTPPVKSHSEPRHIVQTMSEVDIINDGQRWPKYGQKIVKGNPNPRSYYRCSVAGCPVKKHVERASHDPKLVITTYEGHHVHDFPTSKAIGQISAAPDTGTAGVREDSRIESGESKHVVESKSESGENKHIREPKTEAGGNKRVGESIPESGENKHIREPKTEAGENKHIGESRIESGGNKHVEKSKLELGGNKHVGESIPKPGGNKHVGESIPESGGNKHVGESIPESGENKHVGLDMAVHIGAN

SEQ ID NO: 11703 - protein, 677 aa, Anabaena sp.
FGPFYDYTPTIRDPKNIGKGVQYLNRYLSSKLFQDSQQWLESLFNFLRLHNYNGIQLLINHQIQSQQQLSQQVKNALNFVSDRPNDEPYEQFRLQLQTMGFEPGWGNTASRVRDTLNILDELIDSPDPQTLEAFISRIPMIFRIVLVSAHGWFGQEGVLGRPDTGGQVVYVLDQAKNLEKQLQEDAILAGLEVLNVQPKVIILTRLIPNSDGTLCNQRLEKVYGTENAWILRVPLREFNPKMTQNWISRFEFWPYLETFAIDSERELLAEFQGRPDLIVGNYTDGNLVAFLLTRRMKVTQCNIAHALEKSKYLFSNLYWQDLEEKYHFSLQFTADLIAMNAANFVISSTYQEIVGTPDSIGQYESYKCFTMPELYHVVNGIELFSPKFNVVPPGVNENSYFPYTQTQNRIESDRDRLEEMLFTLEDSSQIFGKLDDPNKRPIFSMARLDRIKNLTGLAECFGQSQELQERCNLILVAGKLRIEESEDNEEKDEIVKLYRIIDEYNLHGKIRWLGVRLSKNDSGEIYRVICDRQGIFVQPALFEAFGLTILESMISGLPTFATQFGGPLEIIQDKINGFYINPTHLEETATKILDFVTKCEQNPNYWNIISEKAIDRVYSTYTWKIHTTKLLTLARIYGFWNFTSKEKREDLLRYLESLFYLIYKPRAQQLLEQHKYR

SEQ ID NO: 11704 - protein, 759 aa, Tetraodon nigroviridis
MVLTGKRSEKGPACWKRRVKSEYMRLRQLKRFRRADEIKSMFSTNRQKIMERTDILNQEWKTRRIQPVHIMTSVGSLRGTRECTVDSSFSEFPRQVIPLKTLNAVASVPVMYSWSPLQQNFMVEDETVLHNIPYMGDEILDQDGTFIEELIKNYDGKVHGDRECGFINDEIFVELVNALAQYSDNEDEEEEEEHDFKVDKIDLCDSKKHPEDGRKDGLVNNEGRSGADGSKKFPSDKIFEAISAMFPDKGSTEELKEKYKELTEQQMPGALPPECTPNIDGPHARSVQREQSLHSFHTLFCRRCFKYDCFLHPFHATPNTYKRKNLENLVDSKPCGLDCYMYLVQDGMASEYAAGAERTKTPSKRPAGRRRGRQPNSSSRPSTPTVSSESKDADSDREGSKEDERENEKDEDDKKDENTSSSEGNSRCQTPVKMKLVGEAEAVDWNGAEASLFRVLIGTYYDNFCAIARLIGTKTCRQVYEFRVKESSIIARAPAEDEDTPPRKKKRKHRLWATHCRKIQLKKDGSSNHVYNYQPCDHPRQPCDSSCPCVTAQNFCEKFCQCSSECQNRFPGCRCKAQCNTKQCPCYLAVRECDPDLCLTCGAADHWDSKNVSCKNCSIQRGAKKHLLLAPSDVAGWGIFIKEPVQKNDFISEYCGEIISQDEADRRGKVYDKYMCSFLFNLNNDFVVDATRKGNKIRFANHSVNPNCYAKVMMVNGDHRIGIFAKRAIQTGEELFFDYRYSQADARKYVGIEREMEIA

SEQ ID NO: 11705 - protein, 806 aa, Nostoc punctiforme
MSELLQAVLDSEERSDLRSFLSELRQQEKKYLLRNDILNVYSEYCSKSQKPEAYYTTSELGKLIYYTQEIIQEDSNFCFIIRSKIASQEVYWLTSDLSIEPMTVQDLLDLRDRLVNKFHPNDGDLLELDFGPFYDYTPIIRDPKNIGKGVQFLNRYLSSKIFQDSKQLLENLLNFLRLHHYNGVQLLVNDRIQSQQQLSEQVKKAIGFVNNRPDDEPYEQFRFQLQSMGFEPGWGNTAARVRETLNILDELIDSADPQTLEAFISRVPMIFRIVLVSAHGWFGQEGVLGRPDTGGQVVYVLDQAKSLEKQLQEDVLLAGLEKLNVEPKVIILTRLIPNSDGTLCNQRLEKVHGTENAWILRVPLRDFNPNMTQNWISRFEFWPYLETFAIDSERELRAEFQGTPDLIVGNYTDGNLIAFLLARRLKVTQCNVAHALEKSKYLFSNLYWQELEEKYHFSLQFTADLIAMNAANFVVSSTYQEIVGTPDSVGQYESYKCFTMPELYHVTNGIELFSPKFNVVPPGVNENNYFPYTRTKDRVESDRQRLAETLFTLEDPTQIFGKLDDPNKRPLFSMARLDHIKNLTGLAECYGQSKELQEHCNLILVAGKLRVEESGDNEERDEIIKLYNIIDEYNLHGKIRWLGVRLSKTDSGEIYRVIADRQGIFVQPALFEAFGLTILESMVSGLPTFATQFGGPLEIIQDKVNGFLINPTNLDETATKIVDFITKCEQNPNYWNEISQRGIDRVYSTYTWKIHTSKLLSLARIYGFWNFTSKENREDLLRYLEALFYLIYKPRAQQLLEQHKYR

SEQ ID NO: 11706 - protein, 470 aa, Prochlorococcus marinus
MSLKFLYLHLHGLIRSNNLELGRDSDTGGQTQYVLELVKSLANTSEVDQVDIVTRLIKDSKIDSSYSKKQEFIAPGARILRFQFGPNKYLRKELFWPYLDELTQNLIQHYQKYENKPSFIHAHYADAGYVGVRLSQALKVPFIFTGHSLGREKKRKLLEAGLKINQIEKLYCISERINAEEESLKYADIVVTSTKQESVSQYSQYHSFSSEKSKVIAPGVDHTKFHHIHSTTETSEIDNMMIPFLKDIRKPPILAISRAVRRKNIPSLVEAYGRSEKLKRKTNLVLVLGCRDNTFKLDSQQRDVFQKIFEMIDKYNLYGKVAYPKKHSPANIPSIYRWAASSGGIFVNPALTEPFGLTLLEASSCGLPIIATDDGGPNEIHAKCENGLLVNVTDINQLKIALEKGISNSSQWKLWSRNGIEGVHRHFSWNTHVRNYLSILQGHYEKSTIVSSSGIKESCLKGSSSLIKPH

SEQ ID NO: 11707 - protein, 346 aa, Nicotiana tabacum
MSPPLLDVREEEGQSNVTLLASSASLGSICKKGSELKERNYMGLSDCSSVDSCTISTSSEDNNACGLNLKATELRLGLPGSLSPERGIETCPLASNEKLLFPLHPAKDSALAVSQKTVVTGNKRRFSDAMDGFSEGKFMPNSGLKAGDTKETSRVQPPKMKEATNQNTVPERTSAVNGASNRVGSGAPATKAQVVGWPPIRSFKKNTLASTSKNNEKVDGKAGSPALFIKVSMDGAPYLRKVDLKNYSAYQELSSALEKMFSCFTIGQYGSHGAPGKEMLSESQLKDLLHGSEYVLTYEDKDGDWMLVGDVPWEMFIETCKRLRIMKGSDAIGLAPRGMEKCRSRN

SEQ ID NO: 11708 - protein, 599 aa, Physcomitrella patens
MALRIENPYYKLLDTDEEIVEDFELMSRNARETQLELLRKILERNANVEYLQRQGLNGRTDEASFKACVPVSTYANIEADVDRIADGDTSPICCVDPPTSFALSSGTTGGKCKLIPRTDALLAQAMKAGQIGSVYRRRAFPRKHEGPPVVMSFQYAGRQFDTKSGLKAGTGTTNFYRSAAFKNAKSAPFSATSPVDIVLGYDVPQQMYCHLLCGLYRCQEVEQMSAIFAYMIVEPFRLLERVWRDICKDIREGTVNERVSDPELRSSVLKVLSPNPELADLIERECAKGWSGIIERLFPNINYIMSIFSGSMLPYVAPMRQYAGSVPLMNADYGASEAWIGINLDPRCPAEDASFTIIPNFAYFEFIPVNRDSAGYDSVEGDEIVGLTDVKVGQEYEIVLTTVGGLYRYRLGDIVKVTGFFNSTPKVAFVCRKGVVLSVNTDKTDEEELRLVVGKASLLLKESNMELADYSSYTDQDSQPGHYVIFWELRSHEHLDMDLLSECCKVLDQSFNNPYMRGRAARTIGPLELAIVKEGAFARLMEQFVRKNGVGASQYKVSRCFKNPATLKHFRDETIATLRSPDFPPELLAAWRPSTKIVG

SEQ ID NO: 11709 - protein, 484 aa, Physcomitrella patens
MNVSEGCSTLTGAQLKYSTDKSNMSYETVYRDAAVESPQREVSNESGSTLKEHDYFGLSEVLSSNSSSGKQPEKCCREELNLNESATTLQLGPPAAVKPSGQADGDDAHDEGAGPENPAKRSAYHMQQESLADGRKAAAEMGSFKIQRKNILEEFRAMKAHAHMTKSPKTVQTMQHNMHVSYSGAQMAFGGAKNNGVKRVFSEAVVANHNAASGVGVGVREGNDDVSRCEEMNGTEQLDLKVHLPKGMGMARMAPASGSPSFDNMQGPLNPFFRKSLVSKMPVPDGGDSSANASNDCANRKGMVASPSVQPPPAQNQTVGWPPVKNFNKMNTPAPPASTPARACPSVQRKGASTSSSGNLVKIYMDGVPFGRKVDLKTNDSYDKLYSMLEDMFQQYISGQYCGGRSSSSGESHWVASSRKLNFLEGSEYVLIYEDHEGDSMLVGDVPWELFVNAVKRLRIMKGSEQVNLAPKNADPTKVQVAVG

SEQ ID NO: 11710 - protein, 503 aa, Physcomitrella patens
MKFSNEVVHKSMNITEDCSALTGALLKYSTDKSNMNFETLYRDAAVESPQHEVSNESGSTLKEHDYFGLSEVSSSNSSSGKQPEKCCREELNLNESATTLQLGPPAAVKPSGHADGADAHDEGAGPENPAKRPAHHMQQESLADGRKAAAEMGSFKIQRKNILEEFRAMKAQAHMTKSPKPVHTMQHNMHASFSGAQMAFGGAKNNGVKRVFSEAVGGNHIAASGVGVGVREGNDDVSRCEEMNGTEQLDLKVHLPKGMGMARMAPVSGGQNGSAWRNLSFDNMQGPLNPFFRKSLVSKMPVPDGGDSSANASNDCANRKGMVASPSVQPPPAQNQTVGWPPVKNFNKMNTPAPPASTPARACPSVQRKGASTSSSGNLVKIYMDGVPFGRKVDLKTNDSYDKLYSMLEDMFQQYISGQYCGGRSSSSGESHWVASSRKLNFLEGSEYVLIYEDHEGDSMLVGDVPWELFVNAVKRLRIMKGSEQVNLAPKNADPTKVQVAVG

SEQ ID NO: 11711 - protein, 499 aa, Sus scrofa
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPSCIPNGKENFSGSTSLWQNI

SEQ ID NO: 11712 - protein, 612 aa, uncultured bacterium
MLIADGAIGTMLALRGVPTPYELANLLYPDTVRALHREYYEAGARLIETNTYTANRVRLFNLPERGSEAPPTYSLLEQFGSPEELVRRINQEAVRLAREAVGADALVFGSVGPVGKPLEPIGETRLDEAEGAFREQMQALLEAGVDGLILETFIDPRELELAIRVARELAPDLPLIASKGFVEDGETLMEGLPERFAHTVSALGVDAVGANCVVGPQRMLDIVRMMATGTELPLSSMPTPGLPQLVRGQVVYDIHPDYFGRYAVRLVEAGAQIVGGCCGTTPDHIRAVAQAVSRTPVKRRAGGIRAVVRERKEEELPLAEPSRLSQILGKERVIAVELDLPRGLKVQKVIEGARLLKEHGVHVIDISDGARARLRMNVIAISHLVQREAGIEVMMHFACRDRNLLAIQADLLGAHALGIRNVLAITGDPAQIGDYPTATSVFDVDAIGLVRILRRFNEGRDLAGNTIGVRANFTIAVAYNPLAPDPETERDRLRKKIEEGAHLVYTQPIFEMRVVEETAELMNRLGVPWLVGVLPLRSARHAEFMHNEVPGVSIPEPILRRMAEAPEEDALAVGLEIARRFVAEAAPYAQGVYLMPPAGSAQIALQVIEAIR

SEQ ID NO: 11713 - protein, 145 aa, Medicago sativa
MGFTDKQEALVNSSWESFKQNPGNSVLFYTIILEKAPAAKGMFSFLDSAGVQDSPKLQSHAEKVFGMVRDSAAQLRATGGVVLGDATLGAIHIQKGVVDPHFAVVKEALLKTIKEVSGDKWSEELNTAWEVAYDALATAIKKAMV

SEQ ID NO: 11714 - protein, 73 aa, Medicago sativa
AKGMFSFLKDTTGVQDSPQLQAHAAKVFEMVRNSAVQLRSTGEVVLGDATLGAIHIQKGVVDPHFVVVKEALL

SEQ ID NO: 11715 - protein, 230 aa, Drosophila melanogaster
MNNYFGIGIDADLCLDFHNAREENPNQFNSRLRNKGYYVKMGLRKIVGRKAVKDLQKELRLEVDGKIVELPPVDGIIILNILSWGSGANPWGPDKDDQFSTPNHYDGMLEVVGVTGVVHLGQIQSGIRTAMRIAQGGHIKIHLNTDMPVQVDGEPWIQSPGDVVVLKSALKATMLKKNKLKMKRRNTEPTMMVAGSAAPPLSLALPPSVGEVGVAGEGAEGDGGTNNTDF

SEQ ID NO: 11716 - protein, 153 aa, Drosophila melanogaster
MFASVGADGSVRMFDLRHLEHSTIIYEDPAHTALLRLAWNKQDPNYLATVAMDSCEVIILDVRVPCTPVARLSNHRACVNGIAWAPHSSCHICTAGDDHQALIWDIQQMPRAIEDPILAYTAAEGEVNQIQWGATQPDWIAICYNKACEILRV

SEQ ID NO: 11717 - protein, 366 aa, Edwardsiella ictaluri
MKILYVITGLGLGGAEKQLSLLADNFTARGEQVSIVYLTGEVLVKPKNKNIKIYNLGIDKSFSSLIKGIWKLKSIISDVRPDVIHSHMYHANILARISCCLSLFSSRLVCSAHNKNEGGRVRMIIYRMTDFLCAKTTNVSQEALDEFITKKAFRKRKSSLVYNGIDLSIFKKKSTNIQNIKNKLGINFDEKVIFCAGRLTEAKDYPNLILAISKMHQKKCKIIIAGDGPMRSDIERLIDRCHLSHRILLIGIIDNISDYYNLSDLFVLPSRWEGFGLVVAEAMACECPVIATDAGGVAEVLSNADWLVPIADSSKLAEKIDEFFLLDSSEVKDIKAKNKDHCENQFSIGAIINNWYAIYNGIRSKL

SEQ ID NO: 11718 - protein, 549 aa, Arabidopsis thaliana
MAVDSPLQSRMVSATTSEKDVKALKFIEEMTRNPDSVQEKVLGEILTRNSNTEYLKRFDLDGVVDRKTFKSKVPVVTYEDLKPEIQRISNGDCSPILSSHPITEFLTSSGTSAGERKLMPTIEEDLDRRQLLYSLLMPVMNLYVPGLDKGKGLYFLFVKSESKTSGGLPARPVLTSYYKSDHFKRRPYDPYNVYTSPNEAILCSDSSQSMYAQMLCGLLMRHEVLRLGAVFASGLLRAISFLQNNWKELARDISTGTLSSRIFDPAIKNRMSKILTKPDQELAEFLVGVCSQENWEGIITKIWPNTKYLDVIVTGAMAQYIPTLEYYSGGLPMACTMYASSESYFGINLKPMCKPSEVSYTIMPNMAYFEFLPHNHDGDGAAEASLDETSLVELANVEVGKEYELVITTYAGLYRYRVGDILRVTGFHNSAPQFKFIRRKNVLLSVESDKTDEAELQKAVENASRLFAEQGTRGIEYTSYAETKTIPGHYVIYWELLGRDQSNALMSEEVMAKCCLEMEESLNSVYRQSRVADKSIGPLGDTCGTERYV

SEQ ID NO: 11719 - protein, 383 aa, Homo sapiens
NSWSPLGAAAAGPRAARPRRQATAAAAAMAEVHRRQHARVKGEAPAKSSTLRDEEELGMASAETLTVFLKLLAAGFYGVSSFLIVVVNKSVLTNYRFPSSLCVGLGQMVATVAVLWVGKALRVVKFPDLDRNVPRKTFPLPLLYFGNQITGLFSTKKLNLPMFTVLRRFSILFTMFAEGVLLKKTFSWGIKMTVFAMIIGAFVAASSDLAFDLEGYAFILINDVLTAANGAYVKQKLDSKELGKYGLLYYNALFMILPTLAIAYFTGDAQKAVEFEGWADTLFLLQFTLSCVMGFILMYATVLCTQYNSALTTTIVGCIKNILITYIGMVFGGDYIFTWTNFIGLNISIAGSLVYSYITFTEEQLSKQSEANNKLDIKGKGAV

SEQ ID NO: 11720 - protein, 666 aa, Homo sapiens
RGWRRAPLRRGVGSSPRARRLMRPLWLLLAVGVFDWAGASDGGGGEARAMDEEIVSEKQAEESHRQDSANLLIFILLLTLTILTIWLFKHRRARFLHETGLAMIYGLLVGLVLRYGIHVPSDVNNVTLSCEVQSSPTTLLVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 11721 - protein, 112 aa, Cucumis melo
MAEEEQGHHHHHLFHHHKEGEESSDVVDYKKEKKHHKHLEHLGELGAAAAGAYALHEKHEAKKDSEHSHEHKIKEEVGAAVVAGAAGFVLHEHHEKKEAKREEKEEHHHHLF

SEQ ID NO: 11722 - protein, 322 aa, Marah macrocarpus
MVVLSKPEIQQLSSSSSSGVPLIDLSAPDAKHLIVKACEELGFFKVINHGVPMEFISTLESESTKFFSLPLSEKQRAGPPSPFGYGNKQIGRNGDVGWVEYLLLQSNSHAFLSIFGQDPQKLRSALNDYIWAVRNMACEIVELMAEGLKIQQRNALSKLLMGEESDSVFRVNHYPPCPEELQALEGTNMIGFGEHTDPQIISVLRSNNTSGLQISLPDANWISVPPDQTSFFINVGDSLQVMTNGRFKSVKHRVLTNSLKSRISMIYFGGPPLSEKIAPLPSLMKGEESLYKEFTWFEYKRSAYNSRLADNRLVHFERIAAS

SEQ ID NO: 11723 - protein, 102 aa, Anabaena variabilis
MSIYVGNLSYEVTENDLKGVFAEYGTVKRVQVPQDRETGRPRGFAFVEMGTDAEEDAAIEGLDGAEWMGRDLKVNKAKPKEDRGSSGGGRGGYSGGGGGGRY

SEQ ID NO: 11724 - protein, 100 aa, Arabidopsis thaliana
QLPEKKRRLTTEQVHLLEKSFETENKLEPERKTQLAKKLGLQPRQVAVWFQNRRARWKTKQLERDYDLLKSTYDQLLSNYDSIVMDNDKLRSEVTSLTEK

SEQ ID NO: 11725 - protein, 797 aa, Arabidopsis thaliana
MPCTTYLPLLLLLFLLPPPSVQSKVIIKGNQTILSFKAIFRLGFFSTTNGSSNWYLGISYASMPTPTHVWVANRIRPVSDPDSSTLELTSTGYLIVSNLRDGVVWQTDNKQPGTDFRFSETGNLILINDDGSPVWQSFDNPTDTWLPGMNVTGLTAMTSWRSLFDPSPGFYSLRLSPSFNEFQLVYKGTTPYWSTGNWTGEAFVGVPEMTIPYIYRFHFVNPYTPTASFWYIVPPLDSVSEPRLTRFMVGANGQLKQYTWDPQTQSWNMFWLQPEDPCRVYNLCGQLGFCSSELLKPCACIRGFRPRNDAAWRSDDYSDGCRRENGDSGEKSDTFEAVGDLRYDGDVKMSRLQVSKSSCAKTCLGNSSCVGFYHKEKSNLCKILLESPNNLKNSKGNISKSIIILCSVVGSISVLGFTLLVPLILLKRSRKRKKTRKQDEDGFAVLNLKVFSFKELQSATNGFSDKVGHGGFGAVFKGTLPGSSTFVAVKRLERPGSGESEFRAEVCTIGNIQHVNLVRLRGFCSENLHRLLVYDYMPQGSLSSYLSRTSPKLLSWETRFRIALGTAKGIAYLHEGCRDCIIHCDIKPENILLDSDYNAKVSDFGLAKLLGRDFSRVLATMRGTWGYVAPEWISGLPITTKADVYSFGMTLLELIGGRRNVIVNSDTLGEKETEPEKWFFPPWAAREIIQGNVDSVVDSRLNGEYNTEEVTRMATVAIWCIQDNEEIRPAMGTVVKMLEGVVEVTVPPPPKLIQALVSGDSYRGVSGTSCSEGHGCSDLNTGLSSPGSRSSFGRPSP

SEQ ID NO: 11726 - protein, 530 aa, Mus musculus
MSGSNGPTDTHTYQSLAEDCPFGSVEQPKRSTGRLVMHSMAMFGREFCYAVEAAYVTPVLLSVGLPKSLYSMVWLLSPILGFLLQPVVGSASDHCRARWGRRRPYILTLAIMMLLGMALYLNGDAVVSALVANPRQKLIWAISITMVGVVLFDFSADFIDGPIKAYLFDVCSHQDKEKGLHYHALFTGFGGALGYILGAIDWVHLDLGRLLGTEFQVMFFFSALVLILCFITHLCSIPEAPLRDAATDPPSQQDPQGSSLSASGMHEYGSIEKVKNGGADTEQPVQEWKNKKPSGQSQRTMSMKSLLRALVNMPSHYRCLCVSHLIGWTAFLSNMLFFTDFMGQIVYHGDPYGAHNSTEFLIYERGVEVGCWGLCINSVFSSVYSYFQKAMVSYIGLKGLYFMGYLLFGLGTGFIGLFPNVYSTLVLCSMFGVMSSTLYTVPFNLIAEYHREEEKEKGQEAPGGPDNQGRGKGVDCAALTCMVQLAQILVGGGLGFLVNMAGSVVVVVITASAVSLIGCCFVALFVRYVD

SEQ ID NO: 11727 - protein, 709 aa, Mus musculus
MGMSKSRGCFGYPLSIFFIVVNEFCERFSYYGMRALLVLYFRNFLGWDDNLSTAIYHTFVALCYLTPILGALIADSWLGKFKTIVSLSIVYTIGQAVISVSSINDLTDHDHNGSPDSLPVHVALSMVGLALIALGTGGIKPCVSAFGGDQFEEGQEKQRNRFFSIFYLAINGGSLLSTIITPILRVQQCGIHSQQACYPLAFGVPAALMAVALIVFVLGSGMYKKFQPQGNIMGKVAKCIGFAIKNRFRHRSKAYPKREHWLDWAKEKYDERLISQIKMVTKVMFLFIPLPMFWGLFDQQGSRWTLQATTMNGKIGANEIQPDQMQTVNAILNVNNGPNVDAVVYRSIAKCGFNFTSLKKMTVGMFLASMAFVVAAIVQVEIDKTLPVFPGGNQVQIKVLNIGNNNMTVHFPGNSVTLAQMSQTDTFMTFDIDKLTSINISSSGSPGVTTVAHDFEQGHRHNLLVWEPSQYRVVKDGPNQKPEKGENGIRFVNTLNEMVTNKMSGKVYEKFTSHNASGYKFLPSGEKQYTINTTAVAPTCLTDFKSSNLDFGSAYTYVIRRASDGCLEVKEFEDIPPNTVNMALQIPQYFLLTCGEVVFSVTGLEFSYSQAPSNMKSVLQAGWLLTVAVGNIIVLIVAGAGHFPKQWAEYILFASLLLVVCVIFAIMARFYTYINPAEIEAQFDEDEKKKGIGKENPYSSLEPVSQTNM

SEQ ID NO: 11728 - protein, 518 aa, Mus musculus
MEPAVSLAVCALLFLLWVRVKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVSMGQVTALLNSIGWTLPVLPELDDLTVGGLIMGTGIESSSHKYGLFQHICTAYELILADGSFVRCTPSENSDLFYAVPWSCGTLGFLVAAEIRIIPAKKYVKLRFEPVRGLEAICEKFTRESQRLENHFVEGLLYSLDEAVAVIMTGVMTDDVESSKLNSIGSYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCMSQALHTFQNDIHVYPIWLCPFILPSQPGLVHPKGDEAELYVDIGAYGEPRVKHFEARSCMRQLEKFVRSVHGFQMLYADCYMNREEFWEMFDGSLYHKLRKQLGCQDAFPEVYDKICKAARH

SEQ ID NO: 11729 - protein, 520 aa, Trametes hirsuta
MSRFQSLLAFVVASLAAVAHAAIGPTADLTISNAEVSPDGFARQAVVVNNVTPGPLVAGNKGDRFQLNVIDNLTNHTMLKSTSIHWHGFFQKGTNWADGPAFVNQCPISSGHSFLYDFQVPDQAGTFWYHSHLSTQYCDGLRGPFVVYDPNDPHASLYDVDNDDTVITLADWYHTAAKLGPAFPLGADATLINGLGRSPSTTAADLAVINVTKGKRYRFRLVSLSCDPNHTFSIDGHDLTIIEVDSINSQPLVVDSIQIFAAQRYSFVLNADQDVGNYWIRANPNFGNVGFAGGINSAILRYDGADPVEPTTTQTTPTKPLNEVDLHPLATMAVPGSPVAGGVDTAINMAFNFNGTNFFINGASFVPPTVPVLLQIIRRAQNAQDLLPSGSVYSLPSNADIEISFPATAAPPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPIYDALDVNDQ

SEQ ID NO: 11730 - protein, 66 aa, Triticum aestivum subsp. spelta
DWCHEYRKLKAKVETIQKCQKHLMGEDLESLNLKELQQLEQQLESSLKHIRSRKNQLMPESISELQ

SEQ ID NO: 11731 - protein, 67 aa, Triticum aestivum subsp. sphaerococcum
GNWCHEYRKLKAKVETIQKCQKHLVGEDLESLNLKELQQLEQQLESSLKHIRSRKNQLMPESISELQ

SEQ ID NO: 11732 - protein, 305 aa, Chlamydophila pneumoniae AR39
MHMSLFLVFLTAFIWSSSFALSKLVMNASAPIFATGARMVIAGAILALAAWFRGGFVGISKKIFLYIVLLALTGFYLTNIFEFIGLQSLSSSKTCFIYGLSPLMSALFSYIQLKEKVTLKKVLGLSLGLVSYICYLTFGGGGDDSQPWTWQIGLPELLILGAASLASFGWTLLRQIEKQSTLSVTAINAYAMLIAGMLSIMHSAVVEPWRPLPVQDISQFLYATLALVVISNLICYNLYAKLLRKYSSTFLSFCNLVMPLYSGFYGWILLGEKGVSLGLVLAVAFMVAGCRLIYHEEFRQGYIVS

SEQ ID NO: 11733 - protein, 591 aa, Chlamydophila pneumoniae AR39
MTKLSSKARNPLVLFQVRKLFMNTQNSQATEVSSEEESQKKLEELVALAKEQGFITYEEINEILPMSFDTPEQIDQVLIFLTGMDIQVLNQIDVERQKEKKKEAKELEGLARRTEGTPDDPVRMYLKEMGTVPLLTREEEVEISKRIEKAQVQIERIILRFRYSAKEAISIAHYLISGKERFDKIISEKEVEDKTHFLKLLPKLITLLKEEDTYLENLLLSLKQPDLSKQEAAKLNDSLEKCRIRTQAYLRCFHCRHNVTEDFGEVVFKAYDSFLHLEQQINDLKVRAERNKFAAAKLAAAKRKLYKREVAAGRTLEEFKKDVRMLQRWMDKSQEAKKEMVESNLRLVISIAKKYTNRGLSFLDLIQEGNMGLMKAVEKFEYRRGYKFSTYATWWIRQAVTRAIADQARTIRIPVHMIETINKVLRGAKKLMMETGKEPTPEELAEELGLTPDRVREIYKIAQHPISLQAEVGEGSESSFGDFLEDTAVESPAEATGYSMLKDKMKEVLKTLTDRERFVLIHRFGLLDGKPKTLEEVGSAFNVTRERIRQIEAKALRKMRHPIRSKQLRAFLDLLEEEKTGTSKVKSLKSK

SEQ ID NO: 11734 - protein, 379 aa, Chlamydophila pneumoniae AR39
  unsure (1)..(379): unsure at all Xaa locations
MKHLAVLGSTGSIGRQTLEIVRRYPSEFKIISMASYGNNLRLFFQQLEEFAPLAAAVYNEEVYNEACQRFPHMQFFLGQEGLTQLCIMDTVTTVVAASSGIEALPAILESMKKGKALALANKEILVCAGELVSKTAKENGIKVLPIDSEHNALYQCLEGRTIEGIKKLILTASGGPLLNKSLEELSCVTKQDVLNHPIWNMGSKVTVDSSTLVNKGLEIIEAYWLFGLENXEILAVIHPQSLIHGMVEFLDGSVISIMNPPDMLFPIQYALTAPERFASPRDGMDFSKKQTLEFFPVDEERFPSIRLAQQVLEKQGSSGSFFNAANEVLVRRFLCEEISWCDILRKLTTLMECHKVYACHSLEDILEVDGEARALAQEI

SEQ ID NO: 11735 - protein, 413 aa, Cucumis sativus
GDDVEDVRREVQIMHHLTGHPHIVELKEVYEDRHYVNLIMELCAGGELFDRIIAKGHYSECTAASLCRQIVTVVHNCHSMGVMHRDLKPENFLFLSADENSPLKATDFGLSVFFKPGDVFKDLVGSAYYVAPEVLRRRYGPEAAVWSAGVILYILLSGVPPFWAENDQGIFDAVLRGHIDFSSDPWPSISSGAKDLIRKLLHSDPKERLSAIEALNHPWMKEDGEASDKPLDIAVLTRMKQFRAMNKLKKVALKVIAENLSEEEIVGLKEMFKSMDTDNSGTITFEELKAGLPKLGTKLSESEVRQLMEAADVDGNGSIDYIEFITAAMHMNRVEREDHLFKAFEYFDKDKSGYITMEELETALKKYNMGDETTIKEIIAEVDTDNDGRINYDEVVAMMRKGNQELTTTSRQK

SEQ ID NO: 11736 - protein, 371 aa, Ipomoea nil
MVSTITATVPSRVERLASSGIERIPKEYIRPEEERRSIGDIFEEEKIAGGPQVPTVDLKGINSEDLEVREKCREELRKAAVDWGVMHLVNHGISEELTGRVKAAGEGFFGQPIEEKEKYANDQAAGNVQGYGSKLANNASGQLEWEDYFFHCIFPEDKTDLSIWPKTPSDYIDATKEYAKQLRALATKVLAVLSLGLGLEEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNREKVRVSWAVFCEPPKDKILLQPLPETVSEAEPPRFPPRTFAQHIKHKLFRQSDQEAADTPKPDNDDHHQSN

SEQ ID NO: 11737 - protein, 371 aa, Ipomoea nil
MVSTITATVPSRVERLASSGIERIPKEYIRPEEERRSIGDIFEEEKIAGGPQVPTVDLKGINSEDLEVREKCREELRKAAVDWGVMHLVNHGISEELTGRVKAAGEGFFGQPIEEKEKYANDQAAGNVQGYGSKLANNASGQLEWEDYFFHCIFPEDKTDLSIWPKTPSDYIDATKEYAKQLRALATKVLAVLSLGLGLEEGRLEKEVGGMEELLLQMKINYYPKCPQPELALGVEAHTDVSALTFILHNMVAGLQLFYGGKWVTAKCVPNSIIMHVGDTVEILSNGKYKSILHRGVVNREKVRVSWAVFCEPPKDKILLQPLPETVSEAEPPRFPPRTFAQHIKHKLFRQSDQEAADTPKPDNDDHHQSN

SEQ ID NO: 11738 - protein, 262 aa, Fritillaria cirrhosa
MSSAESREENVYLAKLAEQAERYEEMVEFMEKVAKTVETEELTVEERNLLSVAYKNVIGARRASWRIMSSIEQKEESKGNDQNVKLIKGYRHKVEEELAKICNDILTVIDKHLIPSSGSGEATVFYYKMKGDYYRYLAEFKNEHERKEAADQSMKAYQAASNTANTDLPSTHPIRLGLALNFSVFYYEIMNSPERACHLAKQAFDEAIAELDTLSEESYKDSTLIMQLLRDNLTLWTSDLPEDGGDEGFKGEEAKAAGDDEH

SEQ ID NO: 11739 - protein, 476 aa, Homo sapiens [sequence omitted]

SEQ ID NO: 11740 - protein, 391 aa, Rattus norvegicus
MSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMSSAGMAGGSTPVSSANMMSGISSVPTPSPLGPLAGSPVIAAANSLGIPVPAAAGAQQ

SEQ ID NO: 11741 - protein, 1493 aa, Rattus norvegicus
MAAAAGDRASSSGFPGAAAASPEAGGGGGALQGSGAPAAGAGLLRETGSAGRERADWRRQQLRKVRSVELDQLPEQPLFLTASPPCPSTSPSPEPADAAAGASGFQPAAGPPPPGAASRCGSHSAELAAARDSGARSPAGAEPPSAAAPSGREMENKETLKGLHKMDDRPEERMIREKLKATCMPAWKHEWLERRNRRGPVVVKPIPIKGDGSEMSNLAAELQGEGQAGSAAPAPKGRRSPSPGSSPSGRSGKPESPGVRRKRVSPVPFQSGRITPPRRAPSPDGFSPYSPEETSRRVNKVMRARLYLLQQIGPNSFLIGGDSPDNKYRVFIGPQNCSCGRGTFCIHLLFVMLRVFQLEPSDPMLWRKTLKNFEVESLFQKYHSRRSSRIKAPSRNTIQKFVSRMSNCHTLSSSSTSTSSSENSIKDEEEQMCPICLLGMLDEESLTVCEDGCRNKLHHHCMSIWAEECRRNREPLICPLCRSKWRSHDFYSHELSSPVDSPTSLRGVQQPSSPQQPVAGSQRRNQESNFNLTHYGTQQIPPAYKDLAEPWIQAFGMELVGCLFSRNWNVREMALRRLSHDVSGALLLANGESTGTSGGGSGGSLSAGAASGSSQPSISGDVVEAFCSVLSIVCADPVYKVYVAALKTLRAMLVYTPCHSLAERIKLQRLLRPVVDTILVKCADANSRTSQLSISTLLELCKGQAGELAVGREILKAGSIGVGGVDYVLSCILGNQAESNNWQELLGRLCLIDRLLLEISAEFYPHIVSTDVSQAEPVEIRYKKLLSLLAFALQSIDNSHSMVGKLSRRIYLSSARMVTTVPPLFSKLVTMLSASGSSHFARMRRRLMAIADEVEIAEVIQLGSEDTLDGQQDSSQALAPPRYPESSSLEHTAHVEKTGKGLKATRLSASSEDISDRLAGVSVGLPSSATTEQPKPTVQTKGRPHSQCLNSSPLSPPQLMFPAISAPCSSAPSVPAGSVTDASKHRPRAFVPCKIPSASPQTQRKFSLQFQRTCSENRDSEKLSPVFTQSRPPPSSNIHRAKASRPVPGSTSKLGDASKNSMTLDLNSASQCDDSFGSGSNSGSAVIPSEETAFTPAEDKCRLDVNPELNSSIEDLLEASMPSSDTTVTFKSEVAVLSPEKAESDDTYKDDVNHNQKCKEKMEAEEEEALAIAMAMSASQDALPIVPQLQVENGEDIIIIQQDTPETLPGHTKANEPYREDTEWLKGQQIGLGAFSSCYQAQDVGTGTLMAVKQVTYVRNTSSEQEEVVEALREEIRMMSHLNHPNIIRMLGATCEKSNYNLFIEWMAGASVAHLLSKYGAFKESVVINYTEQLLRGLSYLHENQIIHRDVKGANLLIDSTGQRLRIADFGAAARLASKGTGAGEFQGQLLGTIAFMAPEVLRGQQYGRSCDVWSVGCAIIEMACAKPPWNAEKHSNHLALIFKIASATTAPSIPSHLSPGLRDVALRCLELQPQDRPPSRELLKHPVFRTTW

SEQ ID NO: 11742 - protein, 793 aa, Rattus norvegicus
MSARTPLPTVNERDTENHTSVDGYTETHIPPTKSSSRQNIPRCRNSITSATDEQPHIGNYRLQKTIGKGNFAKVKLARHVLTGREVAVKIIDKTQLNPTSLQKLFREVRIMKILNHPNIVKLFEVIETEKTLYLVMEYASGGEVFDYLVAHGRMKEKEARAKFRQIVSAVQYCHQKCIVHRDLKAENLLLDADMNIKIADFGFSNEFTVGNKLDTFCGSPPYAAPELFQGKKYDGPEVDVWSLGVILYTLVSGSLPFDGQNLKELRERVLRGKYRVPFYMSTDCENLLKKLLVLNPIKRGSLEQIMKDRWMNVGHEEEELKPYSEPELDLNDAKRIDIMVTMGFARDEINDALVSQKYDEVMATYILLGRKPPEFEGGESLSSGNLCQRSRPSSDLNNSTLQSPAHLKVQRSISANQKQRRFSDHAGPSIPPAVSYTKRPQANSVESEQKEEWDKDTARRLGSTTVGSKSEVTASPLVGPDRKKSSAGPSNNVYSGGSMTRRNTYVCERSTDRYAALQNGRDSSLTEMSASSMSSTGSTVASAGPSARPRHQKSMSTSGHPIKVTLPTIKDGSEAYRPGTAQRVPAASPSAHSISASTPDRTRFPRGSSSRSTFHGEQLRERRSAAYSGPPASPSHDTAALAHARRGTSTGIISKITSKFVRRDPSEGEASGRTDTARGSSGEPKDKEEGKEAKPRSLRFTWSMKTTSSMDPNDMVREIRKVLDANTCDYEQRERFLLFCVHGDARQDSLVQWEMEVCKLPRLSLNGVRFKRISGTSIAFKNIASKIANELKL

SEQ ID NO: 11743 - protein, 339 aa, Rattus norvegicus
MTDRSPFETDMLTLTRYVMEKGRQAKGTGELTQLLNSMLTAIKAISSAVRKAGLANLYGIAGSVNVTGDEVKKLDVLSNSLVINMLQSSYSTCVLVSEENKEAVITAKERRGKYVVCFDPLDGSSNIDCLASIGTIFAIYRKTTEDEPSEKDALQPGRNIVAAGYALYGSATLVALSTGQGVDLFMLDPALGEFVLVEKDIRIKKKGKIFSLNEGYAKYFDAATAEYVQKKKFPEDGSAPYGARYVGSMVADVHRTLVYGGIFMYPANQKSPNGKLRLLYECNPVAYIIEQAGGMATTGTQPVLDVKPESIHQRVPLILGSPEDVQEYLSCVQRNQAGR

SEQ ID NO: 11744 - protein, 479 aa, Rattus norvegicus
MSPEDPQETQPLLRSPGARAPGGRRVFLATFAAALGPLSFGFALGYSSPAIPSLRRTAPPALRLGDTAASWFGAVVTLGAAAQGAVLGGWLLDRAGRKLSLLLCTVPFVTGFAVITAARDVWMLLGGRLLTGLACGVASLVAPVYISEIAYPAVRGLLGSCVQLMVVTGILLAYVAGWVLEWRWLAVLGCVPPTLMLLLMCYMPETPRFLLTQHQYQEAMAALRFLWGSEEGWEEPPVGAEHQGFQLAMLRRPGVHKPLIIGICLMVFQQLSGVNAIMFYANTIFEEAKFKDSSLASVTVGIIQVLFTAVAALIMDRAGRKLLLALSGVIMVFSMSAFGTYFKLTQSGPSNSSHVGLLVPISAEPADVHLGLAWLAVGSMCLFIAGFAVGWGPIPWLLMSEIFPLHIKGVATGVCVLTNWFMAFLVTKEFNSIMEILRPYGAFWLTAAFCILSVLFTLTFVPETKGRTLEQITAHFEGR

SEQ ID NO: 11745 - protein, 505 aa, Salmonella enterica subsp. enterica serovar Typhi
MKNEKRKSGIEPKVFFPLLIIVGILCWLTVRDLDAANVVINAVFSYVTNVWGWAFEWYMVVMLFSWFWLVFGPYAKKRLGDEKPEFSTASWIFMMFASCTSAAVLFWGSIEIYYYISTPPFGLEPNSTGAKEIGLAYSLFHWGPLPWATYSFLSVAFAYFFFVRKMDVIRPSSTLVPLVGEKHAKGLFSTIVDNFYLVALIFAMGTSLGLATPLVTECMQWLFGIPHTLQLDAIIITCWIILNAICVACGLQKGVRIASDVRSYLSFLMLGWVFIVSGASFIMNYFTDSVGMLLMHLPRMLFYTDAIGKGGFPQGWTVFYWAWWVIYAIQMSIFLARISRGRTVRELCFGMVMGLTASTWILWTVLGSNTLLLMDKNILNIPQLIEQHGVARAIIETWAALPLSTATMWGFFILCFIATVTLINACSYTLAMSTCREVRDGEEPPLLVRIGWSVLVGIIGIVLLALGGLKPIQTAIIAGGCPLFFVNIMVTLSFIKDAKVHWKDK

SEQ ID NO: 11746 - protein, 347 aa, Salmonella enterica subsp. enterica serovar Typhi
MRIEEDLKLGFKDVLIRPKRSTLKSRSDVELERQFTFKHSGQTWSGVPIIAANMDTVGTFEMAQALAGFDILTAVHKHYSVEEWAAFINTASADVLKHVMVSTGTSDADFEKTVQILALNPALNFVCIDVANGYSEHFVQFVAKAREAWPSKTICAGNVVTGEMCEELILSGADIVKVGIGPGSVCTTRVKTGVGYPQLSAVIECADAAHGLGGMIVSDGGCTMPGDVAKAFGGGADFVMLGGMLAGHEESGGSVVEENGEKFMLFYGMSSESAMNRHVGGVAKYRAAEGKTVKLPLRGPVGNTARDILGGLRSACTYVGASRLKELTKRTTFIRVQEQENRIFNSL

SEQ ID NO: 11747 - protein, 398 aa, Salmonella enterica subsp. enterica serovar Typhi
MKQLTILGSTGSIGCSTLDVVHHNPDSFRVIALVAGKNVARMAEQCLEFSPRYAVMDDTSSAEQLKIMLQQHGSRTEVLSGQQAACEMAALDEVGHVMAAIVGAAGLLPTLAAIRAGKTILLANKESLVTCGRLFMDEVKRSNARLLPVDSEHNAIFQSLPQSIQHNLGYADLEQNGVTSILLTGSGGPFRETPMCDLAAMTPDQACRHPNWSMGRKISVDSATMMNKGLEYIEARWLFNASARQMEVLIHPQSVIHSMVRYQDGSVLAQLGEPDMRTPIAHTMAWPNRVTSGAQPLDFCKLSALTFSAPDYQRYPCLKLAMEAFEQGQAATTALNAANEITVAAFLAQQIRFTDIAGLNLAVLERMDLHEPASVDDVLQVDAIAREVARKQVIRLSR

SEQ ID NO: 11748 - protein, 267 aa, Salmonella enterica subsp. enterica serovar Typhi
MTIPAFGLGTFRLKDDVVIASVKTALELGYRAVDTAQIYDNEAAVGQAIAESGVPRNELYITTKIWIENLSKDKLIPSLKESLKKLRTDYVDLTLIHWPSPGDAVSVEEFMQALLEAKKQGLTREIGISNFTIPLMEKAIAAVGADHIATNQIELSPYLQNRKVVDWAKAHGIHITSYMTLAYGKALKDEVIARIAVKHNATPVQVILAWAMGEGYSVIPSSTRRENLASNLLAQDLHLDAEDKNAIAALDCNDRLVSPEGLAPAWD

SEQ ID NO: 11749 - protein, 620 aa, Salmonella enterica subsp. enterica serovar Typhi
MSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKDRRTVCVIGDGAITAGMAFEAMNHAGDIRPDMLVILNDNEMSISENVGALNNHLARLLSGKLYSSLREGGKKVFSGVPPIKELLKRTEEHIKGMVVPGTLFEELGFNYIGPVDGHDVMGLISTLKNMRDLKGPQFLHIMTKKGRGYEPAEKDPITFHAVPKFDPSSGCLPKSSGGLPGYSKIFGDWLCETAAKDSKLMAITPAMREGSGMVEFSRKFPDRYFDVAIAEQHAVTFAAGLAIGGYKPVVAIYSTFLQRAYDQVIHDVAIQKLPVMFAIDRAGIVGADGQTHQGAFDLSYLRCIPDMVIMTPSDENECRQMLFTGYHYNDGPTAVRYPRGNAQGVALTPLEKLPIGKGLVKRHGEKLAILNFGTLMPEAAKVAEALNATLVDMRFVKPLDDTLILEMAAQHDALVTLEENAIMGGAGSGVNEVLMAHRKPVPVLNIGLPDFFIPQGTQEEARAELGLDAAGIEAKIKAWLA

SEQ ID NO: 11750 - protein, 112 aa, Salmonella enterica subsp. enterica serovar Typhi
MKLVTVIIKPFKLEDVREALSSIGIQGLTVTEVKGFGRQKGHAELYRGAEYSVNFLPKVKIDVAIADDQLEEVIDIISKAAYTGKIGDGKIFVAELMRVIRIRTGEADEAAL

SEQ ID NO: 11751 - protein, 493 aa, Salmonella enterica subsp. enterica serovar Typhi
MNKQASQPRAIYYVVALQIWEYFSFYGMRALLILYLTNQLKYDDNHAYELFSAYCSLVYVTPILGGYLADKVLGNRMAVMLGAFLMAIGHLVLGASEIAPTFLYLSLAIIVCGYGLFKSNISCLLGELYQPEDPRRDGGFSLLYAAGNIGSIVAPIACGYVQEEYSWAMGFALAAIGMLAGLVIFLCGNRHFTHTTGVNKAVLCARNYLLPNWGWLLILLVAAPLLITVLFWKEWSVYALIVATAIGLVVLAKIYRQAQTAKQRKELGLIVTLTLFSMLFWAFAQQGGSSISLYIDRFVNRDILGYSVPTAMFQSVNAFAVMLCGVVLAWLVKESVSGNRTVRIWGKFALGLGLMSAGFCILTLSARWSAAYGHSSMPLMVLGLAVMGFAELFIDPVAMSQITRIDIPGVTGVLTGIYMLLSGAIANYLAGVIADQTSQSAFDASGAVNYAINAYVDVFEQITWGALACVGVVLLIWLYQSFKFKSRALAVES

SEQ ID NO: 11752 - protein, 208 aa, Salmonella enterica subsp. enterica serovar Typhi
MITLWGRNNSTNVKKVLWTLEELELPYDQILAGGKFGVNQDADYLAMNPNGLVPLLKDDETDLLLWESNAIVRYLAAQYGQNRLWVDNPARRAEGEKWMDWANQTLSPAHRVILMGLVRTPPEKRDQAAIEAGIEKCDSLFALLDDALAHQPWFSGDNFGTGDIAIAPFVYNLLNVGLKWTPRPNLQRWYQQLTERPAFRKVVMIPVT

SEQ ID NO: 11753 - protein, 286 aa, Salmonella enterica subsp. enterica serovar Typhi
MKQITGVYTAPRPHWVGDGFPVRSLFSYQSHAQQLNPFLLLDYAGPHTFTPGNEKRGVGEHPHRGFETVTIVYSGEVEHRDSTGRGGVIGPGDVQWMSAGAGILHEEFHSDAFTRRGGELEMMQLWVNLPMKDKMTTPGYQSITHDVIPTVTLPDDAGVVRVIAGRYEETKGPAHTFSPLNVWDMRLQRNRQLTLAQPEGWSAALVVLKGNITVNGTTPANEAQLVVLSQQGKTLHLEASSDASVLLLSGEPLNEPIVGYGPFVMNTKQEIAEAVRDFNSGRFGQI

SEQ ID NO: 11754 - protein, 244 aa, Salmonella enterica subsp. enterica serovar Typhi
MSFEGKIALVTGASRGIGRAIAETLVARGAKVIGTATSENGAKNISDYLGANGKGLMLNVTDPASIESVLENIRAEFGEVDILVNNAGITRDNLLMRMKDDEWNDIIETNLSSVFRLSKAVMRAMMKKRCGRIITIGSVVGTMGNAGQANYAAAKAGLIGFSKSLAREVASRGITVNVVAPGFIETDMTRALSDDQRAGILAQVPAGRLGGAQEIASAVAFLASDEASYITGETLHVNGGMYMV

SEQ ID NO: 11755 - protein, 289 aa, Salmonella enterica subsp. enterica serovar Typhi
MEYSILSNNLKMPMVGFGVFKVTDKEECQQSVLSAIRSGYRLIDTAAVYGNEDAVGDAVREAIATGLCTREELFITSKLWVQDMANYDLAKAGIEASLKKSGLDYFDLYLLHQAMGDYFSAWRALEDAYEAGKLKAIGVSNFYAHVLANFCETVRITPMVNQVELHPYFAQPAALETMKHYNVQPEAWAPLGGGRHKPYENVMLQRIADAHQKTIAQVVLRWNVQRGVTVIPKSTRQERIEENFAIWDFSLTDNEMAQINALDLGYVGEAVKHFNPEFVRGCLGVKIHD

SEQ ID NO: 11756 - protein, 481 aa, Salmonella enterica subsp. enterica serovar Typhi
MTIWENAMQYQLLINGVLVDGEGERQSVYNPATGEVILEIAEASPVQVDAAVLAADSAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAALAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDKSTELGPLSSLAHLKRVTAAVEEAKALSHIRVITGGSQTEGKGYYFAPTLLADAKQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 11757 - protein, 300 aa, Salmonella enterica subsp. enterica serovar Typhi
MMSRKDGFLALLVVVVWGLNFVVIKVGLHHMPPLLLAGLRFLLVAFPAIFFVARPKVPLTLLLGYGLTISFGQFAFLFCAIKFGMPAGLASLVLQAQAFFTMALGAFVFSERLQRKQLAGIALAIIGVLVLIEASLNGQHIAMSGFMLTLAAAFSWACGNIFNKKIMQHSPRPAVMSLVVWSALIPILPFLLSSLLLEGADHITQSLITIDMTTILSLLYLAFVATILGYGIWGTLLGRYETWRVAPLSLLVPVVGLASAAVLLGETLTGMQLAGAVLIMAGLYINVFGFRVRRTARVRG

SEQ ID NO: 11758 - protein, 457 aa, Salmonella enterica subsp. enterica serovar Typhi
MQKYTSEARQLLALAIPVILAQVAQTAMGFVDTVMAGGYSATDMAAVAIGTSIWLPAILFGHGLLLALTPVIAQLNGSGRRERIAHQVRQGFWLAGFVSVLVMIVLWNAGYIIRSMHNIDPALADKAVGYLRALLWGAPGYLFFQVARNQCEGLAKTKPGMVMGFLGLLVNIPVNYIFIYGHFGMPELGGIGCGVATAAVYWVMFIAMLSYIKHARSMRDIRNEKGFGKPDSVVMKRLIQLGLPIALALFFEVTLFAVVALLVSPLGIVDVAGHQIALNFSSLMFVLPMSLAAAVTIRVGYRLGQGSTLDAQTAARTGLGVGICMAVVTAIFTVTLRKHIALLYNDNPEVVALAAQLMLLAAVYQISDSIQVIGSGILRGYKDTRSIFFITFTAYWVLGLPSGYILALTDLVVDRMGPAGFWMGFIIGLTSAAVLMMLRMRYLQRQPSAIILQRAAR

SEQ ID NO: 11759 - protein, 920 aa, Salmonella enterica subsp. enterica serovar Typhi
MNLLNLKNTLQTSLVIRLTFLFLLTTIIIWLLSVITAAYISMVQKRQHIIEDLSALSEMNIVLSNQRFEEAERDAKNLMYQCSLATEIHHNDIFPEVSRHLSVGPSNCTPTLNGEKHRLFLQSSDIDEKSFRRDSFILNHKNEISLLSTDNPSDYSTLQLLTRKSFPLYPTHAGFYWSEPEYINGKGWHASVAVADQQGVFFGVMVKLPDLISKSHLPLDDSIRVWLDQNNHLLPFSYIPQKIRTQLENVTLHDGWQQIPGFLILRTTLHGPGWSLVTLYPYGNLHNRILKTILQQIPFTLTALVLMTSAFCWLLHRSLAKPLWRFVDIINKTATAPLSTRLPAQRLDELDSIAGAFNQLLDTLQVQYDNLENKVAERTQALNEAKKRAEQANKRKSIHLTVISHELRTPMNGVLGAIELLQTTPLNIEQQGLADTARNCTLSLLAIINNLLDFSRIESGHFTLHMEETALLPLLDQAMQTIQGPAQSKKLSLRTFVGQHVPLYFHTDSIRLRQILVNLLGNAVKFTETGGIRLTVKRHEEQLIFLVSDSGKGIEIQQQSQIFTAFYQADTNSQGTGIGLTIASSLAKMMGGNLTLKSVPGVGTCVSLVLPLQEYQPPQQIKGTLSAPFCLHRQLACWGIRGEPPHQQNALLNAEFLYFPGKLYDLAQQLILCTPNIPIINNLLPPWQLQILLVDDADINRDIIGKMLVSLGQHVTIAASSNEALTLSQQQRFDLVLIDIRMPEIDGIECVQLWHDEPNNLDPDCMFVALSASVATEDIHRCKKNGIHHYITKPVTLATLARYISIAAEYQLLRNIELQEQDPSRCSALLATDDMVINSKIFQSLDLLLADIENAVSAGKKIDQLIHTLKGCLGQIGQTELVCYVIDIENRVKMGKIIALEELTDLRQKIRMIFKNYTIT

SEQ ID NO: 11760 - protein, 306 aa, Salmonella enterica subsp. enterica serovar Typhi
MRFRQLLPLFGALFALYIIWGSTYFVIRIGVESWPPLMMAGVRFLSAGMLLMAFLLLRGEKLPPLRQTINAALIGLLLLAVGNGLVTVAEHQNVPSGIAAVVVATVPLFTLCFSYFFGIKTRKLEWVGIAIGLAGIILLNSGGNLSGNPWGAILILIGSMSWAFGSVYGSRIALPVGMMAGAIEMLAAGVVLLCAAFLSGEKLATLPGLSGFMAVGYLALFGSIIAINAYMYLIRNVSPALATSYAYVNPVVAVLLGTGLGGERLSPVEWAALGVIVFAVVLVTLGKYLFPARAVITPCKTEDSRQ

SEQ ID NO: 11761 - protein, 162 aa, Salmonella enterica subsp. enterica serovar Typhi
MLEDLRANSWSLRPCCMVLAYRIAHFCSVWRKKNVLNNLWAAPVLVLYRVITECLFGYEIQAAATIGRRFTIHHGYAVVINKHVVAGDDFTIRHGVTIGNRGADSLACPVIGHGVELGANVILLGDITIGNHVTIGAGSVVLDSIPDHALVVGEKARVKVST

SEQ ID NO: 11762 - protein, 369 aa, Salmonella enterica subsp. enterica serovar Typhi
MNEQSQAKSPDTLRAMVAGTLANFQHPTLKHNLTTLKALHHVAWMDDTLHVELVMPFVWNSAFEVLKEQCSADLLRITGAKAIDWKLSYNIATLKRVKNQPGINGVKNIIAVSSGKGGVGKSSTAVNLALALEAEGAKVGVLDADIYGPSIPTMLGAEDQRPTSPDGTHMAPIMSHGLATNSIGYLVTDDNAMVWRGPMASKALMQMLQETLWPDLDYLVLDMPPGTGDIQLTLAQNIPVTGAVVVTTPQDIALIDAKKGIVMFEKVEVPVLGIVENMSMHICSNCGHHEPIFGTGGAQKLAEKYHTQLLGQMPLHISLREDLDRGTPTVVSRPESEFTAIYRELADRVAAQLYWQGEVIPGEIAFRAV

SEQ ID NO: 11763 - protein, 948 aa, Salmonella enterica subsp. enterica serovar Typhi
MKYLASFRTTLKVSRYLFRALALLIWLLIAFVSVFYIVNALHQRESEIRQEFNLSSDQAQRFIQRTSDVMKELKYIAENRLTAENGVMSSRARDDKMVVPDFEPLFADSDCAAMGSAWRGSLESLAWFMRYWRDNFSAAYDLNRVFLIGSDNLCMANFGLREMPVERDDALKALHERIMKYRNAPQEESGNNLFWISQGARQGVGYFYALTPVYLANRLQALLGVEQSIRMENFFTPGSLPMGVTIIDENGHSLISLTGPDGIIKAEPRWMQERSWFGYTPGFRELVLKKSLPPSSLSIVYSVPVDLVLERIRILILNAILLNVLVGAGLFTLARMYERRIFIPAESDAQRLEEHEQFNRKIVASAPVGICILRTIDGVNILSNELAHTYLNMLTHEDRQRLTQIICGQQVNFVDVLTSNNTNLQISFVHSRYRNENVAICVLVDVSTRVKMEESLQEMAQAAEQASQSKSMFLATVSHELRTPLYGIIGNLDLLQTKELPKGVDRLVTAMNNSSSLLLKIISDILDFSKIESEQLKIEPREFSPREVMNHITANYLPLVVRKQLGLYCFIEPDVPVSLNGDPMRLQQVISNLLSNAIKFTDIGCIVLHVRCDGDYLSIRVRDTGVGIPAKEVVRLFDPFFQVGTGVQRNFQGTGLGLAICEKLISMMDGDISVDSEPGMGSQFTLRIPLYGAQYPVKKSVEGLAGTCCWLAVRNTSLCQFIETSLARSGVHTQRYEGQEPAADDILIVDDALEHTWQGRAAVVFCRRHIGIPLERAPGEWVHSVASVHELPALLARIYSIELDSEALSSALPTTDKTADSNDDMMILVVDDHPINRRLLADQLGSLGYQCKTANDGVDALNVLSKNAIDIVLSDVNMPNMDGYRLTQRIRQLGLTLPVVGVTANALAEEKQRCLESGMDSCLSKPVTLDALKQTLAVYAERVRKTRA

SEQ ID NO: 11764 - protein, 225 aa, Salmonella enterica subsp. enterica serovar Typhi
MPEEAHVQCKGFLFDLDGTLVDSLPAVERAWCSWADRFNLAHDEVLGFIHGKQAITSLRHFMAGKSEAEIAAEFTRLEQIEATETAGITALPGAVDLLNHLNKAGIPWAIVTSGSMPVARARHQVAGLPAPEVFVTAERVKRGKPEPDAYLLGAQLLGLAPQECVVVEDAPAGVLSGLAAGCHVIAVNAPADTPRLADVDFALDSLTQLSVAKQPNGDVVVLRKT

SEQ ID NO: 11765 - protein, 317 aa, Salmonella enterica subsp. enterica serovar Typhi
MIKLAPAGLKDDIEMRKVYAGFVAGQIEAGSPIIALEADLMSSMAMDSVARDYPQHVINCGIMEANVIGTAAGLALTGRKPFVHTFTAFASRRCFDQLFMALDYQRNNVKVIASDAGVTACHNGGTHMSFEDMGIVRGLAHSVVLEVTDAVMFANILRQLMDLDGFYWLRTIRKQATSIYAPGSTFTIGKGNVLREGDDITLIANGIMVAEALEAARQLEQEGVSAAVIDMFTLKPIDRMLVKNYAEKTRRIVTCENHSIHNGLGSAVAEVLVENCPVPMRRVGVKERYGQVGTQDFLQQEYGLTAAAIVEAAKSLL

SEQ ID NO: 11766 - protein, 465 aa, Salmonella enterica subsp. enterica serovar Typhi
MTDSIMQNYNQLREQVINGDRRFQHKDGHLCFEGVDLDALARQYPTPFYVFSEPEIIRNIHEIQQAFAAHKNTKTFFASKTCSVMGVLKAIRDAGICAEANSQYEVRKCLEIGFRGDQIVFNGVVKKPADLEYAIANDLYLINVDSLYELEHIDAISRKLKKVANVCVRVEPNVPSATHAELVTAFHAKSGLDLEQAEETCRRILAMPYVHLRGLHMHVGDQVPESEPFAKATKVLVDESRRLEEVLGIKFDLINVGGGIPVPYKYDDENGDPLKDNMYAGITAQDFADAVIREVHKWRTDVEICIEPGRKVTGSAAVLLTEVSCEKRKTNYDLNGNVECHVEWKFVDAGYSVLSDSQHFDWFFYVYNASRMTAAHDAWIKLAGPLCDGGDYFHMGVKGEEFLLPKETHVGDIVAFLDAGAYTIESQTVYNNRPRTGVVMIDKNGETRLIRREDSYEDMVKYDIY

SEQ ID NO: 11767 - protein, 263 aa, Salmonella enterica subsp. enterica serovar Typhi
MGKLTGKTALITGASQGIGEGIARVFARHGANLILLDISDEIEKLADELGGRGHRCTAVKADVRDFASVQAAVARAKETEGRIDILVNNAGVCRLGNFLDMSEEDRDFHIDINIKGVWNVTKAVLPEMIKRKDGRIVMMSSVTGDMVADPGETAYALSKAAIVGLTKSLAVEYAQSGIRVNAICPGYVRTPMAESIARQSNPDDPESVLTEMAKAIPLRRLADPLEVGELAAFLASDESSYLTGTQNVIDGGSTLPESVSVGV

SEQ ID NO: 11768 - protein, 490 aa, Salmonella enterica subsp. enterica serovar Typhi
MPMLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLHEVKALTERNGFAGYPVVTEDNELVGIITGRDVRFVTDLNQPVSVYMTPKERLVTVREGEAREVVLAKMHEKRVEKALVVDDNFHLLGMITVKDFQKAERKPNSCKDEQGRLRVGAAVGAGAGNEERVDALVAAGVDVLLIDSSHGHSEGVLQRIRETRAKYPDLQIIGGNVATGAGARALAEAGCSAVKVGIGPGSICTTRIVTGVGVPQITAVSDAVEALEGTGIPVIADGGIRFSGDIAKAIAAGASAVMVGSMLAGTEESPGEIELYQGRSYKSYRGMGSLGAMSKGSSDRYFQSDNAADKLVPEGIEGRVAYKGRLKEIIHQQMGGLRSCMGLTGCATIDELRTKAEFVRISGAGIQESHVHDVTITKESPNYRLGS

SEQ ID NO: 11769 - protein, 396 aa, Salmonella enterica subsp. enterica serovar Typhi
MLDAQTIATVKATIPLLVETGPKLTAHFYDRMFTHNPELKEIFNMSNQRNGDQREALFNAIAAYASNIENLPALLPAVEKIAQKHTSFQIKPEQYNIVGTHLLATLDEMFNPGQEVLDAWGKAYGVLANVFIHREAEIYHENASKDGGWEGTRPFRIVAKTPRSALITSFEFEPVDGGTVAEYRPGQYLGVWLKPEGFAHQEIRQYSLTRKPDGKGYRIAVKREDGGQVSNWLHHHANVGDVVHLAAPAGDFFMNVAADTPVSLISAGVGQTPMLAMLDTLAKEQHTAQVNWFHAAENGDVHAFADEVSELGRTLPRFTAHTWYREPTEADRAQRVFDSEGLMDLSKLEAAISDPAMQFYLCGPVGFMQFAAKQLVSLGVNNENIHYECFGPHKVL

SEQ ID NO: 11770 - protein, 183 aa, Salmonella enterica subsp. enterica serovar Typhi
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 11771 - protein, 482 aa, Salmonella enterica subsp. enterica serovar Typhi
MQLNDSTLFRQQAFIDGDWRDARGGDVIPVSNPANGKPLGNVPKMGAEETRDAINAANRALPAWRALTAKERANILRRWFNLMMEHQDDLARLMTLEQGKPLAEAKGEISYAASFIEWFAEEGKRIYGDTIPGHQTDKRLLVIKQPIGVTAAITPWNFPSAMITRKAGPALAAGCTMVLKPASQTPFSALALAELAQRAGILAGVFNVVTGSAGDIGGELTSNPLVRKLSFTGSTEIGRQLMEQCAKDIKKVSLELGGNAPFIVFDDADLDKAVEGALASKFRNAGQTCVCANRLYVQDGVYDRFAEKLNQAVNKLAVGDGLQADVAIGPLIDEKAVAKVQEHIADALEKGARVITGGEAHKLGGNFFQPTILADVPDNAKVAKEETFGPLAPLFRFSDEADVIRQANDTEFGLAAYFYARDLSRVFRVGEALEYGIVGINTGIISNEVAPFGGIKASGLGREGSKYGIEDYLEIKYMCIGL

SEQ ID NO: 11772 - protein, 188 aa, Salmonella enterica subsp. enterica serovar Typhi
MYARYAGLIFDMDGTLLDTEPTHRKAWREVLGRYGLRFDEQAMVALNGSPTWLIAQSIIELNHADLDPLSLAREKTDAVKSILLDCVEPLPLVEVVKAWHGRRPMSVGTGSESAIAEALLAHLGLRRYFDAVVAADHVQHHKPAPDTFLLCAQRMGVMPTQCVVFEDADFGLQAARAAGMDAVDVRLL

SEQ ID NO: 11773 - protein, 330 aa, Salmonella enterica subsp. enterica serovar Typhi
MSQNTLKVHDLNEDAEFDENGVEAFDEKALSEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 11774 - protein, 432 aa, Salmonella enterica subsp. enterica serovar Typhi
MSKIVKVIGREIIDSRGNPTVEAEVHLEGGFVGMAAAPSGASTGSREALELRDGDKSRFLGKGVTKAVGAVNGPIAQAILGKDAKDQAGIDKIMIDLDGTENKSNFGANAILAVSLANAKAAAAAKGMPLYEHIAELNGTPGKYSMPVPMMNIINGGEHADNNVDIQEFMIQPVGAKTVKEAIRMGSEVFHHLAKVLKGKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 11775 - protein, 918 aa, Salmonella enterica subsp. enterica serovar Typhi
MTNYSLRARMMILILAPTVLIGLLLSIFFVVHRYNDLQRQLEDAGASIIEPLAVSSEYGMNLQNRESIGQLISVLHRRHSDIVRAISVYDDHNRLFVTSNFHLDPSQMQLPAGAPFPRRLSVDRHGDIMILRTPIISESYSPDESAIADAKNTKNMLGYVALELDLKSVRLQQYKEIFISSVMMLFCIGIALIFGWRLMRDVTGPIRNMVNTVDRIRRGQLDSRVEGFMLGELDMLKNGINSMAMSLAAYHEEMQHNIDQATSDLRETLEQMEIQNVELDLAKKRAQEAARIKSEFLANMSHELRTPLNGVIGFTRLTLKTELNPTQRDHLNTIERSANNLLAIINDVLDFSKLEAGKLILESIPFPLRNTLDEVVTLLAHSSHDKGLELTLNIKNDVPENVIGDPLRLQQVITNLVGNAIKFTESGNIDILVEKRALSNTKVQIEVQIRDTGIGIPERDQSRLFQAFRQADASISRRHGGTGLGLVITQKLVNEMGGDISFHSQPNRGSTFWFHINLDLNPNVIIDGPSTACLAGKRLAYIEPNATAAQCTLDLLSDTPVEVIYSPTFSALPLAHYDIMILSVPVTFREPLTMQHERLAKAASMTDFLLLALPCHAQINAEKLKQGGAAACLLKPLTSTRLLPALTEYCQLNHHPEPLLMDTSKITMTVMAVDDNPANLKLIGALLEDKVQHVELCDSGHQAVDRAKQMQFDLILMDIQMPDMDGIRACELIHQLPHQQQTPVIAVTAHAMAGQKEKLLSAGMNDYLAKPIEEEKLHNLLLRYKPGANVAARLMAPEPAEFIFNPNATLDWQLALRQAAGKPDLARDMLQMLIDFLPEVRNKIEEQLVGENPNGLVDLVHKLHGSCGYSGVPRMKNLCQLIEQQLRSGVHEEELEPEFLELLDEMDNVAREAKKILG

SEQ ID NO: 11776 - protein, 748 aa, Salmonella enterica subsp. enterica serovar Typhi
MLTRLREIVEKVASAPRLNEALNILVTDICLAMDTEVCSVYLADHDRRCYYLMATRGLKKPRGRTVALAFDEGIVGLVGRLAEPINLADAQKHPSFKYIPSVKEERFRAFLGVPIIQRRQLLGVLVVQQRELRQYDESEESFLVTLATQMAAILSQSQVTALFGQYRQTRIRALPAAPGVAIATGWQDATMPLMEQVYEASTLDTSLERERLTGALEEAANEFRRYSKRFAAGAQKETAAIFDLYSHLLSDARLRRELFAEVDKGAVAEWAVKKIIEKFAEQFAALTDNYLKERAGDLRTLGQRLLFHLDDSVQGPNAWPERFILVADELSATTLAELPQDRLAGVVVRDGAANSHAAIMVRALGIPTVMGADIQPSVLHRRTLVVDGYRGELLVDPEPVLIQEYQRLISEEIELSRLAEDDVNLPAQLKSGERIKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLSILLPMVTSIDEVDEARRLIERAGREVEEMIGYAIPKPRIGIMLEVPSMVFMLPHLANRIDFISVGTNDLTQYILAVDRNNTRVASIYDSLHPAMLRALSMIAQEAEKHGLDLRLCGEMAGDPMCVAILIGLGYRHLSMNGRSVARVKYLLRHIDFEDAQTLARRSLEAQMATEVRHQVAAFMERRGMGGLIRGGL

SEQ ID NO: 11777 - protein, 420 aa, Salmonella enterica subsp. enterica serovar Typhi
MSLPHYHAETDLNAENLLRLPAEFGCPVWVYDAHIIRRQIAALQQFDVVRFAQKACSNIHILRLMRAQGVKVDSVSLGEIERALAAGYDPQTCPDDIVFTADVIDAATLARVSELHIPVNAGSVDMLTQLGQVSPGHRVWLRVNPGFGHGHSQKTNTGGENSKHGIWHSDLPAALAVMQKYRLKLVGIHMHIGSGVDYGHLEQVCGAMVRQVLECGQDVEAISAGGGLSIPYHEGEEPVDTRHYYGLWNAAREQIARHLGHAVKLEIEPGRYLVAQSGVLVTQVRSVKQMGSRHFVLVDAGFNDLMRPAMYGSYHRISALAADGRALENGPWVETVVAGPLCESGDVFTQQEGGMVETRALPAVIPGDYLVLHDTGAYGASMSSNYNSRPLLPEVLFDNGQARLIRRRQTIEELLALEML

SEQ ID NO: 11778 - protein, 471 aa, Salmonella enterica subsp. enterica serovar Typhi
MVSINDSALTPRSLRDTRRMNMFVSVSAAVAGLLFGLDIGVIAGALPFITDHFVLTSRLQEWVVSSMMLGAAIGALFNGWLSFRLGRKYSLMAGAILFVLGSLGSAFASSVEVLIGARVILGVAVGIASYTAPLYLSEMASENVRGKMISMYQLMVTLGIVLAFLSDTAFSYSGNWRAMLGVLALPAVLLIILVVFLPNSPRWLAQKGRHIEAEEVLRMLRDTSEKARDELNEIRESLKLKQGGWALFKANRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFIGITFWLIPETKNVTLEHIERKLMAGEKLRNIGV

SEQ ID NO: 11779 - protein, 253 aa, Salmonella enterica subsp. enterica serovar Typhi
MILNAFSLEGKVAVVTGCDTGLGQGMALGLAEAGCDIVGINIVEPTETIARVTALGRRFLSLTADLRQIDGIPALLERAVAEYGHIDILVNNAGLIRREDAIDFTEKDWDDVMNLNIKSVFFMSQAAAKYFIAQGNGGKIINIASMLSFQGGIRVPSYTASKSGVMGITRLMANEWAKHNINVNAIAPGYMSTNNTQQLRADAQRSAEILDRIPAGRWGLPGDLMGPVVFLASSAADYINGYTIAVDGGWLAR

SEQ ID NO: 11780 - protein, 464 aa, Salmonella enterica subsp. enterica serovar Typhi
MPDNKKQGRSNKAMTFFVCFLAALAGLLFGLDIGVIAGALPFITDEFQITAHTQEWVVSSMMFGAAVGAVGSGWLSFKLGRKKSLMIGAILFVAGSLFSAAAPNVEVLIISRVLLGLAVGVASYTAPLYLSEIAPEKIRGSMISMYQLMITIGILGAYLSDTAFSYSGAWRWMLGVIIIPAILLLIGVFFLPDSPRWFAAKRRFHDAERVLLRLRDTSAEAKRELDEIRESLQVKQSGWALFKENSNFRRAVFLGILLQVMQQFTGMNVIMYYAPKIFELAGYTNTTEQMWGTVIVGLTNVLATFIAIGLVDRWGRKPTLTLGFLVMAIGMGILGTMMHIGIHSPSAQYFAIAMLLMFIIGFAMSAGPLIWVLCSEIQPLKGRDFGITCSTATNWIANMIVGATFLTMLNNLGNANTFWVYAGLNVLFILLTLWLVPETKHVSLEHIERNLMKGRKLREIGAHD

SEQ ID NO: 11781 - protein, 494 aa, Salmonella enterica subsp. enterica serovar Typhi
MSDVTLLAEVTTFLRQRHGQFIAGERQAGNGTNFSVTNPATGKIIADVVSTTPAQAKEAMQSARRAFDVWRKMPTLQRGALLLKLADTLAAHREELAQLESVCSGKTIMLSRGLELDQSVAFLRYFAGWAGKITGETLNVSLPSMGEERYTAFTQRQPIGVVVGIVPWNFSIMIAIWKLAAALVCGCTIVIKPSEYTPLTLLRVAELAKEAGFPDGVINVVNGAGGEIAQQLIAHPDCAKVSFTGSVATGEKVRRSATSSGKRVTLELGGKNAALFLNDLTAQAMVNGILEAGYLNQGQICAAAERFYLPQEKLDTVMTLLRQRLSEIVPGSPLDEKTVMGPLANQVQLEKVLRLIQRAREEGDTIVYGGETLPGEGYFLQPTAVKVRSKNSTLMHEETFGPVCSFIGYQNEKEALSHINDSPFGLAASVWSENISKALRYAEDIDAGMVWVNMHTFLDPAVPFGGMKGSGIGREFGSAFIDDYTELKSVMVRY

SEQ ID NO: 11782 - protein, 660 aa, Salmonella enterica subsp. enterica serovar Typhi
MPHIVREAPDSRSERQRPKYKYALALNVDSYTVDTNQTNKCGYRLMEQNPQSQLKLLVTRGKEQGYLTYAEVNDHLPEDIVDSDQIEDIIQMINDMGIQVMEEAPDADDLLLAENTTSTDEDAEEAAAQVLSSVESEIGRTTDPVRMYMREMGTVELLTREGEIDIAKRIEDGINQVQCSVAEYPEAITYLLEQYDRVEAEEARLSDLITGFVDPNAEEEMAPTATHVGSELSQEDLDDDEDEDEEDGDDDAADDDNSIDPELAREKFAELRAQYVVTRDTIKAKGRSHAAAQEEILKLSEVFKQFRLVPKQFDYLVNSMRVMMDRVRTQERLIMKLCVEQCKMPKKNFITLFTGNETSETWFNAAIAMNKPWSEKLHDVAEEVQRCLQKLRQIEEETGLTIEQVKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELAERMLMPEDKIRKVLKIAKEPISMETPIGDDEDSHLGDFIEDTTLELPLDSATTESLRAATHDVLAGLTAREAKVLRMRFGIDMNTDHTLEEVGKQFDVTRERIRQIEAKALRKLRHPSRSEVLRSFLDD

SEQ ID NO: 11783 - protein, 778 aa, Salmonella enterica subsp. enterica serovar Typhi
MKQIRMLAQYYVDLMMKLGLVRFSMLLALALVVLAIVVQMAVTMVLHGQVESIDVIRSIFFGLLITPWAVYFLSVVVEQLEESRQRLSRLVQKLEEMRERDLKLNVQLKDNIAQLNQEIADREKAEAELQETFEQLKVEIKEREEAQIQLEQQSSFLRSFLDASPDLVFYRNEDKEFSGCNRAMELLTGKSEKQLVHLKPEDVYSPEAAEKVIETDEKVFRHNVSLTYEQWLDYPDGRKACFEIRKVPYYDRVGKRHGLMGFGRDITERKRYQDALERASRDKTTFISTISHELRTPLNGIVGLSRILLDTDLTAEQEKYLKTIHVSAVTLGNIFNDIIDMDKMERRKVQLDNQPVDFTSFMADLENLSGLQAQQKGLRFVLEPTLPLPHKVITDGTRLRQILWNLISNAVKFTQQGQVTVRARYDEGDMLHFEVEDSGIGIPQDEQDKIFAMYYQVKDSHGGKPATGTGIGLAVSRRLAKNMGGDITVSSLPGKGSTFTLTVHAPAVAEEVEDAFDEDDMPLPALHVLLVEDIELNVIVARSVLEKLGNSVDVAMTGKAALEMFAPGEYDLVLLDIQLPDMTGLDIARELTRRHTREDLPPLVALTANVLKDKKEYLDAGMDDVLSKPLSVPALTAMIKKFWDATDKEESTVTPEESDKAQALLDIPMLEQYIELVGPKLITDGLAVFEKMMLGYLSVLESNLTARDKKGVVEEGHKIKGAAGSVGLRHLQQLGQQIQSPDLPAWEDNVVEWIEEMKQEWQHDVAVLKAWVANAEKK

SEQ ID NO: 11784 - protein, 366 aa, Salmonella enterica subsp. enterica serovar Typhi
MCGGNSAHTSIIPSLPCATLRATPFCYEFVMRRELAIEFSRVTEAAALAGYKWLGRGDKNTADGAAVNAMRIMLNQVNIDGTIVIGEGEIDEAPMLYIGEKVGTGHGDAVDIAVDPIEGTRMTAMGQANALAVLAVGDKGCFLNAPDMYMEKLIVGPGAKGAIDLNLPLADNLRNIADALGKPLGDLTVTILAKPRHDEVIAEMAKLGVRVFAIPDGDVAASILTCMPDSEVDVLYGIGGAPEGVVSAAVIRALDGDMQGRLLARHDVKGDSEENRRIGEQELARCKAMGIEAGKALCLGDMARSDNVIFSATGITKGDLLEGISRKGHIATTETLLIRGKSRTIRRIQSIHYLDRKDPDVQAHIL

SEQ ID NO: 11785 - protein, 911 aa, Salmonella enterica subsp. enterica serovar Typhi
MSTPSLTHRLWLAFALMAALTLLSTVIGWISLRVISQVEQTNTQALLPTMNMARQLSEASAYELFSAQNLTNADSEGVWLAQGKMLKAQSLKINHLLQALSEQGFNTSAIARQEKEIAQTLGQQGTLVGEILTLRAQQQQLSRQIAEAAESIAAQAHGQANNAATSAGATQAGIYDLIESGKGDQAERALDRLIDIDLEYVNQMNELRVNALRFKQLIVTLKDAQGLSDAEETDEKLNQLVKILSRRQQRIEDPTVRAQIADALGKINQYTTLVTLFRKENAIRDQLQTLMANNLFQFTRFSTEVSQLVNAIEKRNEAGLARLTHASQRGQIGLVILGILALCSLSFILWRVVYRSVSRPLAQQTQALQRLLEGDIDSPFPEAAGVSELDTISRLMEAFRANVRKLNRHREDLAEQVRSQTAELHALVLEHRQARAEAEKANEAKSTFLAAMSHEIRTPLYGILGTVQLLADKPLMANYRDDLQAINDSGESLLAILNDILDYSAIEVGGTNVSISEEPFEPRQLLNSALHLMHSRVQVALITDFSEQLPSTLQGDPRRIRQIVINLLSNAAKFTDRGSIVLRTFCDDQSWFIEVEDTGCGIPEAKLTAIFKPFVQATGCRGGTGLGLAISASLAEAMGGTLTVTSTLHVGSCFRLQLPVRHPKPASKSAFREPVNLNGLRLLLIEDNMLTQRITAEMLTGKGVKVSVAESANDALRCLAEGEPFDVALVDFDLPDYDGLTLAQQLMSLYPAMKRIGFSAHVIDDNLRQRTAGLFCGIIQKPVPREELYRMIAHYLQGKSHNARVMLNEHQLAGDMASVGPEKLRQWVALFKDSALPLVEEIEAARAMNDDVNIKRLAHKLKSGCASLGMTQATEACRELELQPLSDIDIKTIVTQGVTALDAWIAGHPSP

SEQ ID NO: 11786 - protein, 407 aa, Salmonella enterica subsp. enterica serovar Typhi
MMSLAGKKIVLGVSGGIAAYKTPELVRRLRERGADVRVAMTEAAKAFITPLSLQAVSGYPVSDSLLDPAAEAAMGHIELGKWADLVILAPATADLIARVASGMANDLVSTICLATPAPVAVLPAMNQQMYRAAATQHNLEVLASRGLFIWGPDSGSQACGDVGPGRMLDPLAIVDKAAAHFAAVNDLRHLNIMITAGPTREPLDPVRYISNYSSGKMGFAIAAAAARRGANVTLVSGPVSLPMPPFVKRVDVITALDMEAAVQAAVQQQHIFISCAAVADYRAETIASEKIKKQAAQSDELIIKMVKNPDIVAGVAALSDNRPYVVGFAAETNNVEEYARQKRTRKNLDLICANDVSLSNQGFNSDKNALHLFWQDGDKVLPLERKELLGQLLLDEIVTRYDEKNRR

SEQ ID NO: 11787 - protein, 381 aa, Salmonella enterica subsp. enterica serovar Typhi
MIKKIIFTVTPIFSIPPRGAAAVETWIYQVAKRLSIPNAIACIKNAGYPEYNKINDNCDIHYIGFSKVYKRLFQKWARLDPLPYSQRILNIRDKVTTQEDSVIVIHNSMKLYRQIRERNPNAKLVMHMHNAFEPELPDTDAKIIVPSQFLKAFYEERLPAAAVSIVPNGFCAETYKRNPQDNLRQQLNIAEDATVLLYAGRISPDKGILLLLQAFKQLRTLRSNIKLVVVGDPYASRKGEKAEYQKKVLDAAKEIGTDCIMAGGQSPDQMHNFYHIADLVIVPSQVEEAFCMVAVEAMAAGKAVLASKKGGISEFVLDGITGYHLAEPMSSDSIINDINRALADKERHQIAEKAKSLVFSKYSWENVAQRFEEQMKSWFDK

SEQ ID NO: 11788 - protein, 273 aa, Salmonella enterica subsp. enterica serovar Typhi
MPCEELEIVWKNIKAEARALADCEPMLASFYHATLLKHENLGSALSYMLANKLASPIMPAIAIREVVEEAYAADPEMIASAACDIQAVRTRDPAVDKYSTPLLYLKGFHALQAYRIGHWLWNKGRRALAIFLQNQVSVSFQVDIHPAAKIGRGIMLDHATGIVVGETAVIEDDVSILQSVTLGGTGKTSGDRHPKIREGVMIGAGAKILGNIEVGRGAKIGAGSVVLQPVPPHTTAAGVPARIVGKPGSDKPSMDMDQHFNGLHHTFEYGDGI

SEQ ID NO: 11789 - protein, 512 aa, Salmonella enterica subsp. enterica serovar Typhi
MTNNPPSTRIQPSEYGYPLKLKARYDNFIGGDWVAPADGEYYQNLTPVTGQPLCEVASSGKKDIDLALDAAHKAKDKWAHTSVQDRAAILFKIADRMEQNLELLATAETWDNGKPIRETSAADIPLAIDHFRYFASCIRAQEGGISEVDSETVAYHFHEPLGVVGQIIPWNFPLLMASWKMAPALAAGNCVVLKPARLTPLSVLLLMEVIGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSGTQMGAQVSHGQLETILNYIDIGKKEGADILTGGRRKELDGELKEGYYLEPTILFGKNNMRVFQEEIFGPVLAVTTFKTMEKALEIANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 11790 - protein, 309 aa, Salmonella enterica subsp. enterica serovar Typhi
MSKKIAVIGECMIELSQKGADVQRGFGGDTLNTSVYIARQVDSAALAVHYVTALGTDSFSQQMLEAWQHENVDTSLTQRMENRLPGLYYIETDDTGERTFYYWRNEAAAKFWLESEQSAAICETLATFDYLYLSGISLAILSPTSRDKLLSLLRECRANGGKVIFDNNYRPRLWTSREETQQVYQKMLECTDIAFLTLDDEDALWGKQPVEEVIARTHAAGVQEVVVKRGADSCLVSIQGEALIDVPAVKLPKEKVIDTTAAGDSFSAGYLAVRLTGGSATDAAKRGHLTASTVIQYRGAIIPHDAMPQ

SEQ ID NO: 11791 - protein, 284 aa, Salmonella enterica subsp. enterica serovar Typhi
MTKEMQNLALAPVGNLESYIRAANAWPMLSADEERALAERLHYQGDLEAAKTLILSHLRFVVHIARNYAGYGLPQADLIQEGNIGLMKAVRRFNPEVGVRLVSFAVHWIKAEIHEYVLRNWRIVKVATTKAQRKLFFNLRKTKQRLGWFNQDEVEMVARELGVSSKDVREMESRMAAQDMTFDMSSDDESDSQPMAPVLYLQDKSSNFADGIEDDNWEEQAANRLTDAMQGLDERSQDIIRARWLDEDNKSTLQELADRYGVSAERVRQLEKNAMKKLRAAIEA

SEQ ID NO: 11792 - protein, 1227 aa, Salmonella enterica subsp. enterica serovar Typhi
MSSKVEQLRAQLNERILVLDGGMGTMIQSYRLHEEDFRGERFADWPCDLKGNNDLLVLSKPEVIAAIHNAYFEAGADIIETNTFNSTTIAMADYRMESLSAEINYAAAKLARACADEWTARTPEKPRFVAGVLGPTNRTASISPDVNDPAFRNITFDQLVAAYRESTKALVEGGADLILIETVFDTLNAKAAVFAVKEEFEALGVDLPIMISGTITDASGRTLSGQTTEAFYNSLRHAEALTFGLNCALGPDELRQYVQELSRIAECYVTAHPNAGLPNAFGEYDLDADTMAKQIREWAEAGFLNIVGGCCGTTPEHIAAMSRAVAGLSPRQLPDIPVACRLSGLEPLNIGDDSLFVNVGERTNVTGSAKFKRLIKEEKYSEALDVARQQVESGAQIIDINMDEGMLDAEAAMVRFLSLIAGEPDIARVPIMIDSSKWEVIEKGLKCIQGKGIVNSISMKEGVEAFIHHAKLLRRYGAAVVVMAFDEQGQADTRERKIEICRRAYKILLEEVGFPPEDIIFDPNIFAVATGIEEHNNYAQDFIGACEDIKRELPHALISGGVSNVSFSFRGNDPVREAIHAVFLYYAIRNGMDMGIVNAGQLAIYDNLPAELRDAVEDVILNRRDDGTERLLDLAEKYRGSKTDEAASAQQAEWRSWDVKKRLEYSLVKGITEFIEQDTEEARQQAARPIEVIEGPLMDGMNVVGDLFGEGKMFLPQVVKSARVMKQAVAYLEPFIEASKEKGSSNGKMVIATVKGDVHDIGKNIVGVVLQCNNYEIVDLGVMVPAEKILRTAREVNADLIGLSGLITPSLDEMVNVAKEMERQGFTIPLLIGGATTSKAHTAVKIEQNYSGPTVYVQNASRTVGVVAALLSDTQRDDFVARTRKEYETVRIQHARKKPRTPPVTLEAARDNDLAFDWERYTPPVAHRLGVQEVEASIETLRNYIDWTPFFMTWSLAGKYPRILEDEVVGVEAQRLFKDANDMLDKLSAEKLLNPRGVVGLFPANRVGDDIEIYRDETRTHVLTVSHHLRQQTEKVGFANYCLADFVAPKLSGKADYIGAFAVTGGLKEDALADAFEAQHDDYNKIMVKAIADRLAEAFAEYLHERVRKVYWGYAPNESLSNDELIRENYQGIRPAPGYPACPEHTEKGTIWQLLDVEKHTGMKLTESFAMWPGASVSGWYFSHPESKYFAVAQIQRDQVTDYAFRKGMSVEDVERWLAPNLGYDAD

SEQ ID NO: 11793 - protein, 563 aa, Salmonella enterica subsp. enterica serovar Typhi
MMPFSIIKNIANRERMEIFFTILIMTLVVSLSGVFTRVLPFQLPLPLMQIAIGALLAWPTFGLHVEFDPELFLVLFIPPLLFADGWKTPTREFLEHGREIFGLALALVLVTVVGIGFLIYWLVPGIPLIPAFALAAVLSPTDAVALSGIVGEGRIPKKIMGILQGEALMNDASGLVSLKFAVAVAMGTMVFTVGGATLEFFKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILESSLAAAEADPNVETWMLFTDIVLIYAALMLVRFGWLWTMKKFSLRFLKKKPMEFASWTSREILIASFAGVRGAITLAGVLSIPLLLPDGSGFPARYELVFLAAGVILFSLFVGVIMLPLLLQHLEVADHAQQLKEERIARAATAEVAIVAIQKMEERLAADTEENIDNQLLTEVSSRVIGNLRRRADGRNDVESSIQEENLERRFRLAALRSERAELYHLRATREISNETLQKLLHDLDLMEALLIENQ

SEQ ID NO: 11794 - protein, 332 aa, Salmonella enterica subsp. enterica serovar Typhi
MKTLGEFIVEKQHEFSQATGELTALLSAIKLGAKIIHRDINKAGLVDILGASCAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLIYTTGCGVHAFTYDPSLGVFCLCQERMRFPEKGKTYSINEGNYIKFPNGVKKYIKFCQEEDSSTSRPYTSRYIGSLVADFHRNLLKGGIYLYPSTASHPQGKLRLLYECNPMAFLAEQAGGKASDGKERILDIIPESLHQRRSFFVGNRHMVDDVERFIREYPDA

SEQ ID NO: 11795 - protein, 505 aa, Salmonella typhimurium LT2
MKNEKKKSGIEPKVFFPPLIIVGILCWLTVRDLDAANVVINAVFSYVTNVWGWAFEWYMVVMLFGWFWLVFGPYAKKRLGDEKPEFSTASWIFMMFASCTSAAVLFWGSIEIYYYISTPPFGLEPNSTGAKEIGLAYSLFHWGPLPWATYSFLSVAFAYFFFVRKMDVIRPSSTLVPLVGEKHAKGLFGTIVDNFYLVALIFAMGTSLGLATPLVTECMQWLFGIPHTLQLDAIIITCWIILNAICVACGLQKGVRIASDVRSYLSFLMLGWVFIVSGASFIMNYFTDSVGMLLMHLPRMLFYTDAIGKGGFPQGWTVFYWAWWVIYAIQMSIFLARISRGRTVRELCFGMVMGLTASTWILWTVLGSNTLLLMDKNILNIPQLIEQHGVARAIIETWAALPLSTATMWGFFILCFIATVTLINACSYTLAMSTCREVRDGEEPPLLVRIGWSVLVGIIGIVLLALGGLKPIQTAIIAGGCPLFFVNIMVTLSFIKDAKVHWKDK

SEQ ID NO: 11796 - protein, 347 aa, Salmonella typhimurium LT2
MRIEEDLKLGFKDVLIRPKRSTLKSRSDVELERQFTFKHSGQTWSGVPIIAANMDTVGTFEMAQALAGFDILTAVHKHYTVEEWAAFINTASADVLKHVMVSTGTSDADFEKTVQILALNPALNFVCIDVANGYSEHFVQFVAKAREAWPTKTICAGNVVTGEMCEELILSGADIVKVGIGPGSVCTTRVKTGVGYPQLSAVIECADAAHGLGGMIVSDGGCTMPGDVAKAFGGGADFVMLGGMLAGHEESGGSVVEENGEKFMLFYGMSSESAMNRHVGGVAKYRAAEGKTVKLPLRGPVGNTARDILGGLRSACTYVGASRLKELTKRTTFIRVQEQENRIFNSL

SEQ ID NO: 11797 - protein, 398 aa, Salmonella typhimurium LT2
MKQLTILGSTGSIGCSTLDVVRHNPDSFRVIALVAGKNVARMAEQCLEFSPRYAVMDDTSSAEQLKIMLQQHGSRTEVLSGQQAACEMAALDEVGHVMAAIVGAAGLLPTLAAIRAGKTILLANKESLVTCGRLFMDEVKRSNARLLPVDSEHNAIFQSLPQSIQHNLGYADLEQNGVTSILLTGSGGPFRETPMCDLAAMTPDQACRHPNWSMGRKISVDSATMMNKGLEYIEARWLFNASARQMEVLIHPQSVIHSMVRYQDGSVLAQLGEPDMRTPIAHTMAWPNRVTSGAQPLDFCKLSALTFSAPDYQRYPCLKLAMEAFEQGQAATTALNAANEITVAAFLAQQIRFTDIAGLNLAVLERMDLQEPASVEDVLQVDAIAREVARKQVIRLSR

SEQ ID NO: 11798 - protein, 267 aa, Salmonella typhimurium LT2
MTIPAFGLGTFRLKDDVVIASVKTALELGYRAVDTAQIYDNEAAVGQAIAESGVPRNELYITTKIWIENLSKDKLIPSLKESLKKLRTDYVDLTLIHWPSPGDAVSVEEFMQALLEAKKQGLTREIGISNFTIPLMEKAIAAVGADNIATNQIELSPYLQNRKVVDWAKAHGIHITSYMTLAYGKALKDEVIARIAAKHNATPAQVILAWAMGEGYSVIPSSTRRENLASSLLAQDLHLDAEDKNAIAALDCNDRLVSPEGLAPAWD

SEQ ID NO: 11799 - protein, 620 aa, Salmonella typhimurium LT2
MSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKDRRTVCVIGDGAITAGMAFEAMNHAGDIRPDMLVILNDNEMSISENVGALNNHLAQLLSGKLYSSLREGGKKVFSGVPPIKELLKRTEEHIKGMVVPGTLFEELGFNYIGPVDGHDVMGLISTLKNMRDLKGPQFLHIMTKKGRGYEPAEKDPITFHAVPKFDPSSGCLPKSSGGLPGYSKIFGDWLCETAAKDSKLMAITPAMREGSGMVEFSRKFPDRYFDVAIAEQHAVTFAAGLAIGGYKPVVAIYSTFLQRAYDQVIHDVAIQKLPVMFAIDRAGIVGADGQTHQGAFDLSYLRCIPDMVIMTPSDENECRQMLFTGYHYNDGPTAVRYPRGNAQGVALTPLEKLPIGKGLVKRHGEKLAILNFGTLMPEAAKVAEALNATLVDMRFVKPLDDTLILEMAAQHDALVTLEENAIMGGAGSGVNEVLMAHRKPVPVLNIGLPDFFIPQGTQEEARAELGLDAAGIEAKIKAWLA

SEQ ID NO: 11800 - protein, 208 aa, Salmonella typhimurium LT2
MITLWGRNNSTNVKKVLWTLEELELPYDQILAGGKFGVNQDADYLAMNPNGLVPLLKDDETDLLLWESNAIVRYLAAQYGQNRLWVDNPARRAEGEKWMDWANQTLSPAHRVILMGLVRTPPEKRDQAAIEAGIEKCDSLFALLDDALAHQPWFSGDNFGTGDIAIAPFVYNLLNVGLKWTPRPNLERWYQQLTERPAFRKVVMIPVT

SEQ ID NO: 11801 - protein, 286 aa, Salmonella typhimurium LT2
MKQITGVYTAPRPHWVGDGFPVRSLFSYQSHAQQLSPFLLLDYAGPHTFTPGNEKRGVGEHPHRGFETVTIVYSGEVEHRDSTGRGGVIGPGDVQWMTAGAGILHEEFHSDAFTRRGGELEMVQLWVNLPMKDKMTTPGYQSITHDVIPTVTLPDNAGVVRVIAGRYEETKGPAHTFSPLNVWDMRLQRNRQLTLAQPEGWSTALVVLKGNITVNGTTPVNEAQLVVLSQQGKTLHLEASSDASVLLLSGEPLNEPIVGYGPFVMNTKQEIAEAVRDFNSGRFGQI

SEQ ID NO: 11802 - protein, 488 aa, Salmonella typhimurium LT2
MKKINHWINGKNVAGNDYFQTTNPATGDVLAEVASGGEAEVNQAVAAAKEAFPKWANLPMKERARLMRRLGDLIDQHVPEIAAMETADTGLPIHQTKNVLIPRASHNFEFFAEVCQQMNGKTYPVDDKMLNYTLVQPVGVCALVSPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPTDPNTQVGALISQQHWEKVSGYIRLGIEEGATLLAGGAEKPTDLPAHLKGGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 11803 - protein, 920 aa, Salmonella typhimurium LT2
MNLLNLKNTLQTSLVIRLTFLFLLTTIIIWLLSVLTAAYISMVQKRQHIIEDLSVLSEMNIVLSNQRFEEAERDAKNLMYQCSLATEIHHNDIFPEVSRHLSVGPSNCTPTLNGEKHRLFLQSSDIDENSFRRDSFILNHKNEISLLSTDNPSDYSTLQPLTRKSFPLYPTHAGFYWSEPEYINGKGWHASVAVADQQGVFFEVTVKLPDLITKSHLPLDDSIRVWLDQNNHLLPFSYIPQKIRTQLENVTLHDGWQQIPGFLILRTTLHGPGWSLVTLYPYGNLHNRILKIILQQIPFTLTALVLMTSAFCWLLHRSLAKPLWRFVDVINKTATAPLSTRLPAQRLDELDSIAGAFNQLLDTLQVQYDNLENKVAERTQALNEAKKRAERANKRKSIHLTVISHELRTPMNGVLGAIELLQTTPLNIEQQGLADTARNCTLSLLAIINNLLDFSRIESGHFTLHMEETALLPLLDQAMQTIQGPAQSKKLSLRTFVGQHVPLYFHTDSIRLRQILVNLLGNAVKFTETGGIRLTVKRHEEQLIFLVSDSGKGIEIQQQSQIFTAFYQADTNSQGTGIGLTIASSLAKMMGGNLTLKSVPGVGTCVSLVLPLQEYQPPQPIKGTLSAPFCLHRQLACWGIRGEPPHQQNALLNAELLYFSGKLYDLAQQLILCTPNMPVINNLLPPWQLQILLVDDADINRDIIGKMLVSLGQHVTIAASSNEALTLSQQQRFDLVLIDIRMPEIDGIECVRLWHDEPNNLDPDCMFVALSASVATEDIHRCKKNGIHHYITKPVTLATLARYISIAAEYQLLRNIELQEQDPSRCSALLATDDMVINSKIFQSLDLLLADIENAVSAGEKIDQLIHTLKGCLGQIGQTELVCYVIDIENRVKMGKIIALEELTDLRQKIRMIFKNYTIT

SEQ ID NO: 11804 - protein, 457 aa, Salmonella typhimurium LT2
MQKYTSEARQLLALRIPVILAQVAQTAMGFVDTVMAGGYSATDMAAVAIGTSIWLPAILFGHGLLLALTPVIAQLNGSGRRERIAHQVRQGFWLAGFVSVLVMIVLWNAGYIIRSMHNIDPALADKAVGYLRALLWGAPGYLFFQVARNQCEGLAKTKPGMVMGFLGLLVNIPVNYIFIYGHFGMPELGGIGCGVATAAVYWVMFIAMLSYIKHARSMRDIRNEKGFGKPDSVVMKRLIQLGLPIALALFFEVTLFAVVALLVSPLGIVDVAGHQIALNFSSLMFVLPMSLAAAVTIRVGYRLGQGSTLDAQTAARTGLGVGICMAVVTAIFTVTLRKHIALLYNDNPEVVALAAQLMLLAAVYQISDSIQVIGSGILRGYKDTRSIFFITFTAYWVLGLPSGYILALTDLVVDRMGPAGFWMGFIIGLTSAAVLMMLRMRYLQRQPSAIILQRAAR

SEQ ID NO: 11805 - protein, 300 aa, Salmonella typhimurium LT2
MMSRKDGFLALLVVVVWGLNFVVIKVGLHHMPPLLLAGLRFLLVAFPAIFFVARPKVPLTLLLGYGLTISFGQFAFLFCAIKFGMPAGLASLVLQAQAFFTMALGAFVFSERLQRKQLAGIALAIIGVLVLIEASLNGQHIAMSGFMLTLAAAFSWACGNIFNKKIMQHSPRPAVMSLVVWSALIPILPFLLSSLLLEGADHITQSLITIDMTTILSLLYLAFVATILGYGIWGALLGRYETWRVAPLSLLVPVVGLASAAVLLGETLTGMQLAGAVLIMAGLYINVFGFRVRRTARVSG

SEQ ID NO: 11806 - protein, 462 aa, Salmonella typhimurium LT2
MTMMTATQALSVNPATGQTLAAMPWANAQEIEHALSLAASGFKKWKMTSVAQRAQTLRDIGQALRAHAEEMAQCITREMGKPIKQARAEVTKSAALCDWYAEHGPAMLNPEPTLVENQQAVIEYRPLGVILAIMPWNFPLWQVLRGAVPILLAGNSYLLKHAPNVTGCAQMIARILAEAGTPAGVYGWVNANNEGVSQMINDPRIAAVTVTGSVRAGAAIGAQAGAALKKCVLELGGSDPFIVLNDADLELAVKAAVAGRYQNTGQVCAAAKRFIVEEGIAQAFTDRFVAAAAALKMGDPLVEENDLGPMARFDLRDELHQQVQASVAEGARLLLGGEKIAGEGNYYAATVLADVTPDMTAFRQELFGPVAAITVAKDAAHALALANDSEFGLSATIFTADDTLAAEMAARLECGGVFINGYSASDARVAFGGVKKSGFGRELSHFGLHEFCNVQTVWKNRV

SEQ ID NO: 11807 - protein, 481 aa, Salmonella typhimurium LT2
MTIWENAMQYQLLINGVLVDGEGERQSVYNPATGEVILEIAEASPAQVDAAVQAADNAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAVLAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDESTELGPLSSLAHLKRVTAAVEEAKALSHIRVITGGSQTEGKGYYFAPTLLADAKQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 11808 - protein, 372 aa, Salmonella typhimurium LT2
MKSRAAVAFGPGQPLKIVEIDVAPPKKGEVLVKITHTGVCHTDAFTLSGDDPEGVFPAVLGHEGGGVVVEVGEGVTSLKPGDHVIPLYTAECGECKFCKSGKTNLCQAVRATQGKGLMPDGTTRFSYNGEPVYHYMGTSTFSEYTVCAEISLAKVNPQAPLDKVCLLGCGVTTGIGAVHNTAKVKAGDTVAVFGLGGIGLAVIQGAVQAKAGRILAVDTNPEKFTLAGEMGATDFINPNDYDKPIQDVIVELTDGGVDFSFECIGNVNVMRAALECCHKGWGESIIIGVAGAGQEIKTRPFQLVTGRVWRGSAFGGVKGRTQLPGMVEDAMNGKIRLDPFITHRLPLEQINDAFELMHQGKSIRTVIHFGDN

SEQ ID NO: 11809 - protein, 289 aa, Salmonella typhimurium LT2
MEYSILSNNLKMPMVGFGVFKVTDKEECQQSVLSAIRSGYRLIDTAAVYGNEDAVGDAVREAIATGLCTREELFITSKLWVQDMANYDLAKAGIEASLKKSGLDYFDLYLLHQAMGDYFSAWRALEDAYEAGKLKAIGVSNFYAHVLANFCETVRITPMVNQVELHPYFAQPAALETMKHYNVQPEAWAPLGGGRHKPYENVMLQGIADAHQKTIAQVVLRWNVQRGVTVIPKSTRQERIEENFAIWDFSLTDNEMAQINALDLGYVGEAVKHFNPEFVRGCLGVKIHD

SEQ ID NO: 11810 - protein, 306 aa, Salmonella typhimurium LT2
MRFRQLLPLFGALFALYIIWGSTYFVIRIGVESWPPLMMAGVRFLSAGMLLMAFLLLRGEKLPPLRQTINAALIGLLLLAVGNGLVTVAEHQNVPSGIAAVVVATVPLFTLCFSYFFGIKTRKLEWVGIAIGLAGIILLNSGGNLSGNPWGAILILIGSMSWAFGSVYGSRIALPVGMMAGAIEMLAAGVVLLCAAFLSGEKLATLPGLSGFMAVGYLALFGSIIAINAYMYLIRNVSPALATSYAYVNPVVAVLLGTGLGGERLSPVEWAALGVIVFAVVLVTLGKYLFPVKAVVTPCKTEDSRQ

SEQ ID NO: 11811 - protein, 162 aa, Salmonella typhimurium LT2
MLEDLRANSWSLRPCCMVLAYRIAHFCSVWRKKNVLNNLWAAPVLVLYRVITECLFGYEIQAAATIGRRFTIHHGYAVVINKHVVAGDDFTIRHGVTIGNRGADSLACPVIGNGVELGANVILLGDITIGNHVTIGAGSVVLDSIPDHALVVGEKARVKVST

SEQ ID NO: 11812 - protein, 369 aa, Salmonella typhimurium LT2
MNEQSQAKSPDTLRAMVAGTLANFQHPTLKHNLTTLKALHHVAWMDDTLHVELVMPFVWNSAFEVLKEQCSADLLRITGAKAIDWKLSYNIATLKRVKNQPGINGVKNIIAVSSGKGGVGKSSTAVNLALALAAEGAKVGVLDADIYGPSIPTMLGAEDQRPTSPDGTHMAPIMSHGLATNSIGYLVTDDNAMVWRGPMASKALMQMLQETLWPDLDYLVLDMPPGTGDIQLTLAQNIPVTGAVVVTTPQDIALIDAKKGIVMFEKVEVPVLGIVENMSMHICSNCGHHEPIFGTGGAQKLAEKYHTQLLGQMPLHISLREDLDRGTPTVVSRPESEFTAIYRELADRVAAQLYWQGEVIPGEIAFRAV

SEQ ID NO: 11813 - protein, 253 aa, Salmonella typhimurium LT2
MTKVAIVTASDSGIGKACALLLAQNGFDIGITWHSDERGAQETAKKAAQFGVRAETIHLDLSQLPEGAQAIEHLIQRLGRVDVLVNNAGAMTKSAFIDMPFTQWRQIFTVDVDGAFLCAQIAARHMIKQGEGGRIINITSVHEHTPLPQASAYTAAKHALGGLTKSMALELIEHHILVNAVAPGAIATPMNDMDDSDIEPGSEPSIPIARPGSTHEIASLVAWLCSEGASYTTGQSLIVDGGFMLANPQFNAK

SEQ ID NO: 11814 - protein, 948 aa, Salmonella typhimurium LT2
MKYLASFRTTLKVSRYLFRALALLIWLLIAFVSVFYIVNALHQRESEIRQEFNLSSDQAQRFIQRTSDVMKELKYIAENRLTAENGVMSSRARDDKMVVPDFEPLFADSDCAAMGSAWRGSLESLAWFMRYWRDNFSAAYDLNRVFLIGSDNLCMANFGLREMPVERDDALKALHERIMKYRNAPQEESGNNLFWISQGARQGVGYFYALTPVYLANRLQALLGVEQSIRMENFFTPGSLPMGVTIIDENGHSLISLTGPDGIIKAEPRWMQERSWFGYTPGFRELVLKKSLPPSSLSIVYSVPVDLVLERIRILILNAILLNVLVGAGLFTLARMYERRIFIPAESDAQRLEEHEQFNRKIVASAPVGICILRTIDGVNILSNELAHTYLNMLTHEDRQRLTQIICGQQVNFVDVLTSNNTNLQISFVHSRYRNENVAICVLVDVSTRVKMEESLQEMAQAAEQASQSKSMFLATVSHELRTPLYGIIGNLDLLQTKELPKGVERLVTAMNNSSSLLLKIISDILDFSKIESEQLKIEPREFSPREVMNHITANYLPLVVRKQLGLYCFIEPDVPVSLNGDPMRLQQVISNLLSNAIKFTDIGCIVLHVRCDGDYLSIRVRDTGVGIPAKEVVRLFDPFFQVGTGVQRNFQGTGLGLAICEKLISMMDGDISVDSEPGMGSQFTLRIPLYGAQYPVKKSVEGLAGTCCWLAVRNTSLCQFIETSLARSGVHTQRYEGQEPAADDILIVDDALEHTWQGRAAVVFCRRHIGIPLERAPGEWVHSVASVHELPALLARIYSIELDSEALSSALPTTDKTADSNDDMMILVVDDHPINRRLLADQLGSLGYQCKTANDGVDALNVLSKNAIDIVLSDVNMPNMDGYRLTQRIRQLGLTLPVVGVTANALAEEKQRCLESGMDSCLSKPVTLDVLKQTLAVYAERVRKTRA

SEQ ID NO: 11815 - protein, 441 aa, Salmonella typhimurium LT2
MSSPQENLYDAIRIVKRKIIPLAFILYFFNYMDRVNIGFAALRMNESLGITPEDFANISSIFFISYLIFQIPSSIGLQKLGARKWISSIIIGWGAVTGLIFFAKDTQHILLARIFLGVFEAGFFPGMVYYLACWFPARERGKVNSFFMLSIAVASVLAAPMSGWIIEHLNTPDYEGWRWLFAIEGIPTVFLGILTFYLLPDSPEKAKWLTPQQISALVNKLRTDNETAAALNKNTNSSFLSVIKNPVLLQLSFAYMLIQAAALAANYWLPGLVKGFSADFTDTDVGLIMSIPFIFAMFSMPWWGWHSDKKNERKWHAALPMFLAGCGFLMIALVPSMSLRMLGLTFYGVGILSYYGPYWALPSALLSPSGLAISIAFINSCSSLGGFLINKSLGFVSTHYGATGIFIVEAILCFAAVAVLALMKIDVKKEKSQQTNVVSRT

SEQ ID NO: 11816 - protein, 225 aa, Salmonella typhimurium LT2
MPEEARVQCKGFLFDLDGTLVDSLPAVERAWCSWADRFNLAHDEVLGFIHGKQAITSLRHFMAGKSEAEIAAEFTRLEQIEATETAGITALPGAVDLLNHLNKVGIPWAIVTSGSMPVARARHQVAGLPAPEVFVTAERVKRGKPEPDAYLLGAQLLGLAPQECVVVEDAPAGVLSGLAAGCHVIAVNAPADTPRLADVDFALDSLTQLSVAKQPNGDVVVLRKT

SEQ ID NO: 11817 - protein, 317 aa, Salmonella typhimurium LT2
MIKLAPAGLKDDIEMRKVYAGFIAGQIEAGSPIIALEADLMSSMAMDSVARDYPQHVINCGIMEANVIGTAAGLALTGRKPFVHTFTAFASRRCFDQLFMALDYQRNNVKVIASDAGVTACHNGGTHMSFEDMGIVRGLAHSVVLEVTDAVMFADILRQLMDLDGFYWLRTIRKQARSIYAPGSTFTIGKGNVLREGDDITLIANGIMVAEALEAARQLEQEGVSAAVIDMFTLKPIDRMLVKNYAEKTRRIVTCENHSIHNGLGSAVAEVLVENCPVPMRRVGVKERYGQVGTQDFLQKEYGLTAEAIVEAAKSLL

SEQ ID NO: 11818 - protein, 465 aa, Salmonella typhimurium LT2
MTDSIMQNYNQLREQVINGDRRFQHKDGHLCFEGVDLDALARQYPTPFYVFSEPEIIRNIHEIQQAFAAHKNTKTFFASKTCSVMGVLKAIRDAGICAEANSQYEVRKCLEIGFRGDQIVFNGVVKKPADLEYAIANDLYLINVDSLYELEHIDAISRKLKKVANVCVRVEPNVPSATHAELVTAFHAKSGLDLEQAEETCRRILAMPYVHLRGLHMHVGDQVPESEPFAKATKVLVDESRRLEEVLGIKFDLINVGGGIPVPYKYDDENGDPLKDNMYAGITAQDFADAVIREVHKWRTDVEICIEPGRKVTGSAAVLLTEVSCEKRKTNYDLNGNVECHVEWKFVDAGYSVLSDSQHFDWFFYVYNASRMTAAHDAWIKLAGPLCDGGDYFHMGVKGEEFLLPKETHVGDIVAFLDAGAYTIESQTVYNNRPRTGVVMIDKNGDTRLIRREDSYEDMVKYDIY

SEQ ID NO: 11819 - protein, 488 aa, Salmonella typhimurium LT2
MLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLHEVKALTERNGFAGYPVVTEDNELVGIITGRDVRFVTDLNQPVSVYMTPKERLVTVREGEAREVVLAKMHEKRVEKALVVDDNFHLLGMITVKDFQKAERKPNSCKDEQGRLRVGAAVGAGAGNEERVDALVAAGVDVLLIDSSHGHSEGVLQRIRETRAKYPDLQIIGGNVATGAGARALAEAGCSAVKVGIGPGSICTTRIVTGVGVPQITAVSDAVEALEGTGIPVIADGGIRFSGDIAKAIAAGASAVMVGSMLAGTEESPGEIELYQGRSYKSYRGMGSLGAMSKGSSDRYFQSDNAADKLVPEGIEGRVAYKGRLKEIIHQQMGGLRSCMGLTGCATIDELRTKAEFVRISGAGIQESHVHDVTITKESPNYRLGS

SEQ ID NO: 11820 - protein, 396 aa, Salmonella typhimurium LT2
MLDAQTIATVKATIPLLVETGPKLTAHFYDRMFTHNPELKEIFNMSNQRNGDQREALFNAIAAYASNIENLPALLPAVEKIAQKHTSFQIKPEQYNIVGTHLLATLDEMFNPGQEVLDAWGKAYGVLANVFIHREAEIYHENASKDGGWEGTRPFRIVAKTPRSALITSFEFEPVDGGTVAEYRPGQYLGVWLKPEGFAHQEIRQYSLTRKPDGKGYRIAVKREDGGQVSNWLHHHASVGDGVHLAAPAGDFFMNVAADTPVSLISAGVGQTPMLAMLDTLAKEQHTAQVNWFHAAENGDVHAFADEVSELGRTLPRFTAHTWYREPTESDRAQRLFDSEGLMDLSKLEAAISDPAMQFYLCGPVGFMQFAAKQLVSLGVNNENIHYECFGPHKVL

SEQ ID NO: 11821 - protein, 482 aa, Salmonella typhimurium LT2
MQLNDSTLFRQQAFIDGDWRDARGGDVIPVSNPANGKPLGNVPKMGAEETRDAINAANRALPAWRALTAKERANILRRWFNLMMEHQDDLARLMTLEQGKPLAEAKGEISYAASFIEWFAEEGKRIYGDTIPGHQADKRLLVIKQPIGVTAAITPWNFPSAMITRKAGPALAAGCTMVLKPASQTPFSALALAELAQRAGIPAGVFNVVTGSAGDIGGELTSNPLVRKLSFTGSTEIGRQLMEQCAKDIKKVSLELGGNAPFIVFDDADLDKAVEGALASKFRNAGQTCVCANRLYVQDGVYDRFAEKLNQAVNKLAVGDGLQADVAIGPLIDEKAVAKVQEHIADALEKGARVITGGEAHKLGGNFFQPTILADVPDNAKVAKEETFGPLAPLFRFSDEADVIRQANDTEFGLAAYFYARDLSRVFRVGEALEYGIVGINTGIISNEVAPFGGIKASGLGREGSKYGIEDYLEIKYMCIGL

SEQ ID NO: 11822 - protein, 918 aa, Salmonella typhimurium LT2
MTNYSLRARMMILILAPTVLIGLLLSIFFVVHRYNDLQRQLEDAGASIIEPLAVSSEYGMNLQNRESIGQLISVLHRRHSDIVRAISVYDDHNRLFVTSNFHLDPSQMQLPAGAPFPRRLSVDRHGDIMILRTPIISESYSPDESAIADAKNTKNMLGYVALELDLKSVRLQQYKEIFISSVMMLFCIGIALIFGWRLMRDVTGPIRNMVNTVDRIRRGQLDSRVEGFMLGELDMLKNGINSMAMSLAAYHEEMQHNIDQATSDLRETLEQMEIQNVELDLAKKRAQEAARIKSEFLANMSHELRTPLNGVIGFTRLTLKTELNPTQRDHLNTIERSANNLLAIINDVLDFSKLEAGKLILESIPFPLRNTLDEVVTLLAHSSHDKGLELTLNIKNDVPDNVIGDPLRLQQVITNLVGNAIKFTESGNIDILVEKRALSNTKVQIEVQIRDTGIGIPERDQSRLFQAFRQADASISRRHGGTGLGLVITQKLVNEMGGDISFHSQPNRGSTFWFHINLDLNPNVIIDGPSTACLAGKRLAYVEPNATAAQCTLDLLSDTPVEVVYSPTFSALPLAHYDIMILSVPVTFREPLTMQHERLAKAASMTDFLLLALPCHAQINAEKLKQGGAAACLLKPLTSTRLLPALTEYCQLNHHPEPLLMDTSKITMTVMAVDDNPANLKLIGALLEDKVQHVELCDSGHQAVDRAKQMQFDLILMDIQMPDMDGIRACELIHQLPHQQQTPVIAVTAHAMAGQKEKLLSAGMNDYLAKPIEEEKLHNLLLRYKPGANVAARLMAPEPAEFIFNPNATLDWQLALRQAAGKPDLARDMLQMLIDFLPEVRNKIEEQLVGENPNGLVDLVHKLHGSCGYSGVPRMKNLCQLIEQQLRSGVHEEELEPEFLELLDEMDNVAREAKKILG

SEQ ID NO: 11823 - protein, 420 aa, Salmonella typhimurium LT2
MSLPHYHAETDLNAENLLRLPAEFGCPVWVYDAHIIRRQIAALQQFDVVRFAQKACSNIHILRLMRALGVKVDSVSLGEIERALAAGYDPQTCPDDIVFTADVIDAATLARVSELHIPVNAGSVDMLTQLGQVSPGHRVWLRVNPGFGHGHSQKTNTGGENSKHGIWHSDLPAALAVMQKYRLKLVGIHMHIGSGVDYGHLEQVCGAMVRQVLECGQDVEAISAGGGLSIPYREGEEPVDTRHYYGLWNAAREQIARHLGHAVKLEIEPGRFLVAQSGVLVTQVRSVKQMGSRHFVLVDAGFNDLMRPAMYGSYHRISALAADGRALENGPWVETVVAGPLCESGDVFTQQEGGMVETRALPAVIPGDYLVLHDTGAYGASMSSNYNSRPLLPEVLFDNGQARLIRRRQTIEELLALEML

SEQ ID NO: 11824 - protein, 472 aa, Salmonella typhimurium LT2
MVSINHDSALTPRSLRDTRRMNMFVSVSAAVAGLLFGLDIGVIAGALPFITDHFVLTSRLQEWVVSSMMLGAAIGALFNGWLSFRLGRKYSLMAGAILFVLGSLGSAFASSVEVLIGARVILGVAVGIASYTAPLYLSEMASENVRGKMISMYQLMVTLGIVLAFLSDTAFSYSGNWRAMLGVLALPAVLLIILVVFLPNSPRWLAQKGRHIEAEEVLRMLRDTSEKARDELNEIRESLKLKQGGWALFKANRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFIGITFWLIPETKNVTLEHIERKLMAGEKLRNIGV

SEQ ID NO: 11825 - protein, 253 aa, Salmonella typhimurium LT2
MILNAFSLEGKVAVVTGCDTGLGQGMALGLAEAGCDIVGINIVEPTETIARVTALGRRFLSLTADLRQIDGIPALLERAVAEYGHIDILVNNAGLIRREDAIDFTEKDWDDVMNLNIKSVFFMSQAAAKHFIAQGNGGKIINIASMLSFQGGIRVPSYTASKSGVMGITRLMANEWAKHNINVNAIAPGYMSTNNTQQLRADAQRSAEILDRIPAGRWGLPGDLMGPVVFLASSAADYINGYTIAVDGGWLAR

SEQ ID NO: 11826 - protein, 494 aa, Salmonella typhimurium LT2
MSDVTLLAEVTTFLRQRHGQFIAGERQAGNGTNFSVTNPATGKIIADVVSATPAQAEEAMQSARRAFDVWRKMPTLQRGALLLKLADTLAAHREELAQLESVCSGKTIMLSRGLELDQSVAFLRYFAGWAGKITGETLNVSLPSMGEERYTAFTQRQPIGVVVGIVPWNFSIMIAIWKLAAALVCGCTIVIKPSEYTPLTLLRVAELAKEAGFPDGVINVVNGAGGEIAQQLIAHPDCAKVSFTGSVATGEKVRRSATSSGKRVTLELGGKNAALFLNDLTAQAMVNGILEAGYLNQGQICAAAERFYLPQEKLDTVMTLLRQRLSEIVPGSPLDEKTVMGPLANQVQLEKVLRLIQRAREEGDTIVYGGETLPGEGYFLQPTAVKVRSKNSTLMHEETFGPVCSFIGYQNEKEALSHINDSPFGLAASVWSENISKALRYAEDIDAGMVWVNMHTFLDPAVPFGGMKGSGIGREFGSAFIDDYTELKSVMVRY

SEQ ID NO: 11827 - protein, 275 aa, Salmonella typhimurium LT2
MANPTIIRLQDGNVMPQLGLGVWKASNEEVIAAIHKALEVGYRSIDTATAYQNEEGVGKALKAASVAREELFITTKLWNDDQKRPREALQESLKKLQLDYLDLYLMHWPVPAIDHYVDAWKGMIALQKEGLVKSIGVCNFQIHHLQRLIDETGVTPVINQIELHPLMQQRQLHAWNATHKIQTESWSPLAQGGEGVFDQKVIRELADKYGKTPAQIVIRWHLDCGLVVIPKSVTPSRIAENFAVWDFRLDKDELGEIAKLDQGKRLGPDPDQFGG

SEQ ID NO: 11828 - protein, 660 aa, Salmonella typhimurium LT2
MPHIDREAPDSRSERQRPKYKYALALNVDSYTVDTNQTNKCGYRLMEQNPQSQLKLLVTRGKEQGYLTYAEVNDHLPEDIVDSDQIEDIIQMINDMGIQVMEEAPDADDLLLAENTTSTDEDAEEAAAQVLSSVESEIGRTTDPVRMYMREMGTVELLTREGEIDIAKRIEDGINQVQCSVAEYPEAITYLLEQYDRVEAEEARLSDLITGFVDPNAEEEMAPTATHVGSELSQEDLDDDEDEDEEDGDDDAADDDNSIDPELAREKFAELRAQYVVTRDTIKAKGRSHAAAQEEILKLSEVFKQFRLVPKQFDYLVNSMRVMMDRVRTQERLIMKLCVEQCKMPKKNFITLFTGNETSETWFNAAIAMNKPWSEKLHDVAEEVQRCLQKLRQIEEETGLTIEQVKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELAERMLMPEDKIRKVLKIAKEPISMETPIGDDEDSHLGDFIEDTTLELPLDSATTESLRAATHDVLAGLTAREAKVLRMRFGIDMNTDHTLEEVGKQFDVTRERIRQIEAKALRKLRHPSRSEVLRSFLDD

SEQ ID NO: 11829 - protein, 778 aa, Salmonella typhimurium LT2
MKQIRMLAQYYVDLMMKLGLVRFSMLLALALVVLAIVVQMAVTMVLHGQVESIDVIRSIFFGLLITPWAVYFLSVVVEQLEESRQRLSRLVQKLEEMRERDLKLNVQLKDNIAQLNQEIADREKAEAELQETFEQLKVEIKEREEAQIQLEQQSSFLRSFLDASPDLVFYRNEDKEFSGCNRAMELLTGKSEKQLVHLKPEDVYSPEAAEKVIETDEKVFRHNVSLTYEQWLDYPDGRKACFEIRKVPYYDRVGKRHGLMGFGRDITERKRYQDALERASRDKTTFISTISHELRTPLNGIVGLSRILLDTDLTAEQEKYLKTIHVSAVTLGNIFNDIIDMDKMERRKVQLDNQPIDFTSFMADLENLSGLQAQQKGLRFVLEPTLPLPHKVITDGTRLRQILWNLISNAVKFTQQGQVTVRARYDEGDMLHFEVEDSGIGIPQDEQDKIFAMYYQVKDSNGGKPATGTGIGLAVSRRLAKNMGGDITVSSLPGKGSTFTLTVHAPAVAEEVEDAFDEDDMPLPALHVLLVEDIELNVIVARSVLEKLGNSVDVAMTGKAALEMFVPGEYDLVLLDIQLPDMTGLDIARELTRRHTREDLPPLVALTANVLKDKKEYLDAGMDDVLSKPLSVPALTAMIKKFWDATDKEESTVTPEESDKAQALLDIPMLEQYIELVGPKLITDGLAVFEKMMPGYLSVLESNLTARDKKGVVEEGHKIKGAAGSVGLRHLQQLGQQIQSPDLPAWEDNVVEWIEEMKQEWQHDVAVLKAWVANAEKK

SEQ ID NO: 11830 - protein, 309 aa, Salmonella typhimurium LT2
MSKKIAVIGECMIELSQKGADVQRGFGGDTLNTSVYIARQVDSAALAVHYVTALGTDSFSQQMLEAWQHENVDTSLTQRMENRLPGLYYIETDDTGERTFYYWRNEAAAKFWLESEQSAAICETLATFDYLYLSGISLAILSPTSRDKLLSLLRECRANGGKVIFDNNYRPRLWTSREETQQVYQKMLECTDIAFLTLDDEDALWGQQPVEEVIARTHAAGVQEVVVKRGADSCLVSIQGEALIDVPAVKLPKEKVIDTTAAGDSFSAGYLAVRLTGGSATDAAKRGHLTASTVIQYRGAIIPHDAMPQ

SEQ ID NO: 11831 - protein, 512 aa, Salmonella typhimurium LT2
MTNNPPSTRIQPGEYGYPLKLKARYDNFIGGDWVAPADGEYYQNLTPVTGQPLCEVASSGKKDIDLALDAAHKAKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIIGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSGTQMGAQVSHGQLETILNYIDIGKKEGADILTGGRRKELDGELKEGYYLEPTILFGKNNMRVFQEEIFGPVLAVTTFKTMEEALEIANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 11832 - protein, 273 aa, Salmonella typhimurium LT2
MPCEELEIVWKNIKAEARALADCEPMLASFYHATLLKHENLGSALSYMLANKLASPIMPAIAIREVVEEAYAADPEMIASAACDIQAVRTRDPAVDKYSTPLLYLKGFHALQAYRIGHWLWNKGRRALAIFLQNQVSVSFQVDIHPAAKIGRGIMLDHATGIVVGETAVIEDDVSILQSVTLGGTGKTSGDRHPKIREGVMIGAGAKILGNIEVGRGAKIGAGSVVLQPVPPHTTAAGVPARIVGKPGSDKPSMDMDQHFNGIHHTFEYGDGI

SEQ ID NO: 11833 - protein, 381 aa, Salmonella typhimurium LT2
MIKKIIFTVTPIFSIPPRGAAAVETWIYQVAKRLSIPNAIACIKNAGYPEYNKINDNCDIHYIGFSKVYKRLFQKWTRLDPLPYSQRILNIRDKVTTQEDSVIVIHNSMKLYRQIRERNPNAKLVMHMHNAFEPELPDNDAKIIVPSQFLKAFYEERLPAAAVSIVPNGFCAETYKRNPQDNLRQQLNIAEDATVLLYAGRISPDKGILLLLQAFKQLRTLRSNIKLVVVGDPYASRKGEKAEYQKKVLDAAKEIGTDCIMAGGQSPDQMHNFYHIADLVIVPSQVEEAFCMVAVEAMAAGKAVLASKKGGISEFVLDGITGYHLAEPMSSDSIINDINRALADKERHQIAEKAKSLVFSKYSWENVAQRFEEQMKNWFDK

SEQ ID NO: 11834 - protein, 407 aa, Salmonella typhimurium LT2
MMSLAGKKIVLGVSGGIAAYKTPELVRRLREHGADVRVAMTEAAKAFITPLSLQAVSGYPVSDSLLDPAAEAAMGHIELGKWADLVILAPATADLIARVASGMANDLVSTICLATPAPVAVLPAMNQQMYRAAATQHNLEVLASRGLFIWGPDSGSQACGDVGPGRMLDPLVIVDKAAAHFAAVNDLRHLNIMITAGPTREPLDPVRYISNHSSGKMGFAIAAAAARRGANVTLVSGPVSLPTPPFVKRVDVITALDMEAAVQAAVQQQHIFISCAAVADYRAETIASEKIKKQAAQGDELLIKMVKNPDIVAGVAALSDNRPYVVGFAAETNNVEEYARQKRIRKNLDLICANDVSLSNQGFNSDKNALHLFWQDGDKVLPLERKELLGQLLLDEIVTRYDEKNRR

SEQ ID NO: 11835 - protein, 911 aa, Salmonella typhimurium LT2
MSTPSLTRRLWLAFALMAALTLLSTVIGWISLRVISQVEQTNTQALLPTMNMARQLSEASAYELFSAQNLTNADSEGVWLAQGKMLKAQSLKINHLLQALSEQGFNTSAIARQEKEIAQTLGQQGTLVGEILTLRAQQQQLSRQIAEAAESIAAQAHGQANNAATSAGATQAGIYDLIESGKGDQAERALDRLIDIDLEYVNQMNELRVNALRFKQLIVTLKDAQGLSDAEDTDEKLNQLVKILSRRQQRIEDPTVRAQIADALETINQYTTLVTLFRKENAIRDQLQTLMANNLFQFTRFSTEVSQLVNAIEKRNEAGLARLTHASQRGQIGLVILGILALCSLSFILWRVVYRSVSRPLAQQTQALQRLLEGDIDSPFPEAAGVSELDTISRLMEAFRANVRKLNRHREDLAEQVRSQTAELHALVLEHRQARAEAEKANEAKSTFLAAMSHEIRTPLYGILGTVQLLADKPLMTNYRDDLQAINDSGESLLAILNDILDYSAIEVGGTNVSISEEPFEPRQLLNSALHLMHSRVQVALITDFSEQLPSTLQGDPRRIRQIVINLLSNAAKFTDRGSIVLRTFCDDQSWFIEVEDTGCGIPEAKLTAIFKPFVQATGRRGGTGLGLAISASLAEAMGGTLTVTSTLHVGSCFRLQLPVCHSKPASKSAFREPINLNGLRLLLIEDNMLTQRITAEMLTGKGVKVSLAESANDALRCLAEGESFDVALVDFDLPDYDGLTLAQQLMSLYPAMKRIGFSAHVIDDNLRQRTAGLFCGIIQKPVPREELYRMIAHYLQGKSHNARAMLNEHQLAGDMASVGPEKLRQWVALFKDSALPLVEEIEAARAMNDDVNIKRLAHKLKSGCASLGMTQATEACRELELQPLSDIDIKTIVTQGVTALDAWIAGHPSP

SEQ ID NO: 11836 - protein, 336 aa, Salmonella typhimurium LT2
MRRELAIEFSRVTEAAALAGYKWLGRGDKNTADGAAVNAMRIMLNQVNIDGTIVIGEGEIDEAPMLYIGEKVGTGHGDAVDIAVDPIEGTRMTAMGQANALAVLAVGDKGCFLNAPDMYMEKLIVGPGAKGAIDLNLPLADNLRNIADALGKPLGDLTVTILAKPRHDEVIAEMAKLGVRVFAIPDGDVAASILTCMPDSEVDVLYGIGGAPEGVVSAAVIRALDGDMQGRLLARHDVKGNSEENRRIGEQELARCKAMGIEAGKALCLGDMARSDNVIFSATGITKGDLLEGISRKGHIATTETLLIRGKSRTIRRIQSIHYLDRKDPDVQAHIL

SEQ ID NO: 11837 - protein, 1256 aa, Salmonella typhimurium LT2
MSHVARCSLFRQHALCQYGSLRGALSGASVSSKVEQLRAQLNERILVLDGGMGTMIQSYRLHEEDFRGERFADWPCDLKGNNDLLVLSKPEVIAAIHNAYFEAGADIIETNTFNSTTIAMADYRMESLSAEINYAAAKLARACADEWTARTPEKPRFVAGVLGPTNRTASISPDVNDPAFRNITFDQLVAAYRESTKALVEGGADLILIETVFDTLNAKAAVFAVKEEFEALGVDLPIMISGTITDASGRTLSGQTTEAFYNSLRHAEALTFGLNCALGPDELRQYVQELSRIAECYVTAHPNAGLPNAFGEYDLDADTMAKQIREWAEAGFLNIVGGCCGTTPEHIAAMSRAVAGLLPRQLPDIPVACRLSGLEPLNIGDDSLFVNVGERTNVTGSAKFKRLIKEEKYSEALDVARQQVESGAQIIDINMDEGMLDAEAAMVRFLSLIAGEPDIARVPIMIDSSKWEVIEKGLKCIQGKGIVNSISMKEGVEAFIHHAKLLRRYGAAVVVMAFDEQGQADTRARKIEICRRAYKILTEEVGFPPEDIIFDPNIFAVATGIEEHNNYAQDFIGACEDIKRELPHALISGGVSNVSFSFRGNDPVREAIHAVFLYYAIRNGMDMGIVNAGQLAIYDDLPAELRDAVEDVILNRRDDGTERLLDLAEKYRGSKTDEAANAQQAEWRSWDVKKRLEYSLVKGITEFIEQDTEEARQQAARPIEVIEGPLMDGMNVVGDLFGEGKMFLPQVVKSARVMKQAVAYLEPFIEASKEKGSSNGKMVIATVKGDVHDIGKNIVGVVLQCNNYEIVDLGVMVPAEKILRTAREVNADLIGLSGLITPSLDEMVNVAKEMERQGFTIPLLIGGATTSKAHTAVKIEQNYSGPTVYVQNASRTVGVVAALLSDTQRDDFVARTRKEYETVRIQHARKKPRTPPVTLEAARDNDLAFDWERYTPPVAHRLGVQEVEASIETLRNYIDWTPFFMTWSLAGKYPRILEDEVVGVEAQRLFKDANDMLDKLSAEKLLNPRGVVGLFPANRVGDDIEIYRDETRTHVLTVSHHLRQQTEKVGFANYCLADFVAPKLSGKADYIGAFAVTGGLEEDALADAFEAQHDDYNKIMVKAIADRLAEAFAEYLHERVRKVYWGYAPNESLSNDELIRENYQGIRPAPGYPACPEHTEKGTIWQLLDVEKHTGMKLTESFAMWPGASVSGWYFSHPESKYFAVAQIQRDQVTDYAFRKGMSVEDVERWLAPNLGYDAD

SEQ ID NO: 11838 - protein, 548 aa, Salmonella typhimurium LT2
MEIFFTILIMTLVVSLSGVFTRVLPFQLPLPLMQIAVGALLAWPTFGLHVEFDPELFLVLFIPPLLFADGWKTPTREFLEHGREIFGLALALVLVTVVGIGFLIYWLVPGIPLIPAFALAAVLSPTDAVALSGIVGEGRIPKKIMGILQGEALMNDASGLVSLKFAVAVAMGTMVFTVGGATLEFFKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILESSLAAAEADPNVETWMLFTDIVLIYAALMLVRFGWLWTMKKFSLRFLKKKPMEFASWTSREILIASFAGVRGAITLAGVLSIPLLLPDGSGFPARYELVFLAAGVILFSLFVGVIMLPLLLQHLEVADHAQQLKEERIARAATAEVAIVAIQKMEERLAADTEENIDNQLLTEVSSRVIGNLRRRADGRNDVESSIQEENLERRFRLAALRSERAELYHLRATREISNETLQKLLHDLDLMEALLIENQ

SEQ ID NO: 11839 - protein, 332 aa, Salmonella typhimurium LT2
MKTLGEFIVEKQHEFSQATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDSSTSRPYTSRYIGSLVADFHRNLLKGGIYLYPSTASHPQGKLRLLYECNPMAFLAEQAGGKASDGKERILDIIPESLHQRRSFFVGNRHMVDDVERFIREYPDA

SEQ ID NO: 11840 - protein, 477 aa, Salmonella typhimurium LT2
MSTSDSCYNTGYILRICAIAALGGILFGYDTAVISGAIGSLTSYFHLSPAETGWAVSCVVVGCVIGSFSAGYLSKRFGRKKSLMVSALLFTISAVGTSLSYTFTHFVIYRIIGGLAVGLAATVSPMYMSEVSPKNMRGRALSMQQFAIVFGQILIFYVNYKIASIAADTWLIELGWRYMFAAGIIPCILFCILVFLIPESPRWMMMIGREEETLKILTKISNEEHARHLLADIKTSLQNDQLNAHQKLNYRDGNVRFILILGCMIAMLQQVTGVNVMMYYAPIVLKDVTGSAQEALFQTIWIGVIQLIGSIIGAMIMDKMGRLSLMRKGTIGSIIGLLLTSWALYSQATGYFALFGMLFFMIFYALSWGVGAWVLISEIFPNRMRSQGMSISVGFMWMANFLVSQFFPMINENPYLLSHFHGAFPMWIFAICCIFSYFFICRYLPETKGISLEKMESVVLAKRRKKLQPIQTERYSD

SEQ ID NO: 11841 - protein, 478 aa, Salmonella typhimurium LT2
MSQRSKYNSAYVYVLCCIAALAGLMFGYSTAVITGVVLPLQQYYQLTPTETGWAVSSIVIGCIIGALVGGKIADKLGRKPALLIIAIIFIASSLGAAMSESFMIFSLSRIVCGFAVGMAGTASTMYMSELAPAEIRGKALGIYNISVVSGQVIVFIVNYLIAKGMPADVLVSQGWKTMLFAQVVPSIAMLAITLFLPESPAWCARNNRSEARSIKVLTRIYSGLTATDVAAIFDSMKETVRSQDNVAGGERTNLKSSPVLRYILLVGCCIAVLQQFTGVNVMNYYAPLVLQNSSTEVVMFQTIFIAVCNVVGSFIGMILFDRYGRIPIMKIGTIGSIVGLLIASYGLYTHDTGYITIFGILFFMLLFAVSWSVGAWVLISEVFPEKIKGFGMGLAVSLMWIANFLISLLFPVINDNAWLQETFGGAFSMWIFVVFNLVCYVFISRYVPETKGVPLTEIERLAENKLREIQGKRRDVIA

SEQ ID NO: 11842 - protein, 254 aa, Salmonella typhimurium LT2
MNDLFSLAGKNILITGAAQGIGYLLATGLGRYGARIIVNDITPERAETAVTKLQQEGIKAIAAPFNVTHKQDIEAAVEHIEKDIGVIDVLINNAGIQRRHPFTEFPEQEWNDVIAVNQTAVFLVSQAVTRRMVARQAGKVINICSMQSELGRDTITPYAASKGAVKMLTRGMCVELARHNIQVNGIAPGYFKTEMTKALVEDEAFTSWLCKRTPAARWGDPQELIGAAVFLSSKASDFVNGHLLFVDGGMLVAV

SEQ ID NO: 11843 - protein, 456 aa, Salmonella typhimurium LT2
MAYQTVNPANNQLIKEYPPHTDADIEAALQKADALYHSDWSKGEIDQRLPVLHKLADLIDSRVEELAKIASQEMGKLIEQSRGEVKLCAQIARYYADKAKQFLAPVPYKTEFGDAWVEHHPIGVIMAVEPWNFPYYQLMRVLAPNLAAGNPVLAKHASIVPHCAETFAHLVREAGAPEGAWTNLFISSDQVANIIADPRVQGAALTGSEKAGSAVAAQAAKHIKKSTLELGGNDVFVVLDDADLEKAVKIGVQARLTNAGQVCTAAKRFILHEKIADQFLSQFTEAFRKVKVGDQMDASTELGPLSSKDALETLTRQVEEAVKNGATLHVGGKPLESKGNFFEPTILTHITRDNPAYFEEFFGPVAQMYVVKDDDEAVKLANDSHYGLGGAVFSQNIERAKRMASRIETGMVYINWLTDTAAELPFGGVKRSGFGRELSDLGIKEFVNQKLVVVRR

SEQ ID NO: 11844 - protein, 745 aa, Glomerella cingulata
METNIRGIHQALSRNNSSSSSSVYEMPTADLTELARKGIIKVTTDSNGRLSYTTEVRLRSRNGEYRWHLIRCVEIDNIDFGNGASSYFGSATDINDHKLLEAKLKEAMESKSRFLSNMSHEIRTPLIGISGMVSFLQDTTLNEEQRDYTNTIQTSANSLLMIINDILDLSKVDAGMMKLKYEWFHTRSLIEDVNELVSTMAIAKRLELNYIVEEDVPAWVKGDKVRIRQVLLNVIGNAIKFTAEGEVFSRCRIFTNTKSALSNDEIMLEFAVIDTGRGFTKEEADLIFKPFSQIDGSSTRQHGGSGLGLVISRQLVELHGGKMEGTAVPGKGSTFTFTAKFALPTSADHPDGPIGPEAFKPVVQAPEEVTVLRPAVKASPAAKATSGASPSTDAEFVSPALASSGSSDPSIRSNISHVTERTSVSSINVGLVHFSEAARASGQDLSEMKLELPLSESSPGTTPTPETSKPAKLEDFRPPMYSILVICPQTHSREATAQHIETTLPKDVPHQITALDSVDKAQSLLGGDESVNFTHIVLNLPSPEEIIGLMERITKSMTISNTTILILSDSVQRQAVMKLATETKYEQLVSENLVTFIYKPVKPSRFAVIFDPDKVRDLSIDRNRSTAQRMVETQKASYQEIEKRMGNKGYKVLLVEDNPVNQKVLKKYLKKVGVEVEVVADGAECTETVFSRSHSYFSLILCDLHMPRKDGYQACREIRQWEKERGFKKLPIIALSANVMSDVSG

SEQ ID NO: 11845 - protein, 314 aa, Coccidioides posadasii
MASRHTTFRLNTGEDIPAIGFGTWQDENAQEDAVLTALSAGYRHIDTAAVYGTEKAIGRALARSRLSRDELFITSKLWNNKHRPEDVEQAIDQSLKNLEIDYLDLYLMHWPAAFAPGDDMFPKDSQGNSKTVDIDYVDTYKAMEKLVKSGKTKAIGISNFSKGEMERLLESCSIVPAVMQMELHPWLQQNDFVEWLKSKGIHVTQYSSLGNQNEVYSGRERYGRLIEDPALAAIGTKYGKTGAQVALAWGITKGHSVLVKSKTPHRIQQNFESDFELKQEDMKAIENIDKKLRFNDSSADFGYNFFVGLEGKEK

SEQ ID NO: 11846 - protein, 796 aa, Zea mays; identical to SEQ ID NO: 6256

SEQ ID NO: 11847 - protein, 450 aa, Nicotiana tabacum
MERVFSMEDDIGDHFWSTPPTADLGVDSPTAAAAVSYSKMMNRSSSEWAFQRFLQEATAAGTSTSSPPQPPTMTASSSSSSHQNDVVEIKDENLSIPNLNPSTALNSKPASSFGLAPPPNIAVDSEEYQAFLKSQLHLACAAVALTRGKSLNPQDSGSTAHDKGSETASAAQSGSHVSTLGSGQEVAKIQDKDAGGPVGIPSLPPVQKKPVVQVRSTTSGSSREQSDDDEAEGEAETTQGMDPADAKRVRRMLSNRESARRSRRRKQAHLTELETQVSQLRVENSSLLKRLTDISQKYNEAAVDNRVLKADVETLRTKVKMAEETVKRVTGLNPLFQAMSEISSMVMPSYSGSPSDTSADAAVPVQDDPKHHYYQQPPNNLMPTHDPRIQNGMVDVPPIENVEQNPATAAVGGNKMGRTTSMQRVASLEHLQKRIRGEVSSCGTQGRGEQ

SEQ ID NO: 11848 - protein, 102 aa, Citrus jambhiri
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFG

SEQ ID NO: 11849 - protein, 513 aa, Marchantia polymorpha
MAKHSLKQPLLDKEDQPPVLPPSSYNGSESQGLAEEPKGEFKTWLVEELTHQFWLAGPMILVNLLQYLLNVVSVMFVGHLGELALASSSIATSLAGVTGYHVMMGLASALETLCGQAFGAKEYRLSGIFLQRAIFVLTLCAFPISFVWWHMGTILKFIGQDPSISDGAMEYARFLIPSLFAYAFLQPLVKFLQTQSAVNSMAVFSGITLLFHAPLCYMLVFYFGIGFRGAAIANSISQWINVIFLALYVRFSPTCKRTWTGFSREALHDIFYFLKLAVPSTVMVCLEYWCFESIVLLSGLLPNPKLETSALAICLNTIALMYMVPFGLSAAVSTRVSNELGAGRPYAAKAAVKLTVSLALLEGCLMSILLISVRGVWPYLYSGDAEVVNYVSKMVPFLATLAILDGFQGTLCGVARGCGWQHLGAYTNLGAFYVIGIPTALLMAFHFHLNGYGLWIGIICGLVTQAFLLAVITLTLNWQKLADEATDRVHHSYVEGDVLPKHGQKVDHSQLTQ

SEQ ID NO: 11850 - protein, 230 aa, Lotus corniculatus
MTVAGYLNIGDFIPPLEWLDLQGVQGKMKKLHNRFDAFFAHIIEEQKVILKSEKHQDLLSTLLSLKEAPEDGDKLNDTEIKALLLNLFTAGTDTSSSTAEWAIAELIKNPRIMGQVQQELDNVVGKDKLVTELDMPNLPYLEAVVKETFRLHPSTPLSLPRAAAKSCEVFDYHIPKGATLLVNVWAISRDPKEWASPLEFRPERFLPGGEKASVDVRGTDFALIPFGAGR

SEQ ID NO: 11851 - protein, 447 aa, Listeria innocua
MMKDMTTGNPTKLIFLFAMPMLIGNLFQQFYTMIDAVIVGKFVSVDALAAVGATNSVNFFMISLIIGLMSGISVVVAQYFGFKDYDRLKDVIATATYAVVFSAVILTIAGVLLAKPLLILLRTPANILDDSTIFLTTLFIGILPMSLYNGMAAILRALGNSITPLIFLILSSLMNIALDFLFVVYMGMGVRGAAIATVLSQTAAAIAVIYYAYRHVSFMRIERAKFKLSTPLLKEMVRIGLPSGLQGSFISIGNMALQSLINGFGSSVVAAYTAASRIDSLTYQPGIAFGAASSMFAGQNIGAGKIDRVREGFWSGIKVVTAISIGITILVQLFARQFLLLFVDSSETEVINIGVSYLLIVSLFYVVVGILFVVRETLRGTGDAMVPLAMGIFELVSRLAIGFILSLYIGYVGLWWATPVAWITATMLGVWRYKSGAWQKKAVIRRK

SEQ ID NO: 11852 - protein, 502 aa, Listeria innocua
MAFYFEEPSRTFSEFLLVPGYSSAECVPTNVSLKTPIVKFKKGEESAITMNIPLVSAIMQAVSDDNMGIALAKEGGVSFVFGSQSIESEAAMVSRVKNHKAGFVISDSNISPDKTLQDILDLKEKTGHSTVAVTEDGTAHGKLLGIVTSRDYRVTRMSPDEKVADFMTPFEKLVTAKKSTTLKEANNIIWDHKLNALPLVDDNEHLVHMVFRKDYDSNKENKLELLDSSKRYVVGAGINTRDYEERVPALVEAGADILCIDSSEGYSEWQKRTLDYVRGKYGDTVKVGAGNVVDRDGFRYLAEAGADFVKVGVGGGSICITREQKGIGRGQATALIDVAKARDEYFEETGVYIPICSDGGIVYDYHMTLALAMGADFIMLGRYFSRFDESPTNKVNLNGTYMKEYWGEGANRARNWQRYDLGGDKKLSFEEGVDSYVPYAGSLKDNVAISLSKVRSTMCNCGALNIPELQQKAKITLVSSTSIVEGGAHDVVVKDASNNLIK

SEQ ID NO: 11853 - protein, 204 aa, Listeria innocua
MPTRLKEDIATIIKNDPATKTFFDAFLTNPGLHALWWHRVANFFYRHKMVLFGKVLSQTARFWTNIEIHPGATIGRRLFIDHGAGIVIGETAEIGDDVTIFHGVTLGGTGKDCGKRHPTVGDRALVSAGAKVLGPVDIGADARIGAGAVVLKDVPPGATVVGIPAKVVRLNGRTVGHAVPKMDELTLRIAELENIVEKLLKEKE

SEQ ID NO: 11854 - protein, 254 aa, Listeria innocua
MTFKGFDKDFNITDKVAVVTGAASGIGKAMAELFSEKGAYVVLLDIKEDVKDVAAQINPSRTLALQVDITKKENIEKVVAEIKKVYPKIDILANSAGVALLEKAEDLPEEYWDKTMELNLKGSFLMAQIIGREMIATGGGKIVNMASQASVIALDKHVAYCASKAAIVSMTQVLAMEWAPYNINVNAISPTVILTELGKKAWAGQVGEDMKKLIPAGRFGYPEEVAACALFLVSDAASLITGENLIIDGGYTIK

SEQ ID NO: 11855 - protein, 319 aa, Listeria innocua
MQKEKAPIGLYFLLIAVMASWGFNVTMTKVLVSYFPTVTMTSFRIFTAAITVIIILFITKKLRLPTKREFGLIFLASIFNIVIHHFFLSNGLKLTTGTNAGLILGSAPIVVAIFSVVFLRERIGAWRALGFLAGIFGVSLVVLSNGTGISGISLGDIDIFIAMASQAFSFIIIKKLAGSMDTGLMTGYMLFLGSVMLFALSRFMEPGGVSELVAVHSWKLWLLFVVSAVVATAFGNFVYNYAVGKIGPSRSAIFMNFNPLFSLIGALLFLGEAIKIPQLVGFVFIIIGVLLGSGALMDLIYERKKTKVRDPEKLLEKEV

SEQ ID NO: 11856 - protein, 492 aa, Listeria innocua
MSTEKEKTFFGHPRGLATLFNTEFWERFSYYGMRAILIYYMYYSVSKGGLGFSQSTATAIMSIYGSLVFMSGVIGGWFADRVLGPRQTIFYGGVLIMVGHLVLAIPSGGAAALFVSMAFIILGTGLLKPNVSSVVGDLYPAGDNRRDAGFSIFYMGINLGAFIAPPIVSNVSDHAGSFHAGFGVAAVGMAIALVVYVLTGKRYLKEAGKKAPNPLQKSEAKILTMKIIGIILAIGLLIAVLTLITGSLTINTIILAVTVMGVGVPLAYFIMMMTSKKTEADERSRLTAYIPLFLIAVLFWMIEEQGSTTLALFAAERTDLSIWGFNLNPANFQSLNPVFVITLSPIFAWIWTKLGDRQPSTPRKFALGLFFAGLSFVVMMLPGILHGNTTTLVSPLWLVLSFFICIFGEMFISPVGLSATTKLAPKAFASQTMSLWFLSDAMGQAFNAQVTQFFNADTEIAYFGITGFVAIGFAIALFIFAPFLKKYMKGVH

SEQ ID NO: 11857 - protein, 253 aa, Listeria innocua
MSAYPKFDVILKALNLSSVGVIITDPEQKNNPIIFVNTGFENITGYTKEEAIGSNCHFLQGDDTDKEEVAKIRHAINEKSTANVLLKNYRKNGTSFMNELTIEPIYDDNDHLYFVGIQKDVTTEHNYQLELEKSLWEIEKLSTPIVPIKENICVLPLIGSLTHDRFQHMSDYVSEYMDNGKEDYLIMDLSGLADFNEDAVMNLVKFHGFMKLTGVELIITGISPKFAMTLMRYQENLSSLTTYSTIKEALQFY

SEQ ID NO: 11858 - protein, 682 aa, Listeria innocua
MEIFLYVLALLVAIFISNLLNRFVPFVSVPLIQIGLGVIIAIMPITFDLQLNPELFLVMFIAPLLFNDGRQTDKAALWGMRMPILVLALGLVFATVVVIGYFVHWMIPTVPLAAAFALAAALAPTDAVAVSSLSGRINLPKRIMNLLEGEALINDASGLVAFQFAIAAMVTGVFSLMDASISFFIIAIGGILVGLVLSWLKFRLLKWVRGLGMEDVTFHMLIQILTPFIIYLAAEELHVSGILAVVAAGIMHSMEQKKMDPQLVKLNVVSQSTWSVIIFVLNGLVFLLLGTQLPAITEVVWNDSGSSNLQVIAYILSITAALILLRFLWVYISWSIGAKQRQKQNKKTQLPKFRPVVLTSLSGVRGAVTLASALAIPFFLDDGSLFPQRSLIIFIASGVILCTLVIATFILPLLAKSEEVTTEDERAEIATRIRILRNVIRELKEQTLPETKAATDEVIEDYRRRIYDLQQNNISNRGMDERERAKRLEIIQWERENTQKMTDEGRIVATDSYRYQHYLNMMEQAIKQRFRTKIKTAWMFLYRLIMLIIHPKKWRRITHKVKKGISKDSERFQAIRQLREENEILIISKLKEQLTKENADIIGPLITEHTIFLERVRKEHSPRGKRAKFEQKKREVQVVAFQLERDIIQNMFEKGGISRELARDLRQNLNMIETYLYDDFLE

SEQ ID NO: 11859 - protein, 274 aa, Listeria innocua
MNLKDTVKLANGVEMPRLGFGVWKVQDGDEAVNSVKWAIEAGYISIDTAAAYKNEEGVGQAIKESGVKREDLFVTTKLWNAEQGYESTLAAFDESLRKLELDYVDLYLIHWPVEGKFKDTWRAFEKLYKDKRVRAIGVCNFHEHHLKELMEDAEIAPMVNQIELHPQLTQEPLRKFCAENNIVVEAWSPLGNGKLLANPEIKAIADAHGKSVAQVILRWDLQIGVVTIPKSVHQERIIQNADIFDFELSDEEVAKISGLNKDERTGPDPDNFNF

SEQ ID NO: 11860 - protein, 488 aa, Listeria innocua
MSIKETSLPKVQTKLFINGKWIDGDNKETKDIVNPANGEVIAKIAQAGPKETKQAIKAAKDAFPDWAKMELADRVKLLHNIADLMEERADTLAKIMTLEQGKPLKESKGEVLTGAENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSADTLKKISLELGGHAPFIVFADANLEAAVDDLITAKFRNNGQVCVSPNRIFVAKEIKEKFTKTLVAKVEKLKVGNGLDDVNVGPLIREDAIDKIDKQLKNATDKGAKVLTGGERLTGSDYDKGNFYKPTVLDNVTREMDIFYEETFGPVIPLIVFENEDEAIEMANDSEFGLASYFYTKDLARVEKVGAALEYGMVGANEIAISNPETPFGGVKHSGFGRENGHYGMEEYIQVKFINLKYRD

SEQ ID NO: 11861 - protein, 572 aa, Listeria innocua
MAKELKGIAASDGIAIAKAYLLVEPDLSYEKTEVTDVESEVKRFESALEVSRTELSTIREKAAKDLGEDKAQIFDAHLLVLNDPELTGPIEESIKNAKTNAETALQETTDMFIGMFESMDNEYMRERAADIKDVRKRVLSHLLGVTIPNPALIDEEVVVVAADLTPSDTAQLNRKFVKGFVTDIGGRTSHSAIMARSLEIPAVVGTKEVTASVAKNDIVIIDGLEGNVIIHPTEEQIAHYEKIKSDFALQQAEWEKLKNEKTVSKDGVHVELAANIGTPNDLEGVISNGGEAVGLYRTEFLYMGRDNFPTEEEQFEAYKAVVSGMDGKSVVVRTLDIGGDKTLPYLELPEEMNPFLGFRAIRLCFANEELFRTQLRALLRASVYGNLKIMFPMIATVNEFRQARDILLDEKAKLKAAGTEVSDSIELGIMIEIPAAAVLADQFAKEVDFFSIGTNDLIQYTMAADRMNERVSYLYQPYNPSILRLVKMVIDASHKEGKWTGMCGEMAGDQTAVPLLLGLGLDEFSMSASSILKSRSLIKRLDQSEMVKLAEEALNKSTAEEVVELVEKYTAE

SEQ ID NO: 11862 - protein, 325 aa, Listeria innocua
MAQKTMIQAITDALAVELEKDENVLVFGEDVGKNGGVFRATEGLQEKFGEDRVFDTPLAESGIGGLAIGLALEGFRPVPEIQFFGFVFEVMDSVAGQMARMRYRTGGTRTAPITIRAPFGGGVHTPEMHADNLEGLMAQSPGLKVVIPSTPYDAKGLLISAIRDNDPVIFLEHMKLYRSFREEVPEGEYTVEIGKAAVRREGTDVSIITYGAMVQESMKAAEALEKDGVSVEVIDLRTISPIDVETIIASVKKTNRAVVVQEAQKQAGIAANIVAEINDHAILSLEAPVMRVAAPDSVFPFSQAETVWLPNHNDIIERVKEVIAF

SEQ ID NO: 11863 - protein, 380 aa, Listeria innocua
MKKIILLGATGSIGTQTLTIIRENPEKFQLVAFSFGRNIERGRAIIQEFKPKMVAVWHTRDRVTLESEFPDVKFFNGLDGLREVATYLDGDVLLNAVMGSVGLLPTLDAIEAGKAIAIANKETLVTAGHLVMQAAKEKNISLLPVDSEHSAILQALNGENRERIEKIILTASGGSFRDKTREQLSEVTVKEALKHPNWNMGNKLTIDSATMFNKGLEVMEAHWLFGVDYDDIEVVIQRESIVHSMVQFVDGSFIAQLGTPDMRMPIQYALTYPDRLSIPYEKEFRITDFSALHFEEVNYERFPALKLAYNAGKIGGTMPTVLNAANEIAVAGFLNGQVAFYNIEALVENAMNRHTSISNPNLDTILQVDQETRAYVKTLL

SEQ ID NO: 11864 - protein, 632 aa, Listeria innocua
MSCFYLDLLKIKDPSFMKQLDIQELEALAADIRAFLITSTSKSGGHIGPNLGVVELTIALHYTFNSPNDKFIWDVGHQSYVHKILTGRASQFDTLRQHGGLDGFPKRKESIHDVFETGHSSTSLSAAVGMVIARDIKKEDFYVIPIIGDGALTGGMAFEALNHIGDMGKDMIVILNDNDMSIAPNVGALHNVLGKLRTSNTFQQTKTNIDKLMRKIPTAGEKLADTAEKAKDGIKHLLVEGTFFEELGFMYLGPIDGHNLEDVITNLEIAKRTKGPVLLHIITKKGKGYQPAELDSRGTWHGTGPYKVETGSFIKPAKTVASWSSVISNELMRLAANDERIVAITPAMPVGSKLEKFAKTFPERFFDVGIAEQHATTMAAGLATQAMKPFLAIYSTFLQRAYDQLVHDVCRQKLNVVIGIDRAGLVGADGETHQGIFDISFLNSIPNMIITMPKDEEEARQLMDTAFAYDDGPFAIRYPRGNGPGKELSESSKLIPIGEWETIIQPVDAVILTFGPTLEQALKAAEQLEDLGQRVGVINARFIKPLDEALLHRIFKQKIPILTVEESLLKGGFGASVLEFMEENNYTDVTIHRIGLPDEFIGHGSVPLILESYGISPTGIVLKINEMLAQSE

SEQ ID NO: 11865 - protein, 327 aa, Listeria innocua
MPVISYIDAITMALKEEMERDDKVFILGEDVGKKGGVFKATAGLYDEFGEDRVLDTPLAESAIAGVGIGAAMYGYRPVAEMQFADFIMPAVNQIISEASRIRYRSNNDWSCPMVIRAPFGGGVHGALYHSQSVEKVFFGQPGLKIVVPSSPYDAKGLLKAAIRDNDPVLFFEHKRAYRLLKGEVPETDYIVPIGEANVVREGDDITVITYGLAVQFAQQAAERLAAEGVEAHILDLRTIYPLDQEAIIEATKKTGKVLLVTEDNKQGSIISEVAAIISEHCLFDLDAPIARLAGPDTPAMPFAPTMEKHFMINPDKVADAMKELAEF

SEQ ID NO: 11866 - protein, 374 aa, Listeria innocua
MSDKTQNTKPVAELNVEQVKEALIEEGKKKGILTYAKIAARLAPFTLDSDQMDEYLEHVGEAGIEVSDDADDEDPDETELVKEETESFDLTDMSVPPGVKINDPVRMYLKEIGRVDLLTADEEIALAKRIEAGDIEAKGRLAEANLRLVVSIAKRYVGRGMLFLDLIQEGNMGLMKAVEKFDFNKGFKFSTYATWWIRQAITRAIADQARTIRIPVHMVETINKLIRVQRSLLQDLGRDPSPEEIGEEMDLPTEKVREILKIAQEPVSLETPIGEEDDSHLGDFIEDQDATSPSDHAAYELLKEQLEDVLDTLTDREENVLRLRFGLDDGRTRTLEEVGRVFGVTRERIRQIEAKALRKLRHPSRSKQLKDFLE

SEQ ID NO: 11867 - protein, 479 aa, Listeria innocua
MKRMKFKYAYQLFFTQFIILLIACIMIGVLVSHSLKDYFYQSQVDDLTSYGETISMDIRHSPQDATIQVLNTYQRILDVKKIHYTIKNADDETIYPTQLNQPLPKDFSISKDDKKKLKSGETVSKKIDNRFNREMTIVYVPIMDGDKFVGSIVLNSPISGTEQVIGTINRYMFYTILLSITIALILSAILSKLQVNRINKLRSATKDVIQGNYKARLKENNFDEIGALAIDFNKMTETLETSQEEIERQEKRRRQFIADVSHEMRTPLTTISGLTEGLVNDIIPKSETDRCIALIDTEAKRLTKLVNENLDYEKIRSNKIKLQKTRFNGREFLELIKEQLDYVATEKGNKITVDIDKDMYIYADYDRLTQVFINIVKNGVQFTENGLITLTGTQDYKESVLTITDTGIGMNTEELEQIWERFYKADMSRTNTAFGESGIGLSIVKQLIEYHDGTISVTSEPNKGTTFTIRLPFFQDNEQ

SEQ ID NO: 11868 - protein, 121 aa, Listeria innocua
MSGLTKIEIITRPNRFHLFQKELAKIGVSGLTVTKALGTGLEKGFIELYRGTKKESNVHERMKIEIVVSTVPVEDVLRVVKETLRTGEPGDGKVFIYPLAEVVKISTGETGIDALQDKPAK

SEQ ID NO: 11869 - protein, 617 aa, Listeria innocua
MNLRKDLSEKVLIADGAMGTLLYSYGVDRSFEELNLSHPEDIVAIHKAYIGAGADIIQTNTYGANYIKLARYGLEDEVKRINQAAIRLAKEAARGTGTYIFGTIGGINGAVDARLPAAPLEEIKRSFREQLYCFLLDGVDAILLETYYDLDELKTVLKILRETTDLPVVANVSMHESGILQNGKKLPDALEELIALGADVVGINCRLGPYHMARALETVPLYDKAYLAVYPNASLPEVQEGKVIYQSDTDYFEHYGEVFRQEGARIIGGCCGTTPDHIRALRKGLESTKPVLEKEVRPILELVPEEVEDEESGERLLDKVKERLTILVELDPPRTFDTSKFFEGAKALDEAGVDAITISDNSLATPRISNMALASILKHEYGIKPLIHLTTRDHNLVGMHSHVMGFHKLGLHDVLAITGDPTKVGDFPGASSVFDLRSVELVQLIKKFNDGISYTGKSLKEKARFHVGAAFNPNVLNLEKAVRLIERKVEYGADYIITQPIYDVNKAVLLKEALQKANIDVPLFIGVMPLLSSRNAEFLHNEVPGIRLTDEVRERMREAEEHGHANEEGMAIARELVDAICEHFQGIYIITPFLRYDLSIELAKYVQNKQQLQIASK

SEQ ID NO: 11870 - protein, 248 aa, Listeria innocua
MNKVALVTGSSRGLGREIAIALAKEGYDIAVNFSRNRKKAEEVQQEIEQLGRKCTIFKANVGDVEKVRALFKAVDEEFGRLDVFINNAASGVLRPIMELEESHWDWTMNINAKALLFAGQEAAKLMQRQKSGKIISLSSIGSIRYLENYTTVGVSKAAVESLTRYLAVELAPFGIAVNAVSGGLIETEALNHFPNREELLKDAVSKTPAGRMIEPNDLVNAVLFLASEKADMIRGQTILVDGGRTLLV

SEQ ID NO: 11871 - protein, 247 aa, Listeria innocua
MTLQGKVAVVTGGSRGIGRDIAIKLAKEGANIFFNYNGSPEAAEETAKLVAEHGVEVEAMKANVAIAEDVDAFFKQAIERFGRIDILVNNAGITRDNLLMRMKEDEWDDVININLKGTFLCTKAVSRTMMKQRAGKIINMASVVGLIGNAGQANYVASKAGVIGLTKTTARELAPRGINVNAVAPGFITTEMTDKLDDKTKEAMLAQIPLGAYGTTEDIANAVLFLASDASKYITGQTLSVDGGMVM

SEQ ID NO: 11872 - protein, 399 aa, Listeria innocua
MQGKNILLAVSGGIAVYKAVALTSKLTQAGANVKVMMTEHAQEFVPPLSFQVLSKNDVYTDTFDEKKSSVVAHIDLADWADLVIVAPATANLIGKMANGIADDMVTTTILATEAPVWVAPAMNVHMIQHPAVIRNINRLYADGVRFIEPEEGYLACGYVGRGRLEEPEKIVLRIAEFFQEDKDLLQGKKVLVTAGATREKLDPVRYFTNHSTGKMGFSIAESAARHGANVTLITTSKTLPVPPGVEAVYVESADEMYQAVLERKAEQHIFVMTAAVADYTPANVSEQKIKKQPGDFTIEMKRTKDILLEIGQNKTADQVVIGFAAETENLETNALKKLTSKNADMIVANNISEAGAGFSGDTNIVTLYRKDGSNEALPLLDKKEVAEHIIEEAANFLRK

SEQ ID NO: 11873 - protein, 456 aa, Listeria innocua
MQQTVTYGAKWKQFLTIFTPIVITQLTLFSMTFFDTTMSGNYSNQALAGVAIGSSFWAPVNAAFSGLLMAITPIIAQLIGAKKEKQVKNTVHNGLYIALFLAFILILINFLVVPTILTHMPVTAEVAHIARHFLNGICIGIPAFFISAILRSFIDSLGLTRVTMLITLCTVPFNIFLNYCFIFGNFGFPEMGGAGSGYATGITYWLVVLVSVILIQTQTRLRKFGIFKGLTALRFSKVKEIIGIGVPNGLTILFETSIFSAVTILMGAFGTETIAAHQSANSVCTLLYAFPLSVASTLTILGGYETGAKRLKDAKQYRHIGMTAAILIGCINGAILFFFRDIIAGFYTNDAELSDLIMHFLVYAILFQFADAVLSPVLGALRGYKDVAITSIIAFISYWLIGLPVGYGLSFTNLGPFGYWIGLSTGLFVAAFILSIRVRKTERKLSLNAKNAEISS

SEQ ID NO: 11874 - protein, 879 aa, Listeria innocua
MRKFVYQFSEGSKEMKNLLGGKGANLAEMTKIGLPVPPGFIISTDACNDYTTSNKHLSEDIFEEVKIHLTELEKQTGKIFGFAENPLLVSVRSGAPFSMPGMMDTVLNLGLNDQAAEGLANLTGDARSAFDSYRRFIQMFGDVVFEIPSYQFEQALARIKKDNNYLLDTELTAANLSELIEIYKLIFSQATGRDFPQDPLEQLRLAIIAVFDSWMNPRAVIYRRLHDIDASFGTAVNIQAMVFGNTGETSGTGITFTRNPSTGEKQVFGEFLLNAQGEDVVAGIRTPEPISALEQRMPLVYNELLKTCELLENHYLDMQDIEFTIEKGKLYVLQTRSGKRTAKAAIQTAVDFVHEGKITREEAIMRVETKQLHQLLHPAFHESALKAGQVIATGLPASPGAATGQIFFEAKEAVAASERGISVILVRNETSPEDIEGMARSSAILTAHGGMTSHAAVVARGMGKCCIAGCAELTINEKEKTIILTTGEQLHEGDFLSLDGSTGNVYLGQIALTEASIGGHFDELMAWADAEKKLKIRVNADTPTDFKKALLFGAEGVGLCRTEHMFFDEKRIPYVRQMILAESLKERESVLTSLKEMQKTDFSELFRIANGRAVNIRLLDPPLHEFLPKTNREIEQLARDMNRTVPQITKRIEELAEANPMLGHRGCRLAITFPEIYRMQAEAIMESAVIVHDEGIDVHPEIMIPLIATKSELSYIKNEIKQAIHAIFEKERVVLPFDIGTMIEIPRACVTADEIAEEAQFFSFGTNDLTQLTYGFSRDDATKFLADYYEKDILPKDPFVTIDKTGVGALVEMAVTRGRMTHANLKMGVCGEHGGDPESIHFFHQLGLSYVSCSPYRVPIARLAAAQAALSENKLVSTI

SEQ ID NO: 11875 - protein, 436 aa, Listeria innocua
MTFERLGTMNVNAEGHLEIGGVDTLKLTEKYGTPLYVYDVALIRDRARGFKKTFEELGVKAQVAYASKAFSAVAIYQLMAEEGLSLDVVSGGELYTAIKANFPPERIHFHGNNKSAEEIHMALDYGIGCFVIDNYYEISLLEDILIERNEKAAVLIRVTPGIEAHTHDYILTGQDDSKFGFGLTNGQAEKAIKQVLHASASFDLIGLHCHIGSQIFETTGFKLAARRIMDKLVEWHGTLGFDSKVLNLGGGFGVRYTAEDEPLEPSEYVRQIMDEVRDVANSNDIAIPEIWIEPGRSLVGEAGTTLYKVGSRKEVPGIRNYIAVDGGMSDNIRPALYDAHYDAVLAANPEKVAEETVAIAGKCCESGDMLIWDLPLPKSDAGEILAVFCTGAYGYAMASNYNRIPRPPVVFVENGMDKLIVARETYENLVQNDLSL

SEQ ID NO: 11876 - protein, 507 aa, Listeria innocua
MKKLTNVFWGASLLVLIAVLFGAFLPEQFETLTTNVQRFLTSNFGWYYLFVVAIIIIFCIFLILSPIGSIRLGKPGEKPGYSNKSWFAMLFSAGMGIGLVFWGAAEPLSHFAVQAPGGEVGSQAAMKDALRYSFFHWGISAWSIYAIVALALAYFKFRKDTPGLISATLYPILGKHAKGPLGQLIDIIAVFATVIGVATTLGLGAQQINGGLTYLFHVPNNFTVQLIIIVIVTVLFLLSAMSGLDKGIQLLSNVNIYVAGVLLILTLILGPTLFIMNNFTNSFGDYLQNIIQMSFQTAPNAPDARKWIDSWTIFYWAWWLSWSPFVGIFIARISRGRTIRQFLLGVIVLPALVSIFWFAVFGGSAIFVDQYKDTALSTLATEQVLFGVFDQFPFGIVLSIVAMILIAVFFITSADSATFVLGMQTTGGSLNPPNSVKVTWGLLQSGIASVLLYAGGLTALQNASIIAAFPFSIVIILMIVSLFVSLTKEQEKLGLYVRPKKSQRSKL

SEQ ID NO: 11877 - protein, 225 aa, Listeria innocua
MNEINPTSERVNTEKRTNKQIIMQKILNWFVFSLLLASIGAAIGSKLSPELYLPLVVLEVALLITAMVVRRSKTINKVVGYPVVLAFAFVTGLTLGPTLTYYFGAGQGAAVLMAFVTATITFTTLAFIGAKMKRDLSFLSSALFAAIIILIIFSFAGVFLPLGSMLTTIISAGGTIIFSLYILYDFNQIMKRDVELADVPMLALNLYLDFLNLFMFLLRLFTGRD

SEQ ID NO: 11878 - protein, 294 aa, Listeria innocua
MTKTLQDRMILPGNETIPYIGLGVFQVTEQEFIAGAVEKAIEVGYRLFDTAAVYNNEAIVGQAILDSAVPREELFISSKVWNGDLGYDETLFAFERTLRNLKLDYLDLYLIHWPVAGKYRDSWRAMERLHDEKLIKSIGVANFKQHHLSDLLVAANEKPVLNQVETHPLLPQNDLRKYLAEQNIAHAAWSPLAKGILMQNPVITEIAKKHQASVDQVILQWHLNRNTIIFPKSITSSRIEENSRLSYFQLDASDMEKIDRLETGKRVGPDPDDLEYFLSSIERERAYLTGGEKE

SEQ ID NO: 11879 - protein, 650 aa, Listeria innocua
MEIFELILLMLSAVFLSNVLSRFLPSIAVPLIQVLLGIILAIPLGDHTMDINPELFLLLFMAPILFNDGARTDKKSLWKNRKAILSLSIGLVFVTVGVLGAFIHYLIPAIPFAAAFALAAALAPTDAVAVGALAEKVRVPHKIMHILEGESLINDASGLVSFQFAVLALVTGTFSFMSAGTSFLLLSLGGIALGVVLSLLKIMLMRGLRQLGIENMTSFMLMEILLPFLIFMVAENIGVNGILAVVSGGMVHSFSYKRINPEMAQLNLLSKNTWSVIIFSLNGLVFVLLGTQLPQIMTAIWEDTGIHKSMLFLYIFGITFLLLALRFLWILFFRNYEENPHADLVSRLKNTFLYTVAGVRGTITLVSALSLPFVLGQGNAFPERDLLIFIAAGVIITTLLLANFTLPLFAAKKDVVVADHTTAIALLRDVVGQLQRYKTDENEVEMNNVLKMYNGRIFSLMEHKEVSATEKELRRLTQEWQLENTRRLVFERKIDTGVGLSLMMRLGKRLYVQTRAQKYRARMRYRQLLSHSIRDFRIVPLSFEERRKERAKLQTENNQFVVQKLNELDKNEFNPEVISLYLMNFERALGSGKHKKETDNEELQTTIDLASQIERETIQHYFEKGTITRKEMKVYRDNLLAIEASFQLEF

SEQ ID NO: 11880 - protein, 464 aa, Listeria innocua
MLYSKENKESYLEPVFGSSAEDRDIPKYTLAKEPLEPRIAYRLVKDELLDEGSARQNLATFCQTYMEDEATKLMSETLEKNAIDKSEYPRTAELENRCVNIIADLWHAPKDQKFMGTSTIGSSEACMLGGMAMKFAWRKRAEKLGLDIYAQKPNLVISSGYQVCWEKFCVYWDIDMRVVPMDKDHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIYNDGSHLPIVCYKLKDDANVKWTLYDLADRLQMRGWQVPAYPLPKNLENIIIQRYVCRADLGFNMAEEFIQDFQASIQELNNAHILFHDTQQSGVHGFTH

SEQ ID NO: 11881 - protein, 467 aa, Listeria innocua
MLYSENDKRKHESYRIPLFGSEEESTSIPKYVLKKEPMEPRIAYQLVKDQLMDEGNARQNLATFCQTYMEKEAEILMAETLEKNAIDKSEYPQTAELENRCVNILADLWNAPKEMSYLGTSTVGSSEACMLGGLAMKFRWRNNAEKRGLDIQAKRPNLIISSGYQVCWEKFCVYWDVDMRVVPMDKEHLSLDVEKVFELVDEYTIGIVGILGITYTGKFDDIALLDEKVEAYNEANEHQLVIHIDGASGAMFTPFVNPELPWDFRLKNVVSINTSGHKYGLVYPGVGWILWKDKEYLPKELIFEVSYLGGSMPTMAINFSRSASQIIGQYYNFLRYGFEGYREIHEKTKKTALYLSKTVEKSGYFEIINDGSNLPIVCYKLKDDLDVEWTLYDLADQLLMKGWQVPAYPLPADLSDTIIQRFVCRADLGYNVAEEFAADFADALHNLEHARVLYHDKERNDSYGFTH

SEQ ID NO: 11882 - protein, 430 aa, Listeria innocua [sequence omitted]

SEQ ID NO: 11883 - protein, 342 aa, Listeria innocua
MLNEQQITRLLYRLQDPVLEASLEETEGILEVQVLGESANIKIALADPAIETDHFVHNIEELLTQFGVNEINIELEYLPAAVIDRIFQARDNILSETSQTKFLAIASGKGGVGKSTVAANLAIALAQQGKKVGLLDADIYGFSIPVLLGTTESPRKENGQIIPVETNGIQMISMDFFVESGEPVIWRGPMLGKMIKMFLEEVRWGKLDYLLIDLPPGTGDVALDIHTLIPKCNEIIVTTPHFAAASVASRAGYMASKNNHNIIGVIENMSYLKLEDGQTLKIFGQGGGEKVAADLETQLLIQLPIEQPDFNGNGYTSAIYSESSEAGKAYKTLAEKIIPYLL

SEQ ID NO: 11884 - protein, 283 aa, Listeria innocua
MKTVKLNNGIEVPILGFGTYQITDAGEAEQAVKEAIAAGYRHIDTAQSYMNEEAVGRGIAASGVDRKELFITTKIWVENVSYKGVMSSFDRSLKRLGLDYIDLLLIHQPYNDVYGAWMAMEELQAQGKIKAIGVSNFGVDRVVDLAAFNDITPQVNQIEINPFQQQSKNIEALRKEGVAVEAWAPFAEGKNDIFTNPILTKIAEKYGKSVAQVILRWLIEQDIIVLAKSVKPERMAQNLAVFDFELSEEDKSAIATLNQGESQFFSHADPEMVKWMASRKINI

SEQ ID NO: 11885 - protein, 280 aa, Listeria innocua
MTLSFSDTYRLNNGIEMPRHGFGVYKLTDEQRMRTALETAVDVGYRLFDTASFYHNEKELGDFFASSGLKRDEFFVTTKMWNTEQGYDETLRAFEKSQKKLQLDQVDLYLVHWPKQDTFFETWRAVEKLYDEGLVRAIGVSNFEAHHLDRLRTSANVLPVVDQLETHPHFPNQLLHRYLEELHIVHQAWSPLGRGGVLQEQILIDLAKKHGKSPAQIVLRWHLQNNISIIPKSETPSRIRENADIYDFELTEADMRQVERLNNGERVSHAPDVMYVRSEI

SEQ ID NO: 11886 - protein, 154 aa, Listeria innocua
MEQDFFMQQALEEAKKAREIGEVPIGAVVVLDGEIIGRAHNLRETTQNAVTHAELLAIEDACKHQNSWRLSGAELYVTLEPCPMCSGAILLSRIDKVYYGAKDPKAGTAGSLMNLLQDDRFNHTCKVEAGLLEAESSAMLKSFFRELRKRKKKE

SEQ ID NO: 11887 - protein, 488 aa, Listeria innocua
MWETKFAKEGLTFDDVLLVPAKSDVLPNDVDLSVEMAPSLKLNVPIWSAGMDTITEAKMAIAIARQGGIGVVHKNMSIEQQAEEIEKVKRSESGVIIDPFYLTPDHQVFAAEHLMGKYRISGVPIVNNEKERKLVGILTNRDLRFISDYSTVIKDVMTKENLVTAPVGTTLKQAEQILQKHRIEKLPLVDEAGILKGLITIKDIEKVIEFPNSAKDKHGRLLAAAAVGITNDTFVRVEKLIEAGVDAIVIDTAHGHSAGVINKISEIRQTFKDVVIVAGNVATAEGARALFEVGVDIVKVGIGPGSICTTRVVAGVGVPQITAIYDCATVAREFGKTIIADGGIKYSGDIVKALAAGGNAVMLGSMLAGTDESPGETEIFQGRQFKTYRGMGSLAAMEHGSKDRYFQADAKKLVPEGIEGRVPYKGSVADIIFQLVGGIRSGMGYTGSPDLRHLREEAAFVRMTGAGLRESHPHDIQITKEAPNYSIS

SEQ ID NO: 11888 - protein, 502 aa, Listeria monocytogenes EGD-e
MAFYFEEPSRTFSEFLLVPGYSSAECVPTNVSLKTPIVKFKKGEESAITMNIPLVSAIMQAVSDDNMGIALATEGGVSFIFGSQSIESEAAMVSRVKNHKAGFVISDSNISPDKTLQDILDLKEKTGHSTVAVTEDGTAHGKLLGIVTSRDYRVTRMSPDEKVADFMTPFEKLVTANKSTTLKEANNIIWDNKLNALPLVDDNEHLVHMVFRKDYDSNKENKLELLDSSKRYVVGAGINTRDYEERVPALVEAGADILCIDSSEGYSEWQKRTLDYVRGKYGDTVKVGAGNVVDRDGFRYLAEAGADFVKVGVGGGSICITREQKGIGRGQATALIDVAKARDEYFEETGVYIPICSDGGIVYDYHMTLALAMGADFIMLGRYFSRFDESPTNKVNLNGTYMKEYWGEGANRARNWQRYDLGGDKKLSFEEGVDSYVPYAGSLKDNVAISLSKVRSTMCNCGALNIPELQQKAKITLVSSTSIVEGGAHDVVVKDASNNLIK

SEQ ID NO: 11889 - protein, 204 aa, Listeria monocytogenes EGD-e
MPTRLKEDIATIIKNDPATKSFFDAFLTNPGLHALWWHRVANFFYRHKMVLFGKVLSQNARFWTNIEIHPGATIGRRLFIDHGAGIVIGETAEIGDDVTIFHGVTLGGTGKDCGKRHPTVGDGALVSAGAKVLGPVEIGAGARIGAGAVVLKDVPPGATVVGIPAKVVRLNGRTVGHAVPKMDELTLRIAELENIVEKLLKEKE

SEQ ID NO: 11890 - protein, 254 aa, Listeria monocytogenes EGD-e
MTFKGFDKDFNITDKVAVVTGAASGIGKAMAELFSEKGAYVVLLDIKEDVKDVAAKINPSRTLALQVDITKKENIEKVVAEIKKVYPKIDILANSAGVALLEKAEDLPEEYWDKTMELNLKGSFLMAQIIGREMIATGGGKIVNMASQASVIALDKHVAYCASKAAIVSMTQVLAMEWAPYNINVNAISPTVILTELGKKAWAGQVGEDMKKLIPAGRFGYPEEVAACALFLVSDAASLITGENLIIDGGYTIK

SEQ ID NO: 11891 - protein, 462 aa, Listeria monocytogenes EGD-e
MFKTNVEQNNVPVFGSFESGQDLPEKRMNKESVDPRIAYQLVKDQLIDEGSARQNLATFCQTYMEPEAEQIMAETMEKNAIDKSEYPQTAKLESSCVNMLADLWNVDESEHYMGTSTVGSSEACMLGGMAMKFRWRSAALKNGLDIHAKKPSLVISSGYQVCWEKFCVYWDIELREVPMSEEHLSINTDIIMDYVDEYTIGIVGILGITYTGKFDDIMTLNDLVEDYNNTHDNEVVIHVDGASGAMFTPFVEPGLEWDFRLPNVVSINTSGHKYGLVYPGVGWILWRDKEYLPEELVFDVSYLGGHMPTMAINFSRSASQIIGQYYNFLRFGYEGYRQIHMRTRDGALQLSQAVAETGLFEIYNDGANLPIVCYKLKDDANVAWTLYDLADRLQMKGWQVPAYPLPKEMGNTIIQRYVCRGDLGQNMVTAFKNDLSESIEELNNAHILYHDVNTSKTHGFTH

SEQ ID NO: 11892 - protein, 319 aa, Listeria monocytogenes EGD-e
MQKEKAPIGLYFLLIAVMASWGFNVTMTKVLVSYFPTVTMTSFRIFTAAITVIIILFITKKLRLPTKQEFGLILLASIFNIVIHHFFLSNGLKLTTGTNAGLILGSAPIVVAIFSVIFLRERIGAWRALGFLAGIFGVSLVVLSNGTGISGISLGDIDIFIAMASQAFSFIIIKKLAGSMDTGLMTGYMLFLGSVMLFGLSRFMEPDGMSELVTVHSWKLWLLFVVSAVVATAFGNFVYNYAVGKIGPSRSAIFMNFNPLFSLIGALLFLGEAIKIPQLVGFGFIIIGVLLGSGALMDLIYERKKTKVRDPEKLLEKEV

SEQ ID NO: 11893 - protein, 492 aa, Listeria monocytogenes EGD-e
MSTNKEKTFFGHPRGLATLFNTEFWERFSYYGMRALLLYYMYTAVADGGLGFSQSTATAIMSIYGSLVFMSGVIGGWFADRVLGARKTIFYGGVLIMVGHIVLALPNGGAAALFGSMAFIILGTGLLKPNVSNVVGDLYPAGDNRRDAGFSIFYMGINLGAFIAPPIVSAVSDNAGSYHAGFGVAAVGMAIALVVYVLTGKRYLKDAGKKAPNPLQRSEAKSLTFKIIGIVLGIGLLIAVLTLITGSLTIDTIILAVTVMGVGVPLAYFIMMMTSKKTEADEKSRLTAYIPLFLIAVLFWMIEEQGSSTLALFAAERTDLSIWGMNLNPANFQSLNPVFVITLSPIFAWIWTKLGDRQPSTPRKFALGLFFAGLSFVVMMLPGILHGNTTTLVSPLWLVLSFFICIFGEMFISPVGLSATTKLAPKAFASQTMSLWFLSDAMGQSFNAQLTQLFNADTEIAYFGITGFVAIAFAIALFIFAPFLKKYMKGVH

SEQ ID NO: 11894 - protein, 253 aa, Listeria monocytogenes EGD-e
MTAYPQFDVILKALNLSSVGVIITDPEQKDNPIIFVNTGFENITGYAKEEALGSNCHFLQGDDTDKEEVAKIRHAINEKSTANVLLKNYRKDGTSFMNELTIEPIYDDHEHLYFVGIQKDVTTEHDYQLELEKSLTEIEKLSTPIVPIKENICVLPLIGSLTHDRFQHMSEYVSEYMDHGKEDYLIMDLSGLAEFNEDAVMNLVKFHGFMKLTGVELIITGISPKFAMTLIRYEENLASLTTYSTIKEALQFY

SEQ ID NO: 11895 - protein, 682 aa, Listeria monocytogenes EGD-e
MEIFLYVLALLVAIFISNLLNRFVPFVSVPLIQIGLGVLIAIMPITFNLQLNPELFLVMFIAPLLFNDGRQTDKAALWGMRMPILVLALGLVFATVVVIGYFVHWMIPTIPLAAAFALAAALAPTDAVAVSSLSGRINLPKRIMNLLEGEALINDASGLVAFQFAIAAMVTGVFSLMDASISFFVIAIGGILVGLILSWLKFRLLKWVRGLGMEDVTFHMLIQILTPFIIYLAAEEIHVSGILAVVAAGIMHSMEQKKMDPQLVKLNVVSQSTWSVIIFVLNGLVFLLLGTQLPAITEVVWNDSGSSNLQVMAYILSITAALILLRFIWVYISWSIGAKQRQKQNKKTQLPKFRPVVLTSLSGVRGAVTLASALAIPFFLDDGSLFPQRSLIIFIASGVILCTLVIATFILPLLAKSEEVTTEDERAEIATRIRILRNVIRELKEQTLPETKAATDEVIEDYRKRIYDLQQNNSSNRGMDERERAKRLEIIQWERENTQKMTDEGRIVATDSYRYQHYLNMMEQAIKQRFRTKVKTAWMFLYRLIMLVIHPKKWGRITHKVKKGISKDSERFQAIRQLREDNEILIISKLKEQLTKENVDIIGPLITEHTIFLERVRKEHSPRGKRAKFEQKKREVQVVAFQLERDIIQNMFEKGGISRELARDLRQNLNMIETYLYDDFLE

SEQ ID NO: 11896 - protein, 274 aa, Listeria monocytogenes EGD-e
MNLKDTVKLANGVEMPRLGFGVWKVQDGDEAVNSVKWAIEAGYISIDTAAAYKNEEGVGQAIKESGIKREDLFVTTKLWNAEQGYESTLAAFDESLRKLELDYVDLYLIHWPVKGKFKDTWRAFEKLYKDKRVRAIGVCNFHEHHLKELMEDAEIAPMVNQIELHPQLTQEPLRKFCAENNIVVEAWSPLGNGKLLSNPEIKAIADAHGKSVAQVILRWDLQIGVVTIPKSVHQERIIQNADIFDFELTEEEVAKISGLNKDERTGPDPDNFNF

SEQ ID NO: 11897 - protein, 488 aa, Listeria monocytogenes EGD-e
MSIKETALPKVQTKLFINGKWTDGDNKETKDIVNPANGDVIAKIAQAGPSETKKAIKAAKDAFPDWAKMELADRVKLLHKIADLMEEKADTLAKIMTLEQGKPLKESKGEVLTGVENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSADTLKKISLELGGHAPFIVFDDANLDAAVNDLVAAKFRNNGQVCVSPNRIFVAKEIKEKFTKALVAKVEQLKVGNGLDDVNVGPLIREDAIDKIDKQLKNATEKGAKVLTGGGRLTGSDYDKGNFYKPTVLDNVTRKMDIFYEETFGPVIPLITFETEDEAIEMANDSEFGLASYFYTKDLARVEKVGAALEYGMVGANEIAISNPETPFGGVKHSGFGRENGHYGMEEYIQVKFINLKYRD

SEQ ID NO: 11898 - protein, 572 aa, Listeria monocytogenes EGD-e
MAKELKGIAASDGIAIAKAYLLVEPDLSYEKTEVTDVESEVKRFESALEVSRTELSMIREKAAKDLGEDKAQIFDAHLLVLNDPELTGPIEESIKNSKTNAETALQETTDMFIGMFESMDNEYMRERAADIKDVRKRVLSHLLGVTIPNPALIDEEVVVVAADLTPSDTAQLNRNFVKGFVTDIGGRTSHSAIMARSLEIPAVVGTKEVTASVAKNDIVIIDGLEGNVIIHPTEEQIAHYEKIKSDFALQQAEWDKLKNEKTVSKDGVHVELAANIGTPNDLEGVISNGGEAVGLYRTEFLYMGRDNFPTEEEQFEAYKAVVSGMDGKSVVVRTLDIGGDKTLPYLELPEEMNPFLGFRAIRLCFANEELFRTQLRALLRASVYGNLKIMFPMIATVNEFRQARDILLDEKAKLKAAGTEVSDSIELGIMIEIPAAAVLADQFAKEVDFFSIGTNDLIQYTMAADRMNERVSYLYQPYNPSILRLVKMVIDASHKEGKWTGMCGEMAGDQTAVPLLLGLGLDEFSMSASSILKSRSLIKRLDQSEMVKLAEEALNKSTAEEVVELVEKYTAE

SEQ ID NO: 11899 - protein, 318 aa, Listeria monocytogenes EGD-e
MNKIANRQVMCEVLMKEATRNDSNLVVLTSDSRGSASLGAFAEKFPERLIETGIAEQNIVGIAAGLAHSGKRAFVASPACFLSMRSIEQVKVDVAYSDTNVKLIGISGGVSYGALGMSHHSLQDIAVTRAIPNLEVILPADRLETEAIFDYLLQSNRPAYVRLGRNAVEDCYAEKPVFQIGKAGTLREGNDVSILATGEMVRVALDASEELKLKGISARVLNFSTIKPFDQEVVKAALTETKLLISIEEHSIYGGLGAAVSEVVSSSPTSIRHLILGIPDEPAIAGTSQEIFDYYGLSATGIVATIMKNLPIIGDERR

SEQ ID NO: 11900 - protein, 325 aa, Listeria monocytogenes EGD-e
MAQKTMIQAITDALAVELEKDENVLVFGEDVGKNGGVFRATEGLQEKFGEDRVFDTPLAESGIGGLAIGLALEGFRPVPEIQFFGFVFEVMDSVAGQMARMRYRTGGTRNAPITIRAPFGGGVHTPEMHADNLEGLMAQSPGLKVVIPSTPYDAKGLLISAIRDNDPVIFLEHMKLYRSFREEVPEGEYTVEIGKAAVRREGTDVSIITYGAMVQESMKAAEALEKDGVSVEVIDLRTISPIDVETIIASVKKTNRAVVVQEAQKQAGIAANIVAEINDHAILSLEAPVMRVAAPDSVFPFSQAETVWLPNHNDIIERVKEVIAF

SEQ ID NO: 11901 - protein, 380 aa, Listeria monocytogenes EGD-e
MKKIILLGATGSIGTQTLAIIRENPEKFQVVALSFGRNMERGRAIIKEFKPKMVAVWHTRDRVTLEAEFPNVKFFNGLEGLREVATYLDGDVLLNAVMGSVGLLPTLDAIEAGKAIAIANKETLVTAGHLVMRAAKEKNISLLPVDSEHSAILQALNGENTERIEKIILTASGGSFRDKTREQLSAVTVKEALKHPNWNMGNKLTIDSATMFNKGLEVMEAHWLFGVDYDDIEVVIQRESIIHSMVQFVDGSFIAQLGTPDMRMPIQYALTYPDRLYIPYEKEFRITDFSALHFEKVDYERFPALKLAYNAGKIGGTMPTVLNAANEIAVAGFLNGQVAFYNIEALVENAMNRHTSISNPDLDTILQVDQETRAYVKTLL

SEQ ID NO: 11902 - protein, 609 aa, Listeria monocytogenes EGD-e
MSCFYLDLLKIKDPSFMKRLDIQELEALAADIRAFLITSTSKSGGHIGPNLGVVELTIALHYSFNSPKDKFIWDVGHQSYVHKILTGRANQFGTLREHGGLDGFPKRKESIHDVFETGHSSTSLSAAAGMVIARDIKKEDFYVIPIIGDGALTGGMALEALNHIGDMGKDMIVILNDNDMSIAPNVGAIHNILGKLRTSDTSKQTKTNVDGAFFEELGFMYLGPIDGHDIEEVITNLELAKRAKGPVLLHIVTKKGKGYQPAELDSRGTWHGTGPYKVETGSFIKPAKRAASWSSVISNELIRLAEMDERIVAITPAMPVGSKLEKFAKAFPERFFDVGIAEQHATTMAAGLATQGMKPFLAIYSTFLQRAYDQLVHDVCRQKLNVVIGIDRAGLVGADGETHQGIFDISFLNSIPNMTISMPKDEVEARQLMDTAFSYNDGPFAIRYPRGEAPGVQVVESNTLIPIGQWETIIQPLDAVILTFGPTIELALKAAEQLEIEGYRVGVINARYIKPLDEALLHKILKQKIPILTVEESLLKGGFGASVLEFIEANNYRDVIMHRIGLPDEFISHGSVSIILESFGISTTGLVLKIKEMLAQSGKLRAKRL

SEQ ID NO: 11903 - protein, 327 aa, Listeria monocytogenes EGD-e
MPVISYIDAITMALKEEMERDDKVFILGEDVGKKGGVFKATAGLYDEFGEDRVLDTPLAESALAGVGIGAAMYGYRPVAEMQFADFIMPAVNQIISEAARIRYRSNNDWSCPMVIRAPFGGGVHGALYHSQSVEKVFFGQPGLKIVVPSSPYDAKGLLKAAIRDNDPVLFFEHKRAYRLLKGEVPETDYIVPIGEANVVREGDDITVITYGLAVQFAQQAAERLAAEGVEAHILDLRTIYPLDQEAIIEATKKTGKVLLVTEDNKQGSIISEVAAIISEHCLFDLDAPIARLAGPDTPAMPFAPTMEKHFMINPDKVADAMKELAEF

SEQ ID NO: 11904 - protein, 374 aa, Listeria monocytogenes EGD-e
MSDKTKNTKPVAELSVEQVKEALIEEGKKKGILTYAKIAARLAPFTLDSDQMDEYLEHVGEAGIEVSDDADDEDPDETELVKEETESFDLTDMSVPPGVKINDPVRMYLKEIGRVDLLTADEEIALAKRIEAGDIEAKGRLAEANLRLVVSIAKRYVGRGMLFLDLIQEGNMGLMKAVEKFDFNKGFKFSTYATWWIRQAITRAIADQARTIRIPVHMVETINKLIRVQRSLLQDLGRDPSPEEIGEEMDLPTEKVREILKIAQEPVSLETPIGEEDDSHLGDFIEDQDATSPSDHAAYELLKEQLEDVLDTLTDREENVLRLRFGLDDGRTRTLEEVGRVFGVTRERIRQIEAKALRKLRHPSRSKQLKDFLE

SEQ ID NO: 11905 - protein, 479 aa, Listeria monocytogenes EGD-e
MKQMKFKYAYQLFFTQFIILLIACIMIGVLVSHSLKDYFYQSQVDDLTSYGQTISRDIRYSPQDATMQVLNTYQRILDVKKIHYTIKNANDETIYPTQMNQPLPKDFSISADDKKKLESGETVSKKIDNRFNKEMTIVYVPIMNGDKFVGSIVLNSPISGTEQVIGTINRYMFYTILLSITVALILSAILSKLQVNRINKLRAATKDVIQGNYNARLKENNFDEIGALAIDFNKMTQTLETSQEEIERQEKRRRQFIADVSHEMRTPLTTISGLTEGLVNDIIPKSETDRCIALIDTEARRLTKLVNENLDYEKIRSNKIKLQKTRFNGKEFLELIKEQLDYVASEKGNTITVAIDKDMAIYADYDRLTQVFINIVKNSVQFTENGQITLTGTQDYKESVLTITDTGIGMNTEELEQIWERFYKADMSRTNTAFGESGIGLSIVKQLIEYHDGSITVTSEPNKGTSFTIRLPFFQDNEQ

SEQ ID NO: 11906 - protein, 121 aa, Listeria monocytogenes EGD-e
MSGLTKIEIITRPNRFHLFQKELAKIGVSGLTVTKALGTGLEKGFIELYRGTKKESNIHERMKIEIVVSTVPVEDVLRVVKETLRTGEPGDGKVFIYPLAEVVKISTGETGIDALQDKPSK

SEQ ID NO: 11907 - protein, 617 aa, Listeria monocytogenes EGD-e
MNLRKDLSEKVLIADGAMGTLLYSYGVDRSFEELNLSHPEDIVAIHKAYIGAGADIIQTNTYGANYIKLARYGLEDEVKRINQAAIRLAKEAARGTGTYIFGTIGGINGAVDARLPAAPLEEIKRSFREQLYCFLLDGVDAILLETYYDLDELKTVLKILRETTDLPVVANVSMHEPGILQNGKKLPDALEELIALGADVVGINCRLGPYHMARALETVPLYDNAYLAVYPNASLPEMQEGKVIYQSDTDYFEHYGEVFRQEGARIIGGCCGTTPDHIRALRKGLETTKPILEKEVRPILELVPEEVEDVDSGERLLDKVKERLTILVELDPPRTFDTTKFFEGAQALDEAGVDAITISDNSLATPRISNMALASILKHEYGIKPLIHLTTRDHNLVGMHSHVMGFHKLGLHDVLAITGDPTKVGDFPGASSVFDLRSVELVQLIKKFNDGISYTGKSLKEKARFHVGAAFNPNVLNLEKAVRLIERKVEYGADYIITQPIYDVNKAILLKEALQKANIDVPLFIGVMPLLSSRNAEFLHNEVPGIRLTDDVRERMREAEEHGHANEEGMAIARELVDAICEHFQGIYIITPFLRYDLSIELAKYAQNKQQVQIGSK

SEQ ID NO: 11908 - protein, 248 aa, Listeria monocytogenes EGD-e
MNKVALVTGSSRGLGREIAIALAKEGYDIAVNFSRNRKKAEEVQQEIEQLGRKCVIFKANVGDVEKVRELFKAVDEEFGRLDIFINNAASGVLRPLMELEESHWDWTMNINAKALLFAGQEAAKLMQRHQSGKIISLSSIGSIRYLENYTTVGVSKAAVESLTRYLAVELAPFGIAVNAVSGGLIETDALNHFPNREELLKDAVSKTPAGRMIEPNDLVNAVLFLASEKADMIRGQTILVDGGRTLLV

SEQ ID NO: 11909 - protein, 247 aa, Listeria monocytogenes EGD-e
MTLQGKVAVVTGGSRGIGRDIAINLAKEGANIFFNYNGSPEAAEETAKLVAEHGVEVEAMKANVAIAEDVDAFFKQAIERFGRVDILVNNAGITRDNLLMRMKEDEWDDVININLKGTFLCTKAVSRTMMKQRAGKIINMASVVGLIGNAGQANYVASKAGVIGLTKTTARELAPRGINVNAVAPGFITTDMTDKLDEKTKEAMLAQIPLGAYGTTEDIANAVLFLASDASKYITGQTLSVDGGMVM

SEQ ID NO: 11910 - protein, 399 aa, Listeria monocytogenes EGD-e
MQGKNILLAVSGGIAVYKAVALTSKLTQAGANVKVMMTAHAQEFVPPLSFQVLSKNDVYTDTFDEKKSSVVAHIDLADWADLVIVAPATANVIGKMANGIADDMVTTTILATEAPVWVAPAMNVHMIQHPAVIRNINRLYADGVRFIEPEEGYLACGYVGRGRLEEPEKIVLRIAEFFQEDKNLLQGKNVLVTAGATREKLDPVRYFTNHSTGKMGFSIAESAARHGANVTLITTSKALPVPHGVEAIYVESAEEMHQAVNERKVSQDIFVMTAAVADYTPAQVSDQKIKKQPGDFTIAMKRTKDILLEIGQHKTSEQVVIGFAAETENVEANARKKLTSKNADMIVANNISEAGAGFSGDTNIVTFYRKDGSSEALPILDKKEVAEHIIKEAANFLRK

SEQ ID NO: 11911 - protein, 456 aa, Listeria monocytogenes EGD-e
MQQTVTYGAKWKQFLTIFTPIVITQLTLFSMTFFDTTMSGNYSNQALAGVAIGSSFWAPVNAAFSGLLMAITPIIAQLIGAKKEKQVKNTVHNGLYIALFLAFILILINFLVVPMILTHMPVTAEVADIARHFLNGICIGIPAFFISAILRSFIDSLGLTRVTMLITLCTVPFNIFLNYCFIFGNFGFPEMGGAGSGYATGITYWLVVLVSVILIQTQTRLRKFGVFKGLTALRFSKIKEIIGIGVPNGLTILFETSIFSAVTILMGAFGTETIAAHQSANSVCTLLYAFPLSVASTLTILGGYETGAKRLKDAKQYRHIGMAAAILIGCVNGAILFFFRDIIAGFYTNDPALSNLIMHFLVYAILFQFADAVLSPVLGALRGYKDVTVTSIVAFISYWLIGLPVGYGLSFTNLGPFGYWIGLSTGLFVAAFILSIRVRKTEQKLSFNTKDAEISN

SEQ ID NO: 11912 - protein, 879 aa, Listeria monocytogenes EGD-e
MRKFVYQFSEGSKEMKNLLGGKGANLAEMTNIGLPVPPGFIISTDACNDYTANNKHLSEAIFDEVKIHLAELEKQTGKIFGFAENPLLVSVRSGAPFSMPGMMDTVLNLGLNDQAAEGLANLTGDARSAYDSYRRFIQMFGDVVFEIPSYHFEQALSRIKKANDYRLDTELTATDLSELIDAYKLIFSQATGTDFPQDPLEQLRLAIIAVFDSWMNPRAVIYRRLHDIDASFGTAVNIQAMVFGNTGETSGTGITFTRNPSTGEKKVFGEFLLNAQGEDVVAGIRTPEPISALEERMPTVYKELLHTCELLENHYLDMQDIEFTIEKGKLYVLQTRSGKRTAKAAIQTAVDFVQEGKITRQEAIMRVETKQLHQLLHPTFDESALKNGQVIATGLPASPGAATGQIFFAAKEAVQATERGIPVILVRNETSPEDIEGMARSNAILTAHGGMTSHAAVVARGMGKCCIAGCAELTINEKEKTIILPTGDTLHEGDALSLDGSSGKVYLGEIALREAQIGGHFDELMAWADTEKRLMIRVNADTPPDFKKALLFGAEGIGLCRTEHMFFDEKRIHYVRQMILAESLSERESVLTTLKEMQKADFSELFRIADGRAVNIRLLDPPLHEFLPKTKQEIEQLASAMNRTVPQITKRINELSEANPMLGHRGCRLAITFPEIYRMQTEAIIESAVTLHDEGIDVHPEIMIPLIATKSELSYIKKEMKHAIHTIFDRERVMLPYDIGTMIEIPRACVTADEIAEEAEFFSFGTNDLTQLTYGFSRDDATKFLADYYEKDILSKDPFVSIDKNGVGALVEMAVTRGRMTSEHLKMGVCGEHGGDPESIQFFHQLGLTYVSCSPYRVPIARLAAAQAALAEKHLIPTI

SEQ ID NO: 11913 - protein, 436 aa, Listeria monocytogenes EGD-e
MTFERLGTMNVNAEGHLEIGGVDTLKLADKYGTPLYVYDVALIRDRARGFKKTFEELGVKAQVAYASKAFSAVAIYQLMAEEGLSLDVVSGGELFTAIKANFPPERIHFHGNNKSAEEIHMALDYGIGCFVIDNYYEISLLEDILIERNEKASVLIRVTPGIEAHTHDYILTGQDDSKFGFGLTNGQAEKAIKQVLHASASFDLIGLHCHIGSQIFETTGFKLAARRIMDKLVEWHQTLGFDSKVLNLGGGFGVRYTAEDEPLEPSEYVRQIMDEVRDVAESNDIDIPEIWIEPGRSLVGEAGTTLYKVGSRKEVPGIRNYIAVDGGMSDNIRPALYDAHYDAVLAANPEKVAEETVAIAGKCCESGDMLIWDLPLPKSNAGEVLAVFCTGAYGYAMASNYNRIPRPPVVFVENGVDKLIVARETYENLVQNDLSL

SEQ ID NO: 11914 - protein, 507 aa, Listeria monocytogenes EGD-e
MKKLTNVFWGSGFLVLLAVLFGAFLPEQFETFTNHIQKFLTSNFGWYYLIVVAIIIIFCLFLVLSPIGSIRLGKPGEEPGYSNKSWFAMLFSAGMGIGLVFWGAAEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWIDSWTIFYWAWWLSWSPFVGIFIARISRGRTIRQFLLGVIVLPALVSVFWFAVFGGSAIFVEQHGNSGLSSLATEQVLFGVFNEFPGGMMLSIVAMILIAVFFITSADSATFVLGMQTTGGSLNPPNSVKVTWGLLQAGIASVLLYAGGLTALQNASIIAAFPFSIVIILMIVSLFVSLTREQEKLGLYVRPKKSQRSQL

SEQ ID NO: 11915 - protein, 225 aa, Listeria monocytogenes EGD-e
MNEINHTSERVNTEKRTEKQIIMQKILNWFVFSLLLASIGAAIGSKLSPELYLPLVVLEVALLITAMVVRRSKTINKVVGYPVVLAFAFVTGLTLGPTLTYYFGAGQGAAVLMAFVTATVTFTTLAFIGAKMKKDLSFLSSALFAAIIILVIFSFVGVFLPLGSMLSTIISAGGTIIFSLYILYDFNQIMKRDVELADVPMLALNLYLDFLNLFMFLLRLFTGRD

SEQ ID NO: 11916 - protein, 294 aa, Listeria monocytogenes EGD-e
MTKTLQDRMILPGNGTIPYIGLGVFQVTEQEFIAGAVEKAIEVGYRLFDTAAVYNNEAIVGQAIASSAVSREELFISSKVWNGDLGYDETLFAFERTLRNLKLDYLDLYLIHWPVAGKYRDSWRAMERLHDEKLIKSIGVANFKQHHLSDLLVAANEKPVLNQVETHPLLPQNDLRKYLVEQNIAHAAWSPLAKGILMQNPVITEIAKKHQASVDQVILQWHLNRNTIIFPKSITSSRIEENSRLSYFQLDASDMEKIDRLETGKRVGPDPDDLEYFLSSIERERAYLASENEE

SEQ ID NO: 11917 - protein, 650 aa, Listeria monocytogenes EGD-e
MEIFELILLMLSAVFLSNVLSRFLPSIAVPLIQVVLGIILAIPLGDHTMDLNPELFLLLFMAPILFNDGASTDKKSLWKNRKAILSLSIGLVFVTVGVLGAFIHYLIPAIPFAAAFALAAALAPTDAVAVGALAEKVRVPHKIMHILEGESLINDASGLVSFQFAVLALVTGTFSFMSAGTSFLLLSLGGIALGAILSLLKIMLMRGLRQLGIENMTSFMLMEILLPFLIFMVAEKVGVNGILAVVSGGMVHSFSYKGLNPEIAQLNLLSKNTWSVIIFSLNGLVFILLGTQLPQILMTIWQDANIQKGMLFVYIIGITFLLLGLRFLWILFFRNYEENPKVDLVSRLKNTFLYTVAGVRGTITLVSALSLPFVLGNGNAFPERDLLIFIAAGVIITTLLLANFTLPLFADKKDKVTADHTTDIVLLRDIVQQLQAYKTDENAVEMNKVLNMYNNRIFSLMEHKEVNATEKELRRLTQEWQLENTRRLVFERKIDTGVGLSHMMRLGKRLYVQTRAEKYRARMRYRQLLSHRFRDFRFVPLTFEERRKEIAKLQNENNLFVMQKLQDLDSNEYNPEIISLYLMNFERALGRGKNKKESNDEALQTTIDLASQIERETIQRYFEKGTITRKEMKVYRDNLLAIEANMQLEF

SEQ ID NO: 11918 - protein, 464 aa, Listeria monocytogenes EGD-e
MLYSKENKESYLEPVFGSSAEDRDIPKYTLGKEPLEPRIAYRLVKDELLDEGSARQNLATFCQTYMEDEATKLMSETLEKNAIDKSEYPRTAELENRCVNIIADLWHAPKDQKFMGTSTIGSSEACMLGGMAMKFAWRKRAEKLGLDIYAKKPNLVISSGYQVCWEKFCVYWDIDMRVVPMDKEHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIFNDGSHLPIVCYKLKDDANVNWTLYDLADRLQMRGWQVPAYPLPKSLENIIIQRYVCRADLGFNMAEEFIQDFQASIQELNNAHILFHDTQQSGVHGFTH

SEQ ID NO: 11919 - protein, 467 aa, Listeria monocytogenes EGD-e
MLYSEDDKRKQESYRIPLFGSEEESTSIPKYVLKKEPMEPRIAYQLVKDQLMDEGNARQNLATFCQTYMEKEAEILMAETLEKNAIDKSEYPQTAELENRCVNILADLWNAPKDMSYLGTSTVGSSEACMLGGLAMKFRWRNNAEKRGLDIQAKRPNLIISSGYQVCWEKFCVYWDVDMRVVPMDKNHLSLDVDKVFDLVDEYTIGVVGILGITYTGKFDDIQLLDEKVEAYNETNEHQLVIHIDGASGAMFTPFVNPELPWDFRLKNVVSINTSGHKYGLVYPGVGWILWKDKEYLPKELIFEVSYLGGSMPTMAINFSRSASQIIGQYYNFLRYGFEGYREIHEKTKKTAIYLAKTVEKSGYFEIINDGANLPIVCYKMKEGLDVEWTLYDLADQLLMKGWQVPAYPLPADLSDTIIQRFVCRADLGYNVAEEFAADFADAIHNLEHARVLYHDKERNDSYGFTH

SEQ ID NO: 11920 - protein, 342 aa, Listeria monocytogenes EGD-e
MLNEQQITRLLYRLQDPVLEASLEETEGVLEVQVLEETANIKIALADPAVETDHFVHNIEELLTQFGVNEINIELEYLPAAVIDRIFQARDNILSEASETKFLAIASGKGGVGKSTVSANLAIALAQQGKKVGLLDADIYGFSIPVLLGTTESPHKENGQIIPVETHGIQMISMDFFVEQGEPVIWRGPMLGKMIKMFLEEVRWGKLDYLLIDLPPGTGDVALDIHTLIPKCNELIVTTPHYAAASVASRAGYMAAKNNHKIIGVIENMSYLTLADGQVLKVFGQGGGEKVAADLETQLLIQLPIEQPEPNGNGYVSALFNSSSTSGKAYKTLAEKIIPYLS

SEQ ID NO: 11921 - protein, 283 aa, Listeria monocytogenes EGD-e
MKTVKLNNGVEVPILGFGTYQITDAAEAEHAVKDAIKAGYRHIDTAQSYMNEEAVGRGIAASGVDRKELFITTKIWVENVSYKGVMSSFDRSLKRLGLDYVDLLLIHQPFNDVYGAWIAMEELQASGKIRAIGVSNFSPDRVIDLAAFNEVTPQVNQIEVNPFQQQTANLAILRKEGVAIEAWAPFAEGKNDIFNNPVLTKIGAKYGKSAAQVILRWLVEQDIIVLAKSVKPERMAQNLAIFDFELTEADKEEIAGLDQGESQFFSHADPEMVKWMASRKLNV

SEQ ID NO: 11922 - protein, 280 aa, Listeria monocytogenes EGD-e
MTLSFSDTYRLNNGIEMPRHGFGVYKLTDEARMRTALETAVDVGYRLFDTASFYHNEKELGDFFASSGLKRDEFFVTTKMWNTEQGYDETLRAFEKSQKKLQLDQIDLYLVHWPKQDTFFDTWRAVEKLYDEGLVRAIGVSNFEAHHLDRLRTSANVLPVVDQLETHPHFPNHLLHRYLEELHIVHQAWSPLGRGGVLQEQILIDLAEKHGKSPAQIVLRWHLQNNISIIPKSETPSRIRENAAIYDFELSEADMRQVERLNTGERVSHAPDVMYVRSEI

SEQ ID NO: 11923 - protein, 156 aa, Listeria monocytogenes EGD-e
MERAFFMQQALEEAEKARDIGEVPIGAVVVLDGEIIGRAHNLRETSQNAVTHAELLAIQDACKHQNSWRLSGAELYVTLEPCPMCSGAILLSRIEKVYYGAKDPKAGTAGSLMNLLQDDRFNHTCEVEAGLMESESSEMLKSFFQELRKRNKSNRS

SEQ ID NO: 11924 - protein, 504 aa, Plasmodium falciparum 3D7
MTKSSKDICSENEGKKNGKSGFFSTSFKYVLSACIASFIFGYQVSVLNTIKNFIVVEFEWCKGEKDRLNCSNNTIQSSFLLASVFIGAVLGCGFSGYLVQFGRRLSLLIIYNFFFLVSILTSITHHFHTILFARLLSGFGIGLVTVSVPMYISEMTHKDKKGAYGVMHQLFITFGIFVAVMLGLAMGEGPKADSTEPLTSFAKLWWRLMFLFPSVISLIGILALVVFFKEETPYFLFEKGRIEESKNILKKIYETDNVDEPLNAIKEAVEQNESAKKNSLSLLSALKIPSYRYVIILGCLLSGLQQFTGINVLVSNSNELYKEFLDSHLITILSVVMTAVNFLMTFPAIYIVEKLGRKTLLLWGCVGVLVAYLPTAIANEINRNSNFVKILSIVATFVMIISFAVSYGPVLWIYLHEMFPSEIKDSAASLASLVNWVCAIIVVFPSDIIIKKSPSILFIVFSVMSILTFFFIFFFIKETKGGEIGTSPYITMEERQKHMTKSVV

SEQ ID NO: 11925 - protein, 524 aa, Plasmodium falciparum 3D7
MGCSQSSNVKDFKTRRSKFTNGNNYGKSGNNKNSEDLAINPGMYVRKKEGKIGESYFKVRKLGSGAYGEVLLCREKHGHGEKAIKVIKKSQFDKMKYSITNKIECDDKIHEEIYNEISLLKSLDHPNIIKLFDVFEDKKYFYLVTEFYEGGELFEQIINRHKFDECDAANIMKQILSGICYLHKHNIVHRDIKPENILLENKHSLLNIKIVDFGLSSFFSKDNKLRDRLGTAYYIAPEVLRKKYNEKCDVWSCGVILYILLCGYPPFGGQNDQDIIKKVEKGKYYFDFNDWKNISEEAKELIKLMLTYDYNKRITAKEALNSKWIKKYANNINKSDQKTLCGALSNMRKFEGSQKLAQAAILFIGSKLTTLEERKELTDIFKKLDKNGDGQLDKKELIEGYNILRSFKNELGELKNVEEEVDNILKEVDFDKNGYIEYSEFISVCMDKQILFSEERLRDAFNLFDTDKSGKITKEELANLFGLTSISEQMWNEVLGEADKNKDNMIDFDEFVNMMHKICDNKSS

SEQ ID NO: 11926 - protein, 600 aa, Plasmodium falciparum 3D7
MKDVCVTTDLNNKFIKDEEKENVLLKRSLLLSKNMYLGNDILTPYNYNLLAYDQNINKRITILDEDNDDDNVINKELKEISTLALSDGNNRKTHEELYKENELKNRRRNIRENVLKKLTCIKMNINMRELDEYSCVKKLYIKKCENNDIQKENDINKKNKKKHKKKKKQSIISSIINDDETYRNDNNYNNYYNIIDNLNYNIHEEKNNNNNNNVNTENSLLPYTNDGKINNTNNLNNFGPIIKKSDDNILSSDVLKHIKTLDIHKKIKKPKWHFPYKLYRVILGHSGWVNCVDVDISNEWFATGSNDRLIKIWDLASCKLKLTLTGHINSIRDIKISKKNPYLFSCGEDNRVKCWDLEYNKVIRDYHGHLSGVYCLSLHPSLDLLMSGGRDAVVRVWDIRTKSSVFVLSGHTGTVMSICSQSVEPQVVSGSQDKMIRLWDLNNGKCRISLTHHKKSIRSLSIHPFEYSFCSCGTDNVKVWCGADAEFDRNITGFNSIINCSLIKQDPYFNDSSILILGSNNGQLHFYDWSSGYKYDTLSNKVVPGTVECENSTLSMAFDKSESRLITTHGDKSIKIWKENEDATPENFPIKWNPYENFKF

SEQ ID NO: 11927 - protein, 532 aa, Plasmodium falciparum 3D7
MSIICTISGQTPEEPVISKTGYIFEKRLIEKHIINYGICPVSGEVLTLEDLYPIKNEKIVKPRPITASSIPGLLSIFQTEWDSIISEMFSLRTHVNDIRNELSHSLYQYDAATRVIAKLLKEKNGYKEEIENLKKQIFQLKSSNDLDIYEIGLNEELLEKMQNVAKDLLINRKKRKIDNVCSVEQWKDFKNTNEFNIHSSTIPGVTCITLDVNKYKYNYNDDHMKHNFFSGGNDGNVYYVSLNDNKILSKLQGHLKKVNSIISHPSNFICITASNDKTIRIWKGDDNNVHHNDNGDSDSDNNNNNNDNDGSHLNNNEYIYDNYQFVSAHVITKHKDHVTSLALHPLENYFISSSKDSMWILHDLETAKTIKTSKDNPSSFKHLAIHPDGMMFGIAAQDSNIHIYDIKSQEYKATLNGHTKSLNCLSFSENGYYLASSSKDNTVKLWDLRKAQSFQTITLNETPNFISFDYSGKYLSIAVENDIQIYNFETKNQANLIKTLSSHTDIVTQTCFGSTTSYILSSSMDKTIKLWN

SEQ ID NO: 11928 - protein, 836 aa, Plasmodium falciparum 3D7
MSDNIENPRDDNENEDRNNIFLYNNEISNEGSDSCNVLCLFLFFLSLFFIMIISADNNTAHTFSSPTNNNNNNNNNNTDNNDNSNNSNNSNINNKKNYINNNNNHSNYNNYFDDDPSIKYRKNNNIYKDNINDEFLKKEDNDNIMNNMLDNILIQCLHFKGAYKIRNKNNNNMSDGIFEAKLVTLKLALNNVTKSYIFFYFNPYDNNNTNHNIYILNDIPKQYKYLGFNGININKENRYIFNGQGYNISTFCQLKNNVKKKNEAYKYAHTNIYNNNDNNNNNNNNINGVNENCLCNYTININQYINKYESVSLREVDESYLYSLKGYILDEQEYYKNYLQNEYIKLYKNYISYIQKYYHTHYIEKENMIHFHSLGNVNEEIIKHQSKLESAKQNDKELSYVTLKKVKHESGTIPNHNTEREYTSNVDNNDGNNKNNDGNNKNNDENNNNSDGNNNNNDGNNKYNDVNNKYNDVNNKNNDVNNKYNDGHNKNNNEHVTNAHYDGYIYSNNCNLLISFEGIDIDKKYISTKVLNFSILFNIKSIIEISLFWSQIGTSGSIPGASRISLISICLNSLIDIFESLLLLYEVLLSKLLLIHFILMILLKFLLFTIMEVRYVLIVWKANHQHEVNEGWEHMQRKLSKLYKYYYGSIFLLILLFYYVFPFFPYILLILYLCWLPQILLDIWRGQRNSVDIKFVFILSLCRLYLPIYIYLYPHNIFQLDNFSQLIDTSNTMFSILIIFIVFIQCIYMLLQRIYGPRYFVNIDLLPHVHNYYKTIDVNFEAGIPECVICMYDIVLKPNKYCVTPCYHIFHEKCLQQWMDIKLECPTCRGPLPNFS

SEQ ID NO: 11929 - protein, 304 aa, Plasmodium falciparum 3D7
MSNVLEECIKLYKDLICCYNNISEKELIEGTNDDLDNLLNLNEDISISTACDINKCKEILGKLKLLIIHLSSVNPLICIGQKDIRELLIVRGILEKGVIISIRNKDIKSFNIYIAQLFIYYFDYKDILPKSKKQNAIVGLYLLYLLASNSIGDFHMTLEILPLEDHNDIYIKYVLNVEQNIMDGFFHHVLTKKENIPLYLYESFMDKLYTTIRFKLIDCIFASTNSIHLLYACELLKLSNQQNLNDFIIQYNEAKNNQGEYNAVCEIKDNHIVCKNQTIAVQQLPSLEIINNSIGYATELERIV

SEQ ID NO: 11930 - protein, 107 aa, Plasmodium falciparum 3D7
MADNITNDKRDIFKIHKWSAVAAWSWDISVDNCAICRNHIMDLCIECQAKTTDHENDKDKKIDKEGCTVAWGVCNHAFHLHCISRWIKARQVCPLDNTTWEFQKATD

SEQ ID NO: 11931 - protein, 158 aa, Plasmodium falciparum 3D7
MEVPGKVIGGKVGGKVGGKVLGLGKGGKGKTGSGKTKKAPLSRASRAGLQFPVGRVHRMLKSRISSDGRVGSTAAVYAAAILEYLTAEVLELAGNATKDLKVKRITPRHLQLAIRGDEELDTLIKATIAGGGVIPHIHKALMNKVPLPPTAQKKPKKN

SEQ ID NO: 11932 - protein, 509 aa, Hordeum vulgare subsp. vulgare
MEVESSSHGAGDEAASKFSLPVDSEHKAKSIRLFSFANPHMRTFHLSWISFFTCFVSTFAAAPLVPIIRDNLNLAKADIGNAGVASVSGSIFSRLAMGAICDLLGPRYGCAFLVMLAAPTVFCMSLIDDAAGYITVRFLIGFSLATFVSCQYWMSTMFNSKIIGTVNGLAAGWGNMGGGATQLIMPLVFHAIQKCGATPFVAWRIAYFVPGMMHVVMGLLVLTMGQDLPDGNLASLQKKGEMAKDKFSKVVWGAVTNYRTWIFVLLYGYCMGVELTTDNVIAEYYFDHFHLDLRTSGTIAACFGMANIVARPAGGYLSDLGARYFGMRARLWNIWILQTAGGAFCLWLGRAKALPESITAMVLFSICAQAACGAVFGVIPFVSRRSLGIISGLSGAGGNFGAGLTQLLFFTSSKYGTGRGLEYMGIMIMACTLPVALVHFPQWGSMLLPPNANATEEEFYAAEWSEEEKKKGLHIPGQKFAENSRSERGRRNVILATAATPPNNTPQHA

SEQ ID NO: 11933 - protein, 252 aa, Lolium perenne
ALFAVFLGSAHGIAKVPPGPNITAEYGDKWLDAKSTWYGKPTGAGPKDNGGACGYKDVDKAPFNGMTGCGNTPIFKDGRGCGSCFEIKCTKPESCSGEAVTVTITDDNEEPIAPYHFDLSGHAFGSMAKKGEEQNVRSAGELELQFRRVKCKYPDDTKPTFHVEKGSNPNYLAILVKYVDGDGDVVAVDIKEKGKDKWIELKESWGAVWRIDTPDKLTGPFTVRYTTEGGTKSEVEDVIPEGWKADTSYSAK

SEQ ID NO: 11934 - protein, 94 aa, Lupinus luteus
ASAHAGKVFKLVYEAAIQLQVTGVVVTDATLKNLGSVHVSKGVADAHFPVVKEAILKTIKEVVGAKWSEELNSAWTIAYDELAIVIKKEMNDAA

SEQ ID NO: 11935 - protein, 379 aa, Zea mays
MATAGKVIKCKAAVAWEAGKPLSIEEVEVAPPQAMEVRVKILFTSLCHTDVDFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 11936 - protein, 252 aa, Antirrhinum majus
MGRGRVQLKRIENKISRQVTFSKRRSGLLKKAHEISVLCDAEVALIVFSTKGKLFEYSTESSMERILERYERYSYAEKKLTSDSHEPEENWCLEYPKLVARIELLERNIRNYVGEDLDHLSMRELQSLEQQLDTALKRTRTRKNQLMHESISQLQKKERSLQDQNNILAKKIKDNEKQQNEKQQDVHEGFAQSSSSINMLLQPPATQLHAVPCLPISGGFQQTVRVEEGGDRTRIADSRSHIPPWLLQHVNQ

SEQ ID NO: 11937 - protein, 90 aa, Vernonia galamensis
REQDRFMPIANVIRIMRKILPPHAKISDDAKETIQECVSEYISFVTGEANDRCQREQRKTITAEDVLWAMSKLGFDDYIEPLTVYLHRYR

SEQ ID NO: 11938 - protein, 90 aa, Argemone mexicana
  unsure (1)..(90): unsure at all Xaa locations
REQDRYMPIANVIRIMRKVLPTHAKISDDAKETIQECVSEYISFITSEANDRCQREQRKTITAEDVLWAMSKLGXDEYIEPLTLYLQRYR

SEQ ID NO: 11939 - protein, 378 aa, Arabidopsis thaliana
LVYCTGRSFSSYSSLRKKRPLLTPDIAVTSVGSEIVYGGGESTVSDVVWTARLDYKWNRDIVVEETLKFPKLEPQPDKSQEEHKVSFFVGREDAVEIMKVLPGILEERGVDVKLVYSNGYAFDVLPRGAGKQGALTYLLDKLDIEGKQPSNTLVCGDSGNDAELFNISDVYGVMVSNSHEELLQWYEENAKDNPKIFHASERCGAGMIEAIQRFNLGPNVSPRDVMDTENFHGESLNPAHEVVQFYLFYERWRCGEVEKSDKYLQNLKSLSSPLGIFVHPSGVEKPIHEWIDEMENLYGDGKEKKFRIWLDNVTSSHISSDTWLAKFVKHELSEGKVRSCSTKVLLSYKEEKQRLTWMHIHQSWLDESSSDDQEKWIF

SEQ ID NO: 11940 - protein, 733 aa, Rhodobacter sphaeroides
MSLALIDPSDPPERQRDKLLEIVRALMARVERTTDDGGAAYAQFQRAAMLEDQVRERTADLQRTLELLNLSNERLAEATRAAEEARQNLANAIETVQEGFALFDADDVLVLCNLRFGMHMLDIQEHLRPGLSFGGYIDRVSRSRYLALPEAETPEDWAVRRKRRHYDRHSIFNVRLIWDRWLQVSEHRTADGGTVILQTDVTDLIRIERLERGKMLDDQARVIRATLDHINQGVCIFDAEGRLVGWNQRLGSLLAIPMNRFRLGVSFGYLLERFAHEISFGEGMDAAHLEAWVQARHERAPLSFELRRHDELILDVFAQEMPDRGFVMSFTDVTAERAAIEALSRANETLEARVMERTLELEDALGHAERANASRSRFVAAASHDLLQPLSAAKLFIATIGDEAVAPESREALTKAQKALDSVEGILGALLDISKLESGRAAVSIQPVRLDRLMEELSDEFAPIAAARGLRLTVLPSSAVVASDPTYLRRILQNLIGNAIRYTAKGRVLVGARMTAGMVRLEVWDTGPGIAEADQEAIFKEFHRLDAPASPAEGMGLGLAIVERACGLLGHPLGLRSEIGRGTCFMLQVPRAESAPAPSVPDASAVRAQAKVAVQDKIAFLVENDDDLRQAMGLLLEKWGVSVLDAPSGEEALALIEEIGILPDFFLVDQQLGAGMTGVEFIRTMRDRHGPVPACIVTAARRPEVAALCAETGIRLIQKPIDARVLEEFLRAL

SEQ ID NO: 11941 - protein, 602 aa, Nicotiana tabacum
MGACTSKPSNFSVDDITVAGDGAIFPVKSGPSNDDDVNSHQTKNDEPSVGKKSPFFPFYSPSPAHYLFSKKSPATNASSNSTPMRFFKRPFPPPSPAKHIRSLLARRHGTVKPNESAIPEGNESEVGDGGGAGLDKSFGFSKNFVNKYEMGEEVGRGHFGYTCKAKFKKGEVKGQEVAVKVIPKSKMTTAIAIEDVRREVKILRALTGHNNLVKFYDAYEDPNNVYIVMELCEGGELLDRILSRGGKYTEDDAKSVMIQILKVVAFCHLQGVVHRDLKPENFLFTSKDENAQLKAIDFGLSDFVKPDERLNDIVGSAYYVAPEVLHRSYSTEADVWSIGVIAYILLCGSRPFWARTESGIFRAVLKADPSFDEQPWPTLSSEAKDFVKRLLNKDPRKRMTAAQALGHPWIKNSHNMEEPLDILIFKLMKAYMRSSALRKAALRALSKTLTVDELFYLKEQFALLEPNKNGTISFNNIKTALMKHATDAMKEARMHDFLASLNALQYRRMDFEEFCAAALSVHQLEALDRWEQHARCAYEIFEKEGNRAIMIEELASELGLSPSVPVHAVLHDWLRHTDGKLSFLGFAKLLHGVSSRSITKVQ

SEQ ID NO: 11942 - protein, 1315 aa, Botryotinia fuckeliana
MEDSTIAHTTAILQTLALSSIDLPLTNVYGNKGIRLPGADTAEKLALERELAALVSRVQRLEARAITVNNQTLPDTPNELGAPSAFADVLTGAPSRASKSTTSRQQLVNSLLAAREAPTGGERPPKFTKLSDEELEALREHVDHQSKQLDSQKSELAGVHAQLFEQKQRQEQALNVLEVERVAALERELKKHQQANEAFQKALREIGEIVTAVARGDLSKKVQIHSVEMDPEITTFKRVINTMMDQLQIFSSEVSRVAREVGTEGILGGQAKISGVDGTWKELTDNVNVMAQNLTDQVREIASVTTAVAHGDLTQKIERPAQGEILQLQQTINTMVDQLRTFAAEVTRVARDVGTEGILGGQAEIEGVQGMWNTLIVNVNAMANNLTTQVRDIAIVTTAVAKGDLTQKVQAECKGEIKQLKETINSMVDQLQQFAREVTKIAREVGTEGRLGGQATVHDVEGTWRDLTENVNGMAMNLTTQVREIAKVTTAVARGDLTKKIEVEVQGEIASLKDTINTMVDRLSTFAFEVSKVAREVGTDGTLGGQAQVDNVEGKWKDLTENVNTMARNLTTQVRGISTVTQAIANGDMSQKIEVAAAGEILILKETINNMVDRLSIFSNEVQRVAKDVGVDGKMGGQADVAGIGGRWKEITTDVNTMANNLTTQVRAFGDITNAATDGDFTKLITVEASGEMDELKRKINQMVYNLRDSIQRNTLAREAAEFANRTKSEFLANMSHEIRTPMNGIIGMTQLTLDTDLTQYQREMLNIVHNLANSLLTIIDDILDLSKIEANRMIMEEIPYTLRGTVFNALKTLAVKANEKFLDLTYRVDSSVPDHVVGDSFRLRQVILNLVGNAIKFTEHGEVSLTIQKAEQDHCAPNEYAVEFCVSDTGIGIQADKLNLIFDTFQQADGSMTRKFGGTGLGLSISKRLVNLMRGDVWVKSQYGKGSSFYFTCTVRLATSDISFIQKQLKPYQGHNVLFIDKGQTGHGKEIITMLTQLGLVPVVVDSEQHTILLGNGRTKEKIASTYDVIVVDSIESARKLRSIDEFKYIPIVLLAPVIHVSLKSALDLGITSYMTTPCLTIDLGNGMIPALENRAAPSLADNTKSFDILLAEDNIVNQRLAVKILEKYHHVVTVVGNGQEALDAIKEKRYDVILMDVQMPIMGGFEATAKIREYERSLGTQRTPIIALTAHAMLGDREKCIQAQMDEYLSKPLKQNHLIQTILKCATLGGALLEKGREVRQSANEESPNSQNGPRGAQHPASSPTPAHMRPAIEPRAYTTTGPINHGSAESPSLVTADAEDPLARLLMRAHSS

SEQ ID NO: 11943 - protein, 1547 aa, Mus musculus
MYAAVEHGPVLCSDSNILCLSWKGRVPKSEKEKPVCRRRYYEEGWLATGNGRGVVGVTFTSSHCRRDRSTPQRINFNLRGHNSEVVLVRWNEPYQKLATCDADGGIFVWIQYEGRWSVELVNDRGAQVSDFTWSHDGTQALISYRDGFVLVGSVSGQRHWSSEINLESQITCGIWTPDDQQVLFGTADGQVIVMDCHGRMLAHVLLHESDGILSMSWNYPIFLVEDSSESDTDSDDYSPPQDGPAAYPIPVQNTKPLLTVSFTSGDISLMNNYDDLSPTVIRSGLKEVVAQWCTQGDLLAVAGMEQQAQLSELPNGPLLKSAMVKFYNVRGEHIFTLDTLVQRPIISICWGHRDSRLLMASGPALYVVRVEHRVSSLQLLCQQAIASTLREDKDVNKLTLPPRLCSYLSTAFIPTIKPPIPDPNNMRDFVSYPSAGNERLHCTMKRTEDDPEVGGPCYTLYLEYLGGLVPILKGRRISKLRPEFVIMDPRTDSKSDEIYGNSLISTVIDSCNCSDSSDIELSDDWAAKKSPKISRSSKSPKLPRISIEARKSPKLPRAAQEISRSPRLPMRKPSMGSPSLTRREFPFEDITQHNYLAQVTSNIWGTKFKIVGLAAFLPTNLGAVIYKTSLLHLQPRQMTIYLPEVRKISMDYINLPVFNPNVFSEDEDDLPVTGASGVPENNPPCTVNIPIAPIHSSAQALSPTQSIGLVQSLLANQNVQLDVLTNQTTAVGSAEHAGDAATQYPVSSRYSNPGQVIFGGVEMGRIIQNPPQLPLPPPPPPPPQAPMQLSAVDHGDRDHEHLQKSAKALRPVPQLAAEGDAVVFSAPQEVQVAKMNPPPPYPGTIPAAPTTAAPPPPLPPPQPPVDVCLKKGDFSLYPTAAHYQPPLGYERITTFDSSGNVEEVCRPRTRMLCSQNTYTLPGPGSSATLRLTATEKKVPQPCTSATLNRLTVPRYSIPTGDPPPYPEIASQLAQGRSAAQRLDNSLIHATLRRNNREVALKMAQLADSSRAPLQPLAKPKGGAAGAVAQLPARPPPALYTCSQCSGAGPSSQSGAALAHAISTSPLASQSSYNLLSPPDTSRDRTDYVNSAFTEDEALSQHCQLEKPLRHPPLPEAAVTMKRPPPYQWDPMLGEDVWVPQERTAQPTVPNPLKLSPLMLGQGQHLDVARVPFVPPKSPSSPTATFPTGYGMGMPYPGSYNNPSLPGVQAPCSPKDALSQAQFAQQESAVVLQPAYPPSLSYCTLPPTYPGSSTCSSVQLPPIALHPWNSYSTCPPMQNTQGTLPPKPHLVVEKPLVSPPPAELQSHMGTEVMVETADNFQEVLSLTESPVPQRTEKFGKKNRKRLDSRAEEGSVQAITEGKVKKDARTLSDFNSLISSPRLGREKKKVKSQKDQLKSKKLNKTNEFQDSSESEPELFISGDELMNQSQGSKKGWKSKRSLRTASELEEFKCRKASEKEDGRLGSQGFVYVMANKQPLWNEATQVYQLDFGGRVTQESAKNFQIELEGRQVMQFGRIDGNAYILDFQYPFSAVQAFAVALANVTQRLK

SEQ ID NO: 11944 - protein, 299 aa, Rattus norvegicus
MGKEEEIARIARRLDKMVTRKNAEGAMDLLRELKNMPITLHLLQSTRVGMSVNALRKQSSDEELIALAKSLIKSWKKLLDVSDGKSRDQGRGTPLPTSSSKDASGTTDLSCKKPDPPRTSSTPRITTFPQVPITCDAVRNKCREMLTLALQTDHDHVAVGVSCEHLSSQIEECIFLDVGNTDMKYKNRVRSRISNLKDAKNPGLRRNVLCGAITPQQIAVMTSEEMASDELKEIRKAMTKEAIREHQMARTGGTQTDLFTCNKCRKKNCTYTQVQTRSSDEPMTTYVVCNECGNRWKFC

SEQ ID NO: 11945 - protein, 710 aa, Rattus norvegicus
MGMSKSRGCFGYPLSIFFIVVNEFCERFSYYGMRALLVLYFRNFLGWDDDLSTAIYHTFVALCYLTPILGALIADSWLGKFKTIVSLSIVYTIGQAVISVSSINDLTDHDHDGSPNNLPLHVALSMIGLALIALGTGGIKPCVSAFGGDQFEEGQEKQRNRFFSIFYLAINAGSLLSTIITPILRVQQCGIHSQQACYPLAFGVPAALMAVALIVFVLGSGMYKKFQPQGNIMGKVAKCIRFAIKNRFRHRSKAFPKRNHWLDWAKEKYDERLISQIKIMTKVMFLYIPLPMFWALFDQQGSRWTLQATTMTGKIGTIEIQPDQMQTVNAILIVIMVPIVDAVVYPLIAKCGFNFTSLKKMTVGMFLASMAFVVAAIVQVEIDKTLPVFPSGNQVQIKVLNIGNNDMAVYFPGKNVTVAQMSQTDTFMTFDVDQLTSINVSSPGSPGVTTVAHEFEPGHRHTLLVWGPNLYRVVKDGLNQKPEKGENGIRFVSTLNEMITIKMSGKVYENVTSHSASNYQFFPSGQKDYTINTTEIAPNCSSDFKSSNLDFGSAYTYVIRSRASDGCLEVKEFEDIPPNTVNMALQIPQYFLLTCGEVVFSVTGLEFSYSQAPSNMKSVLQAGWLLTVAIGNIIVLIVAEAGHFDKQWAEYVLFASLLLVVCIIFAIMARFYTYINPAEIEAQFDEDEKKKGVGKENPYSSLEPVSQTNM

SEQ ID NO: 11946 - protein, 529 aa, Arabidopsis thaliana
MQTSQKHHSAAGLHMLYPQVYCSPQFQAKDNKGFSDIPSKENFFTLESSTASGSLPSYDSPSVSITSGQSPFSPQGSQSCISDLHHSPDNVYGSPLSGVSSLAYDEAGVKSKIRELEVSLLSGDTKVEEFSGFSPAAGKSWNWDELLALTPQLDLKEVLVEAARAVADGDFATAYGFLDVLEQMVSVSGSPIQRLGTYMAEGLRARLEGSGSNIYKSLKCNEPTGRELMSYMSVLYEICPYWKFAYTTANVEILEAIAGETRVHIIDFQIAQGSQYMFLIQELAKRPGGPPLLRVTGVDDSQSTYARGGGLSLVGERLATLAQSCGVPFEFHDAIMSGCKVQREHLGLEPGFAVVVNFPYVLHHMPDESVSVENHRDRLLHLIKSLSPKLVTLVEQESNTNTSPFLSRFVETLDYYTAMFESIDAARPRDDKQRISAEQHCVARDIVNMIACEESERVERHEVLGKWRVRMMMAGFTGWPVSTSAAFAASEMLKAYDKNYKLGGHEGALYLFWKRRPMATCSVWKPNPN

SEQ ID NO: 11947 - protein, 383 aa, Arabidopsis thaliana
MRSSQNGGAMGGRAAGTGGGGPSAPVDKEVDYAQYFCTYSFLYHQKDMLSDRVRMDAYFNAVFQNKHHFEGKTVLDVGTGSGILAIWSAQAGARKVYAVEATKMADHARALVKANNLDHIVEVIEGSVEDISLPEKVDVIISEWMGYFLLRESMFDSVISARDRWLKPTGVMYPSHARMWLAPIKSNIADRKRNDFDGAMADWHNFSDEIKSYYGVDMGVLTKPFAEEQEKYYIQTAMWNDLNPQQIIGTPTIVKEMDCLTASVSEIEEVRSNVTSVINMEHTRLCGFGGWFDVQFSGRKEDPAQQEIELTTAPSEQHCTHWGQQVFIMSNPINVEEGDNLNLGLLMSRSKENHRLMEIELYCEIKEASGNPKESFKKTYFIE

SEQ ID NO: 11948 - protein, 722 aa, Morinda citrifolia
MALNAFAFPGNLSRVLVSNSIKQSLLHSNWLCGTDLQLQFECQNNQVMKNSRRVRASLSERGEYYSQRPPTPLLDTINYPIHMKNLSTKSHYLIQELKQLADELRSDIIFNVSKTGGHLGSSLGVVELTVALHYAFNCPQDKIVWDVGHQAYPHKILTGRRSKMQTIRQTYGIAGFPKRDESVYDAFGAGHSSTSISAGLGMAVGRDLLGKNNNVISVIGDGAMTAGQAYEAMNNAGFLDANLIVILNDNKQVSLPTGTLDGPATPVGALSSALTKLQASPKFRQLREAAKSITKQIGPQAHEVAAKVDEYARGLISASGSTFFEELGLYYIGPVDGHNIEDLITIFDKVKTMPAPGPVLIHIVTEKGKGYPPAEAAADRMHGVVKFDVASGKQFKSKSPTLSYTQYFAEALIKEAEIDNKIVAIHAAMGGGTGLNYFQKIFPERCFDVGIAEQHAVTFAAGLATEGLKPFCAIYSSFLQRGYDQVVHDVDLQKLPVRFAMDRAGLVGADGPTHCGAFDVAYMACLSNMIVMAPADEAELMHMVATAATIDDRPCCFRFPRGNGIGAKLPPDNKGNLIGIGKGRILTEGSRVAIIGYGAIVQQCLGAAEMLKLHNIKPTIADARFCKPLDGELIKRLAKEHEILITVEEGSIGGFGSHVSHFLSLSGLLDGPIKLRSMVLPDRYIDHGSPADQIEQAGLSSRHICATVLSLLGKPKEALQLK

SEQ ID NO: 11949 - protein, 146 aa, Phaseolus vulgaris
MGAFTEKQEALVNSSWEAFKGNIPQYSVVFYTSILEKAPAAKNLFSFLANGVDPTNPKLTAHAESLFGLVRDSAAQLRANGAVVADAALGSIHSQKGVNDSQFLVVKEALLKTLKEAVGDKWTDELSTALELAYDELAAAIKKAYA

SEQ ID NO: 11950 - protein, 298 aa, Homo sapiens
MENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 11951 - protein, 264 aa, Homo sapiens
MENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVTRRALFPGDSEIDQLFRIFRTLGTPDEVVWPGVTSMPDYKPSFPKWARQDFSKVVPPLDEDGRSLLSQMLHYDPYKRISAKAALAHPFFQDVTKPVPHLRL

SEQ ID NO: 11952 - protein, 250 aa, Comamonas testosteroni
MGRVNDKVVLVTGGAMGMGLTHCTLLAREGATVYLSDMNEELGHQAVAEIRRQGGKAHFLHLDVTNENHWTGAVDTILAESDRLDALVNNAGILTLKPVQDTSNEEWDRIFEINVRSVFLGTRAVIEPMRKAHKGCIVNVSSIYGLVGAPGAAAYEASKGAVRLFTKACAVDLAPFNIRVNSVHPGVIATPMTQQILDAPQSARALLGPTLLGRAAQPMEVSQAVLFLVSDEASFVHGSELVVDGGYTAN

SEQ ID NO: 11953 - protein, 257 aa, Neurospora crassa
MLQAIDNIHDRQFLAAELASSATLAAELAQPEIKNILLAASGSVATIKIPEIVKALARHGDKIRIRIILTHFAKHFLGGQSKEQPVYSSLLDYPHVEAIYDDADEWGPEPWQRGASILHIELRRWADILVVAPLSANTLAKIVNGMSDNLLTSVIRAWDTDSSIDNKKKVIMVAPAMNSAMWRHPITAKQIRVLQEEWGVRDPEPSEGDTAGVAVANGWFQVIMPIAKTLACGDTGDGAMASVDTIAEAIESRLGLE

SEQ ID NO: 11954 - protein, 653 aa, Neurospora crassa
MDAKPQRPLWAPPVRYGDENIPPADPTHQSKRSDSKIKAMMAVNGTLNAPPKRAACFDKSNTSKPLADGGNKDMLKNRVKPMVTTSSTRDLRSDGRENNRSAAEEHYMRPTATSKAASHGHQKYSSTAPLSSHAASGAYGGIRSHNAIAKLSAPVKKTTNVYRDNKVKEESTSHAPTSSSVDDLVAMVDKHIKDPRHYKSQPQLKSDQQHTLHRNQSKYVPNYENLNDVDDPDDSNADYAESYEDAVEQLSRDLDIPANTDPAAIVHANHMSIAQASYDSMPQGAPLAPSKPVRALPLPPNVSDPEEYSEDDDDQDLYDDQGYTTAHSYRSHCDNTTGGPPTLVAPKFTADIQKELDIAKAWVLEHQTEEEVEEENWDVSMVAEYGDEIFEYLRELEERMLPNPHYMDIQTEIRWSMRSVLMDWLVQVHHRFSLLPETLFLTVNYIDRFLSVKVVSLGKLQLVGATAIFVAAKYEEINCPSIQELVYMVDQGYSVEEILKAEKFMLTMLNFELGWPGPMSFLRRISKADDYDLETRTLAKYLLEVTIMDERFVGCPASYLAAGAHCLSRFFLQRGPWTHAHVHFSGYTLAQLRPLIISILDCCQEPRKHHGAVYDKYSHQRFKSASTFVEGKIANGFVLPIRTNASISDSAQS

SEQ ID NO: 11955 - protein, 658 aa, Brassica oleracea
  unsure (1)..(658): unsure at all Xaa locations
YHHSYTFSFLLVFLVLILFHPALSIYVNTLSSSESLTISSNRTLVSPGGVFELGFFKPLGRSRWYLGIWYKKAPWKTYAWVANRDNPLSSSIGTLKISGNNLVLLSQSTNTVWSTNLTRGNARSPVIAELLPNGNFVIRHSNNKDSSGFLWQSFDFPTDTLLPEMKLGYDLKTGRNRFLTSWKGSDDPSSGNFVYKLDIRRGLPEFILINQFLNQRVETQRSGPWNGMEFSGIPEVQGLNYMVYNYTENSEEIAYSFHMTNQSIYSRLTVSELTLDRLTWIPPSRDWSLFWTLPTDVCDPLYLCGSYSYCDLITSPNCNCIRGFVPKNPQQWDLRDGTRGCVRTTQMSCSGDGFLRLNNMNLPDTKTATVDRTMDVKKCEERCLSDCNCTSFAIADVRNGGLGCVFWTGELVAIRKFAVGGQDLYVRLNAADLDISSGEKRDRTGKIIGWXIGSSVMLILSVILFCFWRRRQKQAKADATPIVGYQVLMNEVVLPRKKRNFSGEDDVENLELPLMEFEAVVTATEHFSDFNKGRLVDGQEIAVKRLSEMSAQGTDEFMNEVRLIAKLQHNNLVRLLGCCVYEGEKILIYEYLDNLSLDSHLFDLTRRRMLNWQMRFDIINGIARGILYLHHDSSIRIIHRDLKASNILLDKDMTPKIS

SEQ ID NO: 11956 - protein, 412 aa, Neurospora crassa
MADLLYDLLSPSFSGDPSSRPAPDSSSLEYLTSLSSQPLTALETTEPQALAQTSHGLLLSIQALSKKSHKQVIESATHHSTLRTSLPALAASTADLRHSIPKLDHEAVRFSTNYSKSSESDVLLRRKKALLLSRNVERLVDVLELPNLLSTAISTAPVNYSSALDLNGHIRRLHSLYPDSPLVTSIAAQADEAMRTMAANLIQSLKSPGLKLAASLRTISWLRRVLPDLEAAGTSKGHDSQERVLGALFLVCRLATLVNMLDALEPLRDLADQEKARQKAIGSGNAWSGGQQTERYLKRYIEIFREQSFAIQQDALEPMPAALATFPLHLVDMLLETLRLYLPTVKDQASRDSLLTQVLYCAGSLGRLGGDFGLFLASLDLGPEAEEEWVEVVKRHRALAGRLESIVGDQKK

SEQ ID NO: 11957 - protein, 261 aa, Streptomyces galilaeus
MPPAAERVAIVTGATSGIGLAVARSLAERGARVFVCARDGDRVAHTVKELREAGHDVDGASCDVRDTARVRAFVQEARDRFGPVDVLVNNAGRSGGGHTAQIPDELWLDVIETNLNSVFRMTREVLTTGGMLERGAGRIVNIASTGGKQGVALGAPYSASKHGVVGFTKALGLELAKTGITVNAVCPGYVETPMAERVRQGYAGAWDITEDEVLERFEAKIPLGRYSTPDEVAGLVGYLLSSTAASITAQAMNVCGGLGNY

SEQ ID NO: 11958 - protein, 339 aa, Yarrowia lipolytica
MDVDSDIAAESVARVYADVNNLMPPSYWDYDKLALKWGQQDNYEIIKKIGRGKYSEVFEGINIVSKELVVIKALKPVKRKKIKREVKILQNVAGGPNIISLLETVRDPQSKMPAFIFEHVQNLDFRALYPKFTDYDIRYYMYELLKAIDYSHSKGIMHRDVKPHNVMIDHEKRKLRLIDWGLAELYHAGTEYNVRVASRYFKGPELLVDFQLYDYSLDLWSYGAMFASMIFKKEPFFHGTSNTDQLVKIARVLGTEKLWDYLEKYNIELGAEYDDIGTYPARPWSKFVNVDNEAYISQEAIHLLDNLLRYDHQERLTAKEAMAHDYFKPVRVREEGEQE

SEQ ID NO: 11959 - protein, 386 aa, Caenorhabditis elegans
MSSTAGQVINCKAAVAWSAKAPLSIETIQVAPPKAHEVRVKFQILYTAVCHTDAYTLDGHDPEGLFPVVLGHEGSGIVESVGEGVTGFAPGDHVVPLYVPQCKECEYCKNPKTNLCQKIRISQGNGFMPDGSSRFTCNGKQLFHFMGCSTFSEYTVVADISLCKVNPEAPLEKVSLLGCGISTGYGAVLNTCKVEEGSTVAVWGLGAVGLAVIMGAKAAGAKKIVGIDLIESKFESAKFFGATECINPKSVELPEGKSFQAWLVEQFDGGFDYTFECIGNVHTMRQALEAAHKGWGVSCIIGVAGAGQEIATRPFQLVTGRTWKGTAFGGWKSVESVPRLVDDYMNKKLLIDEFITHRWNIDDINTAFDVLHKGESLRSVLAFEKI

SEQ ID NO: 11960 - protein, 295 aa, Homo sapiens
MEHQLLCCEVETIRRAYPDANLLNDRVLRAMLKAEETCAPSVSYFKCVQKEVLPSMRKIVATWMLEVCEEQKCEEEVFPLAMNYLDRFLSLEPVKKSRLQLLGATCMFVASKMKETIPLTAEKLCIYTDNSIRPEELLQMELLLVNKLKWNLAAMTPHDFIEHFLSKMPEAEENKQIIRKHAQTFVALCATDVKFISNPPSMVAAGSVVAAVQGLNLRSPNNFLSYYRLTRFLSRVIKCDPDCLRACQEQIEALLESSLRQAQQNMDPKAAEEEEEEEEEVDLACTPTDVRDVDI

SEQ ID NO: 11961 - protein, 324 aa, Plasmodium falciparum
MENNSTERYIFKPNFLGEGSYGKVYKAYDTILKKEVAIKKMKLNEISNYIDDCGINFVLLREIKIMKEIKHKNIMSALDLYCEKDYINLVMEIMDYDLSKIINRKIFLTDSQKKCILLQILNGLNVLHKYYFMHRDLSPANIFINKKGEVKLADFGLCTKYGYDMYSDKLFRDKYKKNLNLTSKVVTLWYRAPELLLGSNKYNSSIDMWSFGCIFAELLLQKALFPGENEIDQLGKIFFLLGTPNENNWPEALCLPLYTEFTKATKKDFKTYFKIDDDDCIDLLTSFLKLNAHERISAEDAMKHRYFFNDPLPCDISQLPFNDL

SEQ ID NO: 11962 - protein, 270 aa, Homo sapiens
MDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEECIFRDVGNTDMKYKNRVRSRISNLKDAKNPDLRRNVLCGAITPQQIAVMTSEEMASDELKEIRKAMTKEAIREHQMARTGGTQTDLFTCGKCRKKNCTYTQVQTRSSDEPMTTFVVCNECGNRWK

SEQ ID NO: 11963 - protein, 272 aa, Homo sapiens
MDLLRELKAMPITLHLLQSTRVGMSVNALRKQSSDEEVIALAKSLIKSWKKLLDASDAKARERGRGMPLPTSSRDASEAPDPSRKRPELPRAPSTPRITTFPPVPVTCDAVRNKCREMLTAALQTDHDHVAIGADCERLSAQIEECIFRDVGNTDMKYKNRVRSRISNLKDAKNPDLRRNVLCGAITPQQIAVMTSEEMASDELKEIRKAMTKEAIREHQMARTGGTQTDLFTCGKCRKKNCTYTQVQTRSSDEPMTTFVVCNECGNRWKFC

SEQ ID NO: 11964 - protein, 232 aa, Malus x domestica
MGRGKIEIKLIENQTNRQVTYSKRRNGIFKKAQELTVLCDAKVSLIMLSNTNKMHEYISPTTTTKSMYDDYQKTMGIDLWRTHEESMKDTLWKLKEINNKLRREIRQRLGHDLNGLSFDELASLDDEMQSSLDAIRQRKYHVIKTQTETTKKKVKNLEQRRGNMLHGYFDQEAAGEDPQYGYEDNEGDYESALALSNGANNLYTFHLHHRNLHHGGSSLGSSITHLHDLRLA

SEQ ID NO: 11965 - protein, 245 aa, Malus x domestica
MAYESKSLSLDSPQRKLGRGKIEIKRIENTTNRQVTFCKRRNGLLKKAYELSVLCDAEVALIVFSNRGRLYEYANNSVKGTIERYKKASADSSNTGSVSEASTQYYQQEAAKLRARIVKLQNDNRNMMGDALNSMSVKDLKSLENKLEKAISRIRSKKNELLFAEIEYMQKRELDLHNNNQLLRAKIAENERASRTLNVMAGGGTSSYDILQSQPYDSRNYFQVNALQPNHQYNPRHDQISLQLV

SEQ ID NO: 11966 - protein, 132 aa, Leishmania infantum
MATPRSAKKATRKSGSKSAKCGLIFPVGRVGGMMRRGQYARRIGASGAVYLAAVLEYLTAELLELSVKAAAQSGKKRCRLNPRTVMLAARHDDDICMLLKNVTLSRSGVVPSVSKAVAKKKGGKKGRATPSA

SEQ ID NO: 11967 - protein, 132 aa, Leishmania infantum
MATPRSAKKATRKSGSKSAKCGLIFPVGRVGGMMRRGQYARRIGASGAVYLAAVLEYLTAELLELSVKAAAQSGKKRCRLNPRTVMLAARHDDDICMLLKNVTLSRSGVVPSVSKAVAKKKGGKKGRATLSA

SEQ ID NO: 11968 - protein, 132 aa, Leishmania infantum
MATPRSAKKATRKSGSKSAKCGLIFPVGRVGGMMRRGQYAHRIGASGAVYLAAVLEYLTAELLELSVKAAAQSGKKRCRLNPRTVMLAARHDDDICMLLKNVTLSRSGVVPSASKAVAKKKGGKKGRATPSA

SEQ ID NO: 11969 - protein, 132 aa, Leishmania infantum
MATPRSAKKAARKSGSKSAKCGLIFPVGRVGGMMRRGQYARRIGASGAVYLAAVLEYLTAELLELSVKAAAQSGKKRCRLNPRTVMLAARHDDDIGMLLKNVTLSHSGVVPSVSKAVAKKKGGKKGRATPSA

SEQ ID NO: 11970 - protein, 132 aa, Leishmania infantum
MATPRSAKKAARKSGSKSAKCGLIFPVGRVGGMMRRGQYARRIGASGAVYLAAVLEYLTAELLELSVKAAAQSGKKRCRLNPRTVMLAARHDDDIGMLLKNVTLSHSGVVPSVSKAMAKKKGGKKGKATPNA

SEQ ID NO: 11971 - protein, 132 aa, Leishmania infantum
MATPRSAKKAARKSGSKSAKCGLIFPVGRVGGMMRRGQYARRIGASGAVYLAAVLEYLTAELLELSVKAAAQSGKKRCRLNPRTVMLAARHDDDIGTLLKNVTLSHSGVVPNISKAMAKKKGGKKGKATPNA

SEQ ID NO: 11972 - protein, 187 aa, Mus musculus
MPTDMSMWTGPLSLHEVDEQPQHLLRVTYTEAEVEELGQVLTPTQVKHRPGSISWDGLDPGKLYTLILTDPDAPSRKKPVYREWHHFLVVNMKGNDISSGNVLSDYVGSGPPKGTGLHRYVWLVYQQDKPLRCDEPILTNRSGDHRGKFKTAAFRKKYHLGAPVAGTCYQAEWDSYVPKLYKQLSGK

SEQ ID NO: 11973 - protein, 537 aa, Lycopersicon esculentum
MVSSLLLPTPQILSISSSLQSSLPFKPHNFLQITRKKNTLISSPLRVAAPPTTTTATEEEEKLDSKSSDIEDTENDEQDSSSKFSWRDHWYPVSLVEDLDPSLPTPFQLLNRDIVIWFDKSGSQWVALDDKCPHRLAPLSEGRLDENGDLQCSYHGWSFNGCGSCTRIPQAASQGPEAKAFQSPRACATRFPTMVSQGLLFVWPDENGWERAQATKPPMLPEDFDKPEFATVTIQRDLFYGYDTLMENVSDPSHIDFAHHKVTGRRDRAKPLPFKMEASGPWGFAGANNDKPKITAKFVAPCYSMNKIEIDTKLPIVGDQKWVIWICSFNVPMAPGKTRSIVCSARNFSQFTVPGPAWWQVFPRWQEHWTSNKVYDGDMIVLQGQEKVFLSKSKENGTDVNKEYTKLTFTPTQADRFVLAFRNWLRRHGNSQPEWFGSTDNQPLPSTVLSKRQMMDRFEQHTLKCSSCKKAYYTFEKLQKLLIGSVVVCCASAGIPADVNLRIILGSLAIISAGLAYILHELQKNFIFVDYVHAEID

SEQ ID NO: 11974 - protein, 505 aa, Arabidopsis thaliana
MTSCNLLWKELSEHFTSMEQNLMKKSEALRQMIETLDNQTQSSIELLKHREVTIDHSVEIAEGKVEERVRAALDSLEKARDCGDEDTGEVDDGDGLLSALKSLCLKMDARGFWGFVIARKKELENLRSQIPVALVDCVDPPKLVLEAVSEVFPVDKRGGGEKVSNDFGWACVVILESLIPVMVDPVMGKSRLLVTPSVKEKAKEIAETWKASLEERGGIENVKTPDVHTFLQHLVTFGIVKKDDLALYRKLVVGSAWRKQMPKLAVSVGLGDQMPDMIEELIIRGQQLDAVHFTFEVGLVHLFPPVPLLKAYLRDAKKATALITDDSNNSGRSAHLVARKEQSALRAVLKCIEEYKLEEEFPPENLKKRLDQLEKTKTEKRKPAVIPANKRTRASYSGPMPPAKAGRITNAYVSSFPPPPPTFIRSQSHSPQYGVPAYTTSPPTIYSNRSPPYQYSPEAVHGSYQTSPVSYPTAYGTYCSPVAAPPPPVYHPHPHHHHHIQHAYY

SEQ ID NO: 11975 - protein, 297 aa, Homo sapiens
  unsure (1)..(297): unsure at all Xaa locations
SMENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYXHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHL

SEQ ID NO: 11976 - protein, 261 aa, Homo sapiens
VPDYHEDIHTYLREMEVKCKPKVGYMKKQPDITNSMRAILVDWLVEVGEEYKLQNETLHLAVNYIDRFLSSMSVLRGKLQLVGTAAMLLASKFEEIYPPEVAEFVYITDDTYTKKQVLRMEHLVLKVLTFDLAAPTVNQFLTQYFLHQQPANCKVESLAMFLGELSLIDADPYLKYLPSVIAGAAFHLALYTVTGQSWPESLIRKTGYTLESLKPCLMDLHQTYLKAPQHAQQSIREKYKNSKYHGVSLLNPPETLNLLNL

SEQ ID NO: 11977 - protein, 431 aa, Escherichia coli
SKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 11978 - protein, 370 aa, Oryza sativa
MATGKVIKCKAAVAWEAGEALSIEEVEVAPPQRMEVRVKILYTALCHTDVYFWEAKGQTPVFPRILGHEAGGIVESVGEGVTELAAGDHVLPVFTGECKECDHCKSEESNMCDLLRINVDRGVMIGDGKSRFTIKGKPIFHFVGTSTFSEYTVIHVGCLAKINPEAPLDKVCILSCGFSSRFGATVNVAKPKKGQTVAIFGLGAVGLAAMEGARLSGASRIIGVDLNPAKFEQAKKFGCTDFVNPKDHSKPVQVLIEMTNGGLDRAVECTGNINAMISCFECVHDGWGVAVLVGVKDDVFKTHPMNFLNEKTLKGTLIFGNYKPRTDLPNVVELYMKKELELEKFITSVPFSEINTAFDLMLKGRVSAAS

SEQ ID NO: 11979 - protein, 353 aa, Neurospora crassa
MGCGMSTEEKEGKARNEEIENQLKRDRMQQRNEIKMLLLGAGESGKSTILKQMKLIHEGGYSRDGAESFKEIIFSNTVQSMRVILEAMESLELPLADQRVEYHVQTIFMQPAQIEGDVLPPEVGNAIEALWRDAGVQSCFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 11980 - protein, 154 aa, Sesbania rostrata
QKKTKNMGFTDKQEALVNTSYEAFKKNLPGHSVLFYSFILEKEPAAKGLFSFLKDSDGVPQNNPSLQAHAEKVFGLVHDAAAQLRATGVVVLADASLGSVHVQKGVTDPHFVVVKEALLKTLKEAAGATWSDEVSIAWEVAYDGLAAAIKKAMS

SEQ ID NO: 11981 - protein, 148 aa, Sesbania rostrata
GAFTESQEALVTSSYETFKQNASDLSVLFYTFILEKAPGAKNLFSFLKDSDGVPKDNPNLKAHAAKVFELVVDSAVQLRTKGAVVIADANLGPVHVQKGVTDAHFVVVKEALLKTVKEATGAKWSDELSNAWEVAYDELAAAIKKAMG

SEQ ID NO: 11982 - protein, 246 aa, Drosophila yakuba
GTNIITLLAVVKDPVSRTPALIFEHVNNTDFKQLYQTLTDYEIRYYLFELLKALDYCHSMGIMHRDVKPHNVMIDHENRKLRLIDWGLAEFYHPGQEYNVRVASRYFKGPELLVDYQMYDYSLDMWSLGCMLASMIFRKEPFFHGHDNYDQLVRIAKVLGTEELYAYLDKYNIDLDPRFHDILQRHSRKRWERFVHSDNQHLVSPEALDFLDKLLRYDHVDRLTAREAMAHPYFLPIVNGQMNPNN

SEQ ID NO: 11983 - protein, 232 aa, Zea mays
QADFGRLEIELAEVEMPGLMACRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKNGTIPDPNSTDNAEFQLVLTIIKESLKTDPLKYTKMKERLVGVSEETTTGVKRLYQMQANGTLLFLLLMVMIWYPRASSTTCTDAALTGRWLM

SEQ ID NO: 11984 - protein, 97 aa, Talaromyces emersonii
DLVGVASTAIGFFKKAAIGSSARERTIKTKTSPADVVMFSGSKDSQTSADTFQGGEARGALSWAFIESLKKWPRQSYLQLLNSIRALLEDKYTQKPQ

SEQ ID NO: 11985 - protein, 723 aa, synthetic construct
MVSKGEELFTGVVPILVELDGDVNGHRFSVSGEGEGDATYGKLTLKFICTTGKLPVPWPTLVTTLTWGVQCFSRYPDHMKQHDFFKSAMPEGYVQERTIFFKDDGNYKTRAEVKFEGDTLVNRIELKGIDFKEDGNILGHKLEYNYISHNVYITADKQKNGIKAHFKIRHNIEDGSVQLADHYQQNTPIGDGPVLLPDNHYLSTQSALSKDPNEKRDHMVLLEFVTAARMHMEKTELIQKAKLAEQAERYDDMATCMKAVTEQGAELSNEERNLLSVAYKNVVGGRRSAWRVISSIEQKTDTSDKKLQLIKDYREKVESELRSICTTVLELLDKYLIANATNPESKVFYLKMKGDYFRYLAEVACGDDRKQTIDNSQGAYQEAFDISKKEMQPTHPIRLGLALNFSVFYYEILNNPELACTLAKTAFDEAIAELDTLNEDSYKDSTLIMQLLRDNLTLWTSDSAGGTGGSLRRASLPGTGGSELMVSKGEELFTGVVPILVELDGDVNGHKFSVSGEGEGDATYGKLTLKFICTTGKLPVPWPTLVTTFGYGLMCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 11986 - protein, 553 aa, Sus scrofa
MVDMGGLDNLIANTAYLQARKTSDADSKELQRRRRSLMLPGPQSCEQLRQAMPADFNSLCEQQPIGRRLFRDFLATVPAYQEAMGFLEEVQSWELAEEGPAKGSTLQALVATCAVAPNPGQPHSFLSPALVTKCQAATTDEERASLVEQAKAEAMAFLQDQPFREFLVSPFYDKFLQWKVFEMQPVSDKYFEEFRVLGKGGFGEVCAVQVKNTGKMYACKKLDKKRLKKKSGEKMALSEKEILEKVSSPFVVSLAYAFESKSHLCLVMSLMNGGDLKFHIYSVGERGLDMNRVIFYSAQMTCGVLHLHSLGIVYRDLKPENVLLDDLGNCRLSDLGLAVQIQDGKPVTQRAGTNGYMAPEILMEKASYSYPVDWFAMGCSIYEMVAGRTPFKDYKEKISKEDLKQRTLKEEVRFQHQSFTEEAKDICRLFLAKTPEQRLGSREKSDDPRKHHFFKTINFPRLEAGLVDPPFVPDPSVVYAKDVDEIEDFSEVRGVEFDDKDKQFFQRFATGAVPIAWQEEIIETGLFEELNDPNRPAGCGEGNSSRSGVCLLL

SEQ ID NO: 11987 - protein, 501 aa, Suaeda liaotungensis
MSIPIPSRQLFIDGEWREPIKRNRLPIINPSTEETIGEIPAATAEDVEAAVSAARRALKRNKGRDWAATSGAHRARYLRAIAAKVSEKKDHFVKLETMDSGKPLDEAVLDIDDVSTCFEYFADQAEALDNKQKYPVKLPMDRFKSHVLRQPIGVVGLISPWNYPLLMATWKIAPALAAGCTAVLKPSELASVTCLEFGEVCNEVGLPPGVLNILTGLGPDAGAPLVSHPDVDKVAFTGSSATGSKVMGSAAQLVKPVTLELGGKSPIIVFEDVVDLDVAAEWTIFGVFWTNGQICSATSRLLVHESIAAEFVEKLVKWSKKIKISDPFEEGCRLGPVISKGQYDKIMKYISTAKSEGATILCGGSRPEHLKKGYFIEPTIVTDITTSMQIWKEEVFGPVLCVKTFSTEEEALELANDTEYGLAAAVFSKDLERCERVTKALEVGAVWVNCSQPCFCHAPWGGVKRSGFGRELGEWGIENYLNIKQVTSDISDEPWGWYKSP

SEQ ID NO: 11988 - protein, 471 aa, Amorpha fruticosa
MAATATDNKLSNLKSAVAGLNQISENEKKGFINLVSRYLSGEAQHVEWSKIQTPTDEVVVPYESLAPTPDGSSEVKSLLDKLVVLKLNGGLGTTMGCTGPKSVIEVRDGLTFLDLIVIQIENLNSKYGSNVPLLLMNSFNTHDDTQKIIEKYKNSNIQIHTFNQSQYPRLVVDDFLPLPSKGHTGKDGWYPPGHGDVFPSLSNSGKLDALLSQGKEYVFVANSDNLGAIVDLKILNHLVKNKNEYCMEVTPKTLADVKGGTLISYEGRVQLLEIAQVPDEHVSEFKSIEKFKIFNTNNLWVNLKAIKRLVEADALKTEIIPNPKEVDGVKVLQLETAAGAAIRFFDKAIGINVPRSRFLPVKATSDLLLVQSDLYTLEDGFVIRNKARANPENPTVELGPEFKKVSNFLSRFKSIPSIVELDSLKVAGDVWFGPGIILKGKVSIVAKPGVKLEIPDGAVIANKEINGPEDL

SEQ ID NO: 11989 - protein, 170 aa, Caenorhabditis elegans
VSEAAKEREIKISSSDNEIFLVPRNVIRLSNTINTLLMDLGLDDEEGTNAEPIPVQNVTASILKKVISWCNHHHSDPISTEDSDNREKRTDDIGSWDVEFLKVDQGTLFELILAANYLDIKGLLDVTCKTVANMIKGKSPEEIRRTFNIKNDFTPEEEEQIRKENAWCED

SEQ ID NO: 11990 - protein, 144 aa, Caenorhabditis elegans
SSEEQDVKIVTSDDVEFIVSPKIANQSKLLADFVVLNQREPIPLKNVTSEIFKKVIEWCEYHAEDIPKPPDNVEEKRTDDIGEWDVEFLKVDKGTLFELVLAATYLDIKGLFNVTCKSIANSIKGKSPEEIRAVFNLGNETNME

SEQ ID NO: 11991 - protein, 174 aa, Caenorhabditis elegans
IDILITMSAPVSDAPAAQIFYKIISNDGVVTKMSEKAVQQSKTLSNLIENLGYTIENIETRDPIPVTNVNGKTMEKVAEWCEKHNADAIPEDNMNVLKTLTIPEWDQKFLKIEDEALFDLILASNFLDIKGLMYYGCKTVSNMAKGKTTAELREIFGINTDEQDAAEGGAVEVA

SEQ ID NO: 11992 - protein, 408 aa, Oryza sativa (japonica cultivar-group); identical to SEQ ID NO: 966

SEQ ID NO: 11993 - protein, 470 aa, Candida albicans
MKHTIIENEPEIKLQNDLNHHIEISPNTKTTNGTTTTTTTLNVNKTLKAIDLIETSIKNHISTIDHENCLPNDEDSFFVCDLGEIINSVNQWQQSLPMVQPYYAVKCNSNPQILTTLSELGVNFDCASKNEIDLVLSLGIHQAHERIIYANPCKTNSFIRHAANENVNLTTVDNVHELYKLAKFHPHCKILIRLITDDSTAQCQLSTKFGCDLNTAIGEILPKAKELSLQVHGVAFHVGSGAKDFSSIYQAIKDSRILFDEMLSMGFTPKLLDIGGGFERETFPQSSQMVKFALEKFFPIEFSQSNEIKFIAEPGRFMVANAFTLITHIIARRDLPTGGNNHNNDMTPSAMLYINDGVYGNLNCILFDHQTPKVYVLTNENQLFYKQEMMRSLSVNNNNNKTDGFKFSIWGPTCDGLDCVSSLAKLSKNVQVGDWLFFENVGAYTSCASTKFNGLSSGETKTLYVNSNEE

SEQ ID NO: 11994 - protein, 259 aa, Chlamydomonas reinhardtii
MAVDREECVYMAKLAEQAERYDEMVEEMKKVAKLVHDQELSVEERNLLSVAYKNVIGARRASWRIISSIEQKEEAKGNEEHVQRIRKYRTVVEEELSKICASILQLLDDHLIPTASTGESKVFYLKMKGDYHRYLAEFKTGADRKEAAEHTLLAYKAAQDIALVDLPPTHPIRLGLALNFSVFYYEILNSPERACHLAKQAFDEAIAELDSLGEESYKDSTLIMQLLRDNLTLWTSDMQDPAAGDDREGADMKVEDAEP

SEQ ID NO: 11995 - protein, 252 aa, Dictyostelium discoideum
MTREENVYMAKLAEQAERYEEMVETMKKVAELDVELTVEERNLLSVAYKNVIGARRASWRIISSIEQKEESKGNENHVKKIKEYKCKVEKELTDICNDILEVLESHLIVSSASGESKVFYYKMKGDYFRYLAEFATGNPRKTSAESSLIAYKAASDIAVTELPPTHPIRLGLALNFSVFYYEILNSPDRACNLAKTAFDDAIAELDTLSEDSYKDSTLIMQLLRDNLTLWTSDVHNMEKNQDGDDDQNEPGM

SEQ ID NO: 11996 - protein, 267 aa, Arabidopsis thaliana
MATPGASSARDEFVYMAKLAEQAERYEEMVEFMEKVAKAVDKDELTVEERNLLSVAYKNVIGARRASWRIISSIEQKEESRGNDDHVSLIRDYRSKIETELSDICDGILKLLDTILVPAAASGDSKVFYLKMKGDYHRYLAEFKSGQERKDAAEHTLTAYKAAQDIANSELAPTHPIRLGLALNFSVFYYEILNSPDRACNLAKQAFDEAIAELDTLGEESYKDSTLIMQLLRDNLTLWASDMQDDVADDIKEAAPAAAKPADEQQS

SEQ ID NO: 11997 - protein, 279 aa, Mus musculus
NSMKVAQWMIQEPHRAATFFGCIGIDKFGEILKSKAADAHVDAHYYEQNEQPTGTCAACITGGNRSLVANLRAANCYKKEKHLDLENNWMLVEKARVYYIAGFFLTVSPESVLKVARYAAENNRTFTLNLSAPFISQFFKEALMAVMPYVDILFGNETEAATFAREQGFETKDIKEIARKTQALPKVNSKRQRTVIFRNQGRDDTIVATGNDVTAFPVLDENQEEIVDTNGAGDAFVGGFLSQLVSNKPLTECIRAGHYAASVIIRRTGCTFPEKPNFH

SEQ ID NO: 11998 - protein, 316 aa, Oryctolagus cuniculus
MATHLVLYNGAKMPILGLGTWKSPPGQVTEAVKTAIDLGYRHIDCAHVYQNENEVGVALQEKLKEQVVKREELFIVSKLWCTSHDKSLVKGACQKTLNDLKLDYLDLYLIHWPTGFKHGSEYFPLDAAGNVIPSDTDFLDTWEAMEGLVDEGLVKSIGVSNFNHLQIERILNKPGLKYKPAVNQIECHPYLTQEKLIQYCHSKGIVVTAYSPLGSPDRPWAKPEDPSLLEDPRIKAIADKHKKTTAQVLIRFPMQRNLVVIPKSVTPARIAENFQVFDFELSSEDMTTLLSYNRNWRVCALVSCASHKDYPFHAEF

SEQ ID NO: 11999 - protein, 325 aa, Sus scrofa
MAASCVLLHTGQKMPLIGLGTWKSEPGQVKAAIKYALTVGYRHIDCAAIYGNELEIGEALTETVGPGKAVPREELFVTSKLWNTKHHPEDVEPALRKTLADLQLEYLDLYLMHWPYAFERGDNPFPKNADGTIRYDATHYKDTWKALEALVAKGLVRALGLSNFSSRQIDDVLSVASVRPAVLQVECHPYLAQNELIAHCQARGLEVTAYSPLGSSDRAWRDPNEPVLLEEPVVQALAEKYNRSPAQILLRWQVQRKVICIPKSVTPSRIPQNIQVFDFTFSPEEMKQLDALNKNLRFIVPMLTVDGKRVPRDAGHPLYPFNDPY

SEQ ID NO: 12000 - protein, 282 aa, Candida tropicalis
MDSSSYWSYDNIVPSFRLDGKLVIITGGSGGLSAVVSRALLAKGADIALIDMNLERTQQAARDVLQWGEEQMKGKHESPIGQVSAWSCNIGDAEAVELTFKAINEHHGKVASVLINTAGYAENFPAEEYPAKNAENIMKVNGLGSFYVSQAFARPLIQNNMTGSIILIGSMSGTIVNDPQPQCMYNMSKAGVIHLARSLACEWAKYNIRVNTLSPGYILTPLTRNVISGHTEMKTEWESKIPMKRMAEPKEFVGSILYLASDSASSYTTGHNLVVDGGYECW

SEQ ID NO: 12001 - protein, 278 aa, Pichia stipitis
MDYSYANVVPNFRLDGRLAIITGGSGGLAAVISRALLAQGADVALIDMNLERTKSAAKEVLGWGEETLKGEHASAIGQVSAWSCNIGDAEAVDATFSSINEHHGKIADLLINTAGYCENFPAETYPATNAESIMKVNGLGSFYVSQSFARPLIQNNLRGSIILIGSMSGTIVNDPQPQCMYNMSKAGVIHLVRSLACEWAKYNIRVNTLSPGYILTPLTRNVISGHTEMKEAWESKIPMKRMAEPKEFVGSILYLASETASSYTTGHNLVVDGGYECW

SEQ ID NO: 12002 - protein, 132 aa, Leishmania major
MATPRSAKKAARKSSTKSAKAGLIFPVGRVGGMMRRGQYARRIGSSGAVYLAAVLEYLTAELLELSVKAAAQSGKKRCRLSPRTVMLAARHDDDISSLLRKVTLSHSGVVPSASKAVAKKKGGKKGKATPSA

SEQ ID NO: 12003 - protein, 1048 aa, Ipomoea batatas
MAGNDWINSYLEAILDVGPGIDDAKSSLLLRERGRFSPTRYFVEEVITGFDETDLHRSWVRAQATRSPQERNTRLENMCWRIWNLARQKKQLEGEQAQRLAKRRQERERGRREAVADMSEDLSEGEKGDAISDISAHGESIKGRLPRISSVETMESWANQQKGKKLYIVLISLHGLIRGENMELGRDSDTGGQVKYVVELARALGSMPGVYRVDLLTRQVSSPEVDWSYGEPTEMLTPINSEGLMTEMGESSGAYIIRIPFGPRDKYIPKEDLWPYIPEFVDGALNHILHVSKVLGGQIGSGRDVWPVAIHGHYADAGDSAALLSGALNVPMLFTGHSLGRDKLEQLLRQGRLSKDEINSTYKIMRRIEAEELSLDASEIVITSTRQEIDEQWRLYDGFDPILERKLRARIKRNVSCYGRFMPRMVVIPPGMEFHHIVPHEGDMDFETEGSEDGKAPDPHIWTEIMRFFSNPRKPMILALARPDPKKNLTTLVKAFGECRPLRELANLTLIMGNRDNIDEMSSTNASVLLSILKMIDKYDLYGQVAYPKHHKQSEVPDIYRLAAKTKGVFINPAFIEPFGLTLIEAAAHGLPIVATKNGGPVDIHRGSDNGLLVDPHDQHAIADALLKLVADKHLWAKCRANGLKNIHLFSWPEHCKTYLSRIAGCKPRQPCWLRNADDDENSESESPSDSLRDIQDISLNLKFSLDGDKNEDSDNLFDPDDRKNKLENAVLAWSKGVKGTHKTSIDKIDQSSSAGKFPALRRRKQIFVIAVDCDSSTGLFENVRKIFAAVEAEGMEGSIGFHIGHFIQYIRSAFFSDFRGHESTDFDAFICNSGGDLYYSSSHSEDNPFVVDLYYHSHIEYRWGGEGLRKTLVRWAASISDKKGEKEEHIVVEDEKNSADYCYTFKVQKSGGDPSVKELRKSMRIQALRCHVVYCQNGSRINVIPVLSSRSQALRYLYLRWGMDLSKLVVFVGESGDTDYEGLLGGLRKAVILKGVCSVSSSQLLSNRNYPLTDVVPYNSPNVIQTTEECSSSELHASLEKLAVLKG

SEQ ID NO: 12004 - protein, 583 aa, Oryza sativa; identical to SEQ ID NO: 3146

SEQ ID NO: 12005 - protein, 595 aa, Corynebacterium glutamicum
MTTSDPNPKPIVEDAQPEQITATEELAGLLENPTNLEGKLADAEEEIILEGEDTQASLNWSVIVPALVIVLATVVWGIGFKDSFTNFASSALSAVVDNLGWAFILFGTVFVFFIVVIAASKFGTIRLGRIDEAPEFRTVSWISMMFAAGMGIGLMFYGTTEPLTFYRNGVPGHDEHNVGVAMSTTMFHWTLHPWAIYAIVGLAIAYSTFRVGRKQLLSSAFVPLIGEKGAEGWLGKLIDILAIIATVFGTACSLGLGALQIGAGLSAANIIEDPSDWTIVGIVSVLTLAFIFSAISGVGKGIQYLSNANMVLAALLAIFVFVVGPTVSILNLLPGSIGNYLSNFFQMAGRTAMSADGTAGEWLGSWTIFYWAWWISWSPFVGMFLARISRGRSIREFILGVLLVPAGVSTVWFSIFGGTAIVFEQNGESIWGDGAAEEQLFGLLHALPGGQIMGIIAMILLGTFFITSADSASTVMGTMSQHGQLEANKWVTAAWGVATAAIGLTLLLSGGDNALSNLQNVTIVAATPFLFVVIGLMFALVKDLSNDVIYLEYREQQRFNARLARERRVHNEHRKRELAAKRRRERKASGAGKRR

SEQ ID NO: 12006 - protein, 148 aa, Xenopus laevis
ARGDSYVDLSQYRDQHFRGNRSDQESLLKQSCTLYVGNLSFYTTEEQIHELFSKSGDVKRIVMGLDKVKKTACGFCFVEYYTRADAGTAMRFINGTRLDDRIVRTDWDAGFKEGRQYGRGKSGGQVRDEYRQDYDAGRGGYGKVVQSF

SEQ ID NO: 12007 - protein, 301 aa, Trypanosoma congolense
MGSRYQRLEKIGEGSYGVVYRARDITTDVIVALKRIRLESVEEGVPCTAIREISILKELRHENIVRLLDVCHSENRLNLVFEYMEMDLKKYMDRASGNLDPATIQEFMRSLLKGVRFCHERNVLHRDLKPPNLLISREKELKLADFGLGRAFGIPVKKYTHEVVTLWYRSPDVLLGSTQYGTPVDIWSVGCIFAEMAIGAPLFAGKNDADQLLRIFRFLGTPSSQVWPSMNLYPNSTNMLSKPEFQQNLIATCDEQFQTHPAYAKLGPQGIDLLRRLLRYEPGERLTAAQALEHPYFSVEF

SEQ ID NO: 12008 - protein, 345 aa, Trypanosoma brucei brucei
MQVQVQEGQTACDGSLRPLPSAGPASFVPRSLRPAPLRGTSTPDRYSRIEKVGEGSYGIVYKCHDNFTGRTVAMKRIPLIVNDGGVPSTAVREVSLLRELNHPYVVRLLDVVLHEAKLLLIFEYMEQDLQGMLKQRNTAFVGGKLRRIMFQLLLGLHECHSRRFVHRDIKPSNILIDRKESVVKLADFGLGRAFRVPLQTYTTEVMTLWYRAPEVLLGDKQYLPAVDVWSMGCVFAELARRRSLFAGDTAINQLFSIFQLLGTPTEATWRGVTSLPHHNVNFPRWTAKPLRTAVPALDDDGVDLLRRMLCYNPRERITAYEALQHSYFDEVREEEVEKLMRFNGA

SEQ ID NO: 12009 - protein, 311 aa, Trypanosoma brucei brucei
MTMLGALTGRQLSSGLKDQFDRYNRMDILGEGTYGVVYRAVDRATGQIVALKKVRLDRTDEGIPQTALREVSILQEIHHPNIVNLLDVICADGKLYLIFEYVDHDLKKALEKRGGAFTGTTLKKIIYQLLEGLSFCHRHRIVHRDLKPANILVTTDNSVKIADFGLARAFQIPMHTYTHEVVTLWYRAPEILLGEKHYTPAVDMWSIGCIFAELARGKVLFRGDSEIGQLFEIFQVLGTPMDAEGSWLGVSSLPDYRDVFPKWSGKPLTQVLPTLDGDAVDLLSQMLRYNPAERISAKAALQHPWFSDAMF

SEQ ID NO: 12010 - protein, 324 aa, Ajellomyces capsulatus
MENYQKIEKIGEGTYGVVYKARDLTHPNRIVALKKIRLEAEDEGVPSTAIREISLLKEMHDPNIVRLLNIVHADGHKLYLVFEFLDLDLKKYMEALPVSEGGRGKALPDGSTLDMNRLGLGEAMVKKFMAQLVEGIRYCHSHRVLHRDLKPQNLLIDREGNLKLADFGLARAFGVPLRTYTHEVVTLWYRAPEILLGGRQYSTGVDMWSVGAIFAEMCTRKPLFPGDSEIDEIFKIFKLLGTPDENTWPGVTSFPDFKASFPKWKREDTRKLVPGLERNGLDLLDAMLEYDPARRISAKQACMHPYFQAGSSAYSGRERLQPYP

SEQ ID NO: 12011 - protein, 302 aa, Carassius auratus
MDDYLKIEKIGEGTYGVVYKGRNKTTGQVVAMKKIRLESEEEGVPSTAVREISLLKELQHPNVVRLLDVLMQESKLYLVFEFLSMDLKKYLDSIPSGQFMDPMLVKSYLYQILEGILFCHCRRVLHRDLKPQNLLIDNKGVIKLADFGLARAFGVPVRVYTHEVVTLWYRAPEVLLGASRYSTPVDVWSIGTIFAELATKKPLFHGDSEIDQLFRIFRTLGTPNNEVWPDVESLPDYKNTFPKWKSGNLASTVKNLDKNGIDLLTKMLIYDPPKRISARQAMTHPYFDDLDKSTLPASNLKI

SEQ ID NO: 12012 - protein, 294 aa, Vigna unguiculata
MEQYEKVEKIGEGTYGVVYKARDRVTDETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCLFAEMVNRRPLFPGDSEIDELFKIFRILGTPNEETWPGVTALPDFKSTFPKWPPKDLATMVPNLDAAGLNLLSSMLSLDPSKRITARIAVEHEYFKDIKFVP

SEQ ID NO: 12013 - protein, 684 aa, Candida albicans
MPSCDDTASSDTDCQSQVSSTAHLHSYRSNGLVEPPSKRRLTTTNETSLSSAGATTFQIESPGSISAITTNNSTTSAGDSNNSNSFSDQHSRHPRTPNAMNSPTHTPISDIEEDPIQQLPLPSPSASPIQSDTENEHVTTPDSLQGKANLDSIENVMSNEPTTQSELVDLVTKLSGFLSEANQNHLVFKLLQKTTRPTLSTFNNLINNSLKRDILSNVPFEVTMKILSYLDYKTLLSVAQVCKKWFDIINNPDTWIKLLKRDKLITDDAVIKYELQYPDQLLREWSTLPEINSAQVLYKKRKIIVNRWMDPKFKPHRISVSGHGNKVVTCLQHDDEKVVTGVDDKCISIYSTQTGQLMKVLEGHEGGVWALKYTGNTLVTGSTDRTVRVWNMKTGQCTHIFRGHTSTIRCLDIIHPAVIGKNQDGEDIVFPEYPLLITGSRDHNIHVWKLPVVDDSQDYIETFEGEFDNPYLIAVLSGHTQSVRSISGYGNIIISGSYDSTVRVWDLLDDGHCTHVLQGHLDRVYSTAIDFHSKTCFSGSMDSNINVWNFETGELKKVLVGHASLVGLLDLVDDVLVSAAADATLRIWDAKTGELRSKLKGHGAAITCFEHDGLRVVSGSEKMLKLWNVEKGTFARDLLSDVTGGIWQVRFDYKRCVAAVQRIINEDEGETFIEILDFSQPLLQ

SEQ ID NO: 12014 - protein, 292 aa, Xenopus laevis
MQKYEKLEKIGEGTYGTVFKAKNRDTHEIVALKRVRLDDDDEGVPSSALREICLLKELKHKNIVRLHDVLHSDKKLTLVFEFCDQDLKKYFDSCNGDLDPEIVKSFMYQLLKGLAFCHSRNVLHRDLKPQNLLINRNGELKLADFGLARAFGIPVRCYSAEVVTLWYRPPDVLFGAKLYSTSIDMWSAGCIFAELANAGRPLFPGNDVDDQLKRIFRLLGTPTEEQWPAMTKLPDYKPYPMYPATMSLVNVVPKLNATGRDLLQNLLKCNPVQRICADEALQHPYFADFCPP

SEQ ID NO: 12015 - protein, 283 aa, Gallus gallus
MAGNFWQSSHYLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLISAATSVLKTRFSYAFPKEFPYRMNHILECEFYLLELMDCCLIVYHPYRPLLQYVQDMGQEDMLLPLAWRIVNDTYRTDLCLLYPPFMIALACLHVACVVQQKDARQWFAELSVDMEKILEIIRVILKLYEQWKNFDERKEMATILSKMPKPKPPPNSEGEQGPNGSQNSSYSQS

SEQ ID NO: 12016 - protein, 407 aa, Gallus gallus
MRRESDCAEEKAPAKGEGGAEGTVRARKRKADVATFLQDPDEEIAKIEMSRKKQYENQLSWNNINKDPHMLIPTPDKDDDPVGVDYSHFIHLNVASTRSSPLPILGWANRDDVWKNMINKEETYVRDKLYMQRHPLLQPKMRTILLDWLMEVCEVYKLYRETFYLAQDFFDRFMATQQNVVKTLLQLIGISSLFIAAKLEEIYPPKLHQFAYVTDGACTEDEILSMELIIMKALNWNLNPLTVVSWLNIYMQVAYLNELYEVLLPQYPQQIFVQIAELLDLCVLDIGCLEYTYGVLAASALYHFSSSELMQKVSGYEWCEIEECVKWMVPFAMAIREVGSSKLKHFRGIAPEDLHNIQTHINSLDLLDKAQAKQAILAEQNRTSPFPTGVLTPPQSSKKQPAGLKPI

SEQ ID NO: 12017 - protein, 408 aa, Xenopus laevis
MPVISNPAVEKSTKDEGTASCSVRSRKRKADVAIFLQDPDETLDSLEMTKKKQYQDRGPWSNEMTCKSPHKLIPTPEKEEHEPNPTNYSHFASLRFSPVSVSPLPRLGWANQDDVWRNMLNKDRIYLRDKNFFQKHPQLQPNMRAILLDWLMEVCEVYKLHRETFYLAQDFFDRFMATQKNVIKSRLQLIGITSLFIAAKLEEIYPPKLHQFSFITDGACTEDEITRMELIIMKDLGWCLSPMTIVSWFNVFLQVAYIRELQQFLRPQFPQEIYIQIVQLLDLCVLDICCLEYPYGVLAASAMYHFSCPELVEKVSGFKVTELQGCIKWLVPFAMAIKEGGKSKLNFFKGVDIEDAHNIQTHSGCLELMEKVYINQALLEEQNRTSPIPTGVLTPPQSNKKQKSDRAD

SEQ ID NO: 12018 - protein, 420 aa, Chlorohydra viridissima
LFFQKKYFLDKQLNQNAIQIYQDNLTNQNNNIGKKAKLEDEKHAHNKSITSKYKRVPLASISNVQGSRIQPTRAAKEKLKPPQNISDSQLVNDSLKSSNSIQAHNTKNDLHKENLYNESALDTFKESPMVFSPFLSDSSCKKYSSLNGIQDIDSKLHEVFELPEYAQDIHNYLKKSEAKYRPKSNYMRKQTDINSSMRAILIDWLVEVSEEYKLIPQTLYLSVSYIDRFLSHMSVLRGKLQLVGAACMLVAAKFEEIYPPEVAEFVYITDDTYTAKQVLRMEHLILKTLAFDLSVPTCRDFLSRYLFAANAKPESQLKYLAEYLSELTLINCDISVKYAPSMIAASSICVANHMLNSIPWTPTLEFYSGYNIQDLRSCLNEIHLLHLAASTNPQQAIQQKYKSPKFGCVSSLVPLEMPCF

SEQ ID NO: 12019 - protein, 361 aa, Hydra vulgaris
SSRTVLSNISNIQRRPQVVGKIKKEDGVALEEKAPLNKGLGRMVSQSNLISDVQLKTTKIIPAYQDIADVEVPINAMINSFTELEVDDIDLEDLGNPTLCAEYLKDIYKYMNKLERRLEPSDYMAHQAEINFKMRSILVDWLIQVQSRFNLLQETLYLTIYIIDRYLSKQNVKRAELQLEGVTAMLIASKYEEMYAPEIGDFVYITDNAYSKEKIRQMEQKMLKTCEYDFSNPLCLHFLRRNSKAGAVDAQKHTLAKYLMELTLVEYEFITKLPSEIAAAALYLALKLIDDSNWTPTLAHYSGYTEDEILSTVSKLSILTLSMDNSKYQAVKNKYSASKFLRISLIPQLKGHILSKFAERN

SEQ ID NO: 12020 - protein, 292 aa, Gallus gallus
MEHQLQCCEVETIRRAYLDANLLNDRVLQTMLKAEETCSPSVSYFKCVQKEILPYMRKIVATWMLEVCEEQKCEEEVFPLAMNYLDRFLSFEPLKKSRLQLLGATCMFVASKMKETIPLTAEKLCIYTDNSIRPDELLQMELLLVNKLKWNLAAMTPHDFIEHFLTKMPLAEDTKQIIRKHAQTFVALCATDVKFISNPPSMIAAGSVVAAVQGLHLGNTNTFLSYQCLTHFLSQVIKCDPDCLRACQEQIESLLESSLRQAQQHNVSSETKTVEDEADLSCTPTDVRDVNI

SEQ ID NO: 12021 - protein, 291 aa, Xenopus laevis
MELLCCEVDTIGRAHLDRNLITDRVLQTMLKAEETSCPSMSYFKCVQKEILPNMRKIVATWMLEVCEEQKCEEEVFPLAMNYLDRFLSVEPLRKSWLQLLGATCMFLASKMKETIPLTAEKLCIYTDNSIRPDELLIMELRVLNKLKWDLASVTPHDFIEHFLNKMPLTEDTKQIIRKHAQTFVALCATDVNFISNPPSMIAAGSVAAAVQGLNLGNADSVFSTQRLTLFLSQVIKCDPDCLRACQEQIESLLESSLRQAQQQHNASSDTKNMVDEVDISCTPTDVRDVNI

SEQ ID NO: 12022 - protein, 323 aa, Homo sapiens
MDPKYQRVELNDGHFMPVLGFGTYAPPEVPRNRAVEVTKLAIEAGFRHIDSAYLYNNEEQVGLAIRSKIADGSVKREDIFYTSKLWCTFFQPQMVQPALESSLKKLQLDYVDLYLLHFPMALKPGETPLPKDENGKVIFDTVDLSATWEVMEKCKDAGLAKSIGVSNFNCRQLEMILNKPGLKYKPVCNQVECHPYLNQSKLLDFCKSKDIVLVAHSALGTQRHKLWVDPNSPVLLEDPVLCALAKKHKRTPALIALRYQLQRGVVVLAKSYNEQRIRENIQVFEFQLTSEDMKVLDGLNRNYRYVVMDFLMDHPDYPFSDEY

SEQ ID NO: 12023 - protein, 402 aa, Brassica oleracea
MQSSAVFSASPSLPLLKPGRLSLRHPVTASSNLSVSPPNVVSVPPLPRRSWRLASSDSPLRAWSGLPSVSSPSLDTNRFKTAATAVPEEGEGSGKMTKVLELGLLFAMWYLFNIYFNIYNKQVLKALHAPMTVTLVQFAVGSVLITFMWALNLYKRPKISAAQLAAILPLAVVHTLGNLFTNMSLGKVSVSFTHTIKAMEPFFSVVLSAMFLGEVPTPWVIGSIIPIVGGVALASVTEVSFNWAGFLSAMASNLTNQSRNVLSKKVMVKKDDSLDNITLFSIITLMSLFLMAPVTFFSEGIKFTPSYIQSAGVNVQQIYTKSLIAALCFHAYQQVSYMILARVSPVTHSVGNCVKRVVVIVSSVIFFKTPVSPVNAFGTGIALAGVFLYSRVKRIKPKPKTA

SEQ ID NO: 12024 - protein, 602 aa, Daucus carota
MGICVSKPSPEPDLHNHHTSIPVNDTSLPPQDNSIPPKDIAIPAQDNNKPPGKKSPFLPFYSPSPAHFLFSKKSPAVGSPAAGSSNSTPKRLFPFPPPSPAKHIKAAWARRHGSVKPNEAAIPENNEVDGGAGLDKSFGFSKKFGSKFEVGEEVGRGHFGYTCRAKFKKGEFKGQDVAVKVIPKAKMTTAIAIEDVRREVKILRALTGHNNLVQFYDAFEDHTNVYVVMELCEGGELLDRILSRGGKYTEDDAKAVMIQILNVVAFCHLQGVVHRDLKPENFLFKSKDEDSQLKAIDFGLSDYVKPDERLNDIVGSAYYVAPEVLHRSYSTEADVWSIGVISYILLCGSRPFWARTESGIFRAVLKANLSFDEPPWPSVSSEAKDFVKRLLNKDPRKRMTAAQALCHSWIKNSNDIKFPLDILVFKLMKVYMRSSPLRKAALRALSKTLTVDELFYLKEQFVLLEPTKNGTISLENIKQALMRNSTDAMKDSRVLDLLVSLNALQYRRMDFEEFCAAALSVHQLEALDRWEQHARCAYDLFEKDGNRAIMIEELASELGLGPSIPVHAVLHDWIRHTDGKLSFLGYVKLLHGVSTRAIAKAQ

SEQ ID NO: 12025 - protein, 324 aa, Rana catesbeiana
MTLTKETRVTLNDGNMMPILGLGTYAAPDVPKSLAEEAVKTAIDVGYRHIDCAFITGNEMHIGNGIRSKISDGTVKREDIFYTGKLWCTYFSPDMVRKGLERSLRDVGMDYLDLFLMHWPVSLKPSGASDPSDKDKPFIYDNVDLCATWEALEARKDAGLVRSLGVSNFNRRQLERILNKPGLKYKPVCNQVECHVYLNQNKLHSYCKSKDIVLVTYSVLGSHRDRNWVDLSLPVLLDDPILNKIAAKYNRTSAEVAMRFILQKGIVVLAKSFTPARIKQNLGVFEFELKPEDMKTLESLDRNLHYGPFREVKQHPEYPFHDEY

SEQ ID NO: 12026 - protein, 497 aa, Danio rerio
MEYHSVGPGGVVVTGNNVPAFLTKLWTLVEDPDTDPLICWSPNGTSFHVFDQGRFSKEVLPKYFKHNNMASFVRQLNMYGFRKVVHIEQGGLVKPEKDDTEFQHPYFIRGQEQLLENIKRKVTTVSNIKHEDYKFSTDDVSKMISDVQHMKGKQESMDSKISTLKHENEMLWREVATLRQKHSQQQKVVNKLIQFLITLARSNRVLGVKRKMPLMLNDSSSAHSMPKFSRQYSLESPAPSSTAFTGTGVFSPEPPVKTGPIISDITELAQSSPVATDEWIEDRTSPLVHIKEEPSSPAHSPEVEEVCPVEVEVGAGSDLPVDTPLSPTTFINSILQESEPVSALTPPPSEQKCLSVACLDKTELHDHLESIDSGLENLQQILNAQSINFDSSPLFDIFSSAASDVGLDSLASIQDLLSPDPVKETESGLDTDSGKQLVQYTSQPIVLPDPLSTDSSSTDLPMLLELQDDSYFSSEPAEDPTIALLNLQPVPEDPKLS

SEQ ID NO: 12027 - protein, 323 aa, Xenopus laevis
MYHNSTQKKHWTFLSEDEPLRRRIQANVRYRARIRATEKPRLSEIFSLEPHEELAICKYYEKRLLDFCNAFKPTMPKSVLGTACMYFKRFYLNNSVMEHHPRIIMLTCVFLACKVDEFNVSSIQFVGNLGENPLGQEKILEQILEYELLLIQQLNFHLIVHNPYRPFEGFLIDVKTRYPMLENPEVLRKSADEFLNRVALTDACLLFAPSVIALTAILSTASRAGLNMESYLTECLSLKDNQETMSHLLDGMRRLKILVSKYEPARPEEVAALKKRLDHCHSTEVTLSVHGRKRKGYEDDGYISKKPKTEEDEWTDEDFGDSL

SEQ ID NO: 12028 - protein, 152 aa, Onchocerca volvulus
VVSTSPTKLVNVSYNNLTVNLGNELTPTQVKNQPTKVSWDAEPGALYTLVMTDPDAPSRKNPVFREWHHWLIINISGQNVSSGTVLSDYIGSGPPKGTGLHRYVFLVYKQPGSITDTQHGGNRPNFKVMDFANKHHLGNPVAGNFFQAKHED

SEQ ID NO: 12029 - protein, 114 aa, Onchocerca volvulus
WDAEPGALYTLVMTDPDVPSRKNPVFREWHHWLIINISGQNVSSGTVLSDYIGSGPPKGTGLHRYVFLVYKQPGSITDTQHGGNRRNFKVMDFANKHHLGNPVAGNFFQAKHED

SEQ ID NO: 12030 - protein, 134 aa, Onchocerca volvulus
VNLGNELTPTQVKNQPTKVSWDAEPGALYTLVMTDPDAPSRKNPVFREWHHWLIINISGQNVSSGTVLSDYIGSGQPKGTGLHRYVFLVYKQPGSITDTQHGGNRPNFKVMDFANKHHLGNPVAGNFFQAKHED

SEQ ID NO: 12031 - protein, 441 aa, Bacillus subtilis
MTLFLHGTSRQNQHGHLEIGGVDALYLAEKYGTPLYVYDVALIRERAKSFKQAFISAGLKAQVAYASKAFSSVAMIQLAEEEGLSLDVVSGGELYTAVAAGFPAERIHFHGNNKSREELRMALEHRIGCIVVDNFYEIALLEDLCKETGHSIDVLLRITPGVEAHTHDYITTGQEDSKFGFDLHNGQTERAIEQVLQSEHIQLLGVHCHIGSQIFDTAGFVLAAEKIFKKLDEWRDSYSFVSKVLNLGGGFGIRYTEDDEPLHATEYVEKIIEAVKENASRYGFDIPEIWIEPGRSLVGDAGTTLYTVGSQKEVPGVRQYVAVDGGMNDNIRPALYQAKYEAAAANRIGEAHDKTVSIAGKCCESGDMLIWDIDLPEVKEGDLLAVFCTGAYGYSMANNYNRIPRPAVVFVENGEAHLVVKRETYEDIVKLDLPFKTGVKQ

SEQ ID NO: 12032 - protein, 502 aa, Lycopersicon esculentum
MVLTTTSIRDSEESLHCTFASRYVQEPLPKFKMPKKSMPKEAAYQIVNDELMLDGNPRLNLASFVSTWMEPECDKLIMSSINKNYVDMDEYPVTTELQNRCVNMLAHLFHAPVGDDETAVGVGTVGSSEAIMLAGLAFKRKWQSKRKAEGKPFDKPNIVTGANVQVCWEKFARYFEVELKEVKLKEGYYVMDPAKAVEIVDENTICVAAILGSTLTGEFEDVKLLNELLTKKNKETGWETPIHVDAASGGFIAPFLWPDLEWDFRLPLVKSINVSGHKYGLVYAGVGWVIWRSKEDLPDELVFHINYLGSDQPTFTLNFSKGSYQIIAQYYQLIRLGFEGYKNVMKNCLSNAKVLTEGITKMGRFDIVSKDVGVPVVAFSLRDSSKYTVFEVSEHLRRFGWIVPAYTMPPDAEHIAVLRVVIREDFSHSLAERLVSDIEKILSELDTQPPRLPTKAVRVTAEEVRDDKGDGLHHFHMDTVETQKDIIKHWRKIAGKKTSGVC

SEQ ID NO: 12033 - protein, 413 aa, Lycopersicon esculentum
MESDIKNETSFQELDMILTQYLETLSERKKYHIGYPINMCYEHHATLAPLLQFHLNNCGDPFTQHPTDFHSKDFEVAVLDWFAQLWEIEKDEYWGYITSGGTEGNLHGFWLGRRELLPNGYLYASKDSHYSIFKAARMYRMELQTINTLVNGEIDYEDLQSKLLVNKNKPAIININIGTTFKGAIDDLDFVIQTLENCGYSNDNYYIHCDRALCGLILPFIKHAKKITFKKPIGSISISGHKFLGCPMSCGVQITRRSYVSTLSKIEYINSADATISGSRNGFTPIFLWYCLSKKGHARLQQDSITCIENARYLKDRLLEAGISVMLNDFSITVVFERPCDHKFIRRWNLCCLRGMAHVVIMPGITRETIDSFFKDLMQERNYKWYQDVKALPPCLADDLALNCMCSNKKMHN

SEQ ID NO: 12034 - protein, 431 aa, Datura stramonium
MAGQTVIVSGLNPAAILQSTIGGATPAPAAENDHTRKVVPLSRDALQDFMVSIITQKLQDEKQPFYVLDLGEVVSLMDQWNAGLPNIRPFYAVKCNPEPSFLSMLSAMGSNFDCASRAEIEYVLSLGISPDRIVFANPCKPESDIIFAAKVGVNLTTFDSEDEVYKIRKHHPKCELLLRIKPMDDGNARCPMGPKYGALPEEVEPLLRTAQAARLTVSGVSFHIGSGDADSKAYLGAIAAAKGVFETAARFGMSKMTVLDIGGGFTSGHQFTTASAAVRSALEQHFHDEQELTIIAEPGRFFAETAFTLATTIIGKRVRGELREYWINDGLYGSMNCVLYDHATVNATPLACMSNRSNLNCGGSKTFPSTVFGPTCDALDTVLRDYQLPELQVNDWLIFPNMGAYTKAAGSNFNGFNTSAIVTHLAYAYPS

SEQ ID NO: 12035 - protein, 435 aa, Panagrellus redivivus
MTLTGCVDYYEIIAGTKVAVCRNAIDNKTVATAIAATRTVNGNDDPFVVMNVSTIMAKVIQWQRTMPRVAPCYAVKCNDDKVLLRTLADLGMGFDCASKAEIEKVIGLVGPEKIVYANPCKTRGFIAHAEAAGVKRMTFDSVEELTKIKQNHADPSLILRISVSDPTAQCQLGIKFGCDPETVAPKLLRKAADMGMNVIGISFHVGSGCNEPATFRTALEYARGLFDLGISLGLSMTLLDIGGGFPGVDTAHISLDACAAVINPALEELFPLDSCPDVEVIAEPGRYFACAAVSVTTNVIASVKVPASRITEKADDVNRDGYMYYMNDGVYGSFNCKLFDHYQPRGMPLAEHDADEPRFPVCVWGPTCDGLDQVEESSVMPRLYEGDWLYYPDMGAYTSVAASTFNGFDKPKTYYFIDEATLGSIVRKADSAPRG

SEQ ID NO: 12036 - protein, 309 aa, Arabidopsis thaliana
MSSSAKKQTLFISTLIISWYSSNIGVLLLNKFLLSNYGFKFPIFLTMCHMSACAILSYISIVFLKLVPLQHLKSRSQFLKVATLSIVFCASVVGGNISLRYLPVSFNQAVGATTPFFTALFAYLMTFKREAWVTYGALVPVVAGVVIASGGEPGFHWFGFIMCISATAARAFKSVLQGILLSSEGEKLNSMNLMLYMSPVAVIALLPVTLFMEPDVISVTLTLAKQHQYMWILLLVNSVMAYSANLLNFLVTKHTSALTLQVLGNAKGAVAVVISILIFQNPVTVMGIGGYSITVLGVVAYGETKRRFR

SEQ ID NO: 12037 - protein, 436 aa, Entamoeba histolytica [sequence omitted]

SEQ ID NO: 12038 - protein, 434 aa, Streptococcus thermophilus
MSIITDVYAREVLDSRGNPTLEVEVYTESGAFGRGMVPSGASTGEHEAVELRDGDKARYGGLGTQKAVDNVNNVIAEHIIGFDVRDQQGIDRAMIALDGTPNKGKLGANAILGVSIAAARAAADYLEVPLYSYLGGFNTKVLPTPMMNIINGGSHSDAPIAFQEFMIVPAGAPTFKEALRWGAEIFHALKKILKERGLETAVGDEGGFAPRFDGTEDGVETIIKAIEAAGYVPGKDVFIGLDCASSEFYDAERKVYDYTKFEGEGAAVRTAAEQIDYLEELVNKYPIITIEDGMDENDWDGWKALTERLGDKVQLVGDDFFVTNTAYLEKGIAEHAANSILIKVNQIGTLTETFDAIEMAKEAGYTAVVSHRSGETEDSTIADIAVATNAGQIKTGSLSRTDRIAKYNQLLRIEDQLGEVAEYRGLKSFYNLKK

SEQ ID NO: 12039 - protein, 364 aa, Candida glabrata
MDLVLETLDHYIFDDVYAKIAPVELQRGIDDSLVNALSLNKIVSNSTLLHETLSITNSLKRVNKDVYGLTPFLFDFTEKTYASLLPRNNLIREFFSLWAVVTVFGLLLYLITASLSYVFVFDRTIFNHPKYLKNQMYLEIKLAVSAIPTMSLLTVPWFMLELNGYSKLYYDVDWEHHGLRKLLIEYATFIFFTDCGIYLAHRWLHWPRVYKALHKPHHKWLVCTPFASHAFHPVDGYFQSLSYHIYPMILPLHKISYLILFTFVNFWSVMIHDGQHMSNNPVVNGTACHTVHHLYFNYNYGQFTTLWDRLGGSYRRPEDSLFDPKLKMDKKVLEKQARETAAYIQEVEGDDTDRVYNTDKKKTN

SEQ ID NO: 12040 - protein, 364 aa, Ralstonia eutropha
MPEVQRMTLTQFLIEERRRYPDASGGFNGLILNVAMACKEIARAVAFGALGGLHGKASNQAGEAGAVNVQGEIQQKLDVLSNTTFLRVNEWGGYLAGMASEEMEAPYQIPDHYPRGKYLLVFDPLDGSSNIDVNVSVGSIFSVLRAPEGASAVTEQDFLQPGSAQVAAGYALYGPTTMLVLTVGNGVNGFTLDPNLGEFFLTHPNLQVPADTQEFAINASNSRFWEAPVQRYIAECMAGKSGPRGKDFNMRWIASMVAEAHRILMRGGVFMYPRDSKDPAKPGRLRLLYEANPIAFLMEQAGGRASTGRQTLMSVAPGALHQRIGVIFGSRNEVERIEGYHTDQTDPDLPSPLFNERSLFRASA

SEQ ID NO: 12041 - protein, 338 aa, Sus scrofa
MTDQAAFDTNIVTLTRFVMEEGRKARGTGEMTQLLNSLCTAVKAISTAVRKAGIAHLYGIAGSTNVTGDQVKKLDVLSNDLVINVLKSSFATCVLVSEEDKNAIIVEPEKRGKYVVCFDPLDGSSNIDCLVSIGTIFGIYRKNSTDEPSEKDALQPGRNLVAAGYALYGSATMLVLAMVNGVNCFMLDPAIGEFILVDRDVKIKKKGSIYSINEGYAKEFDPAITEYIQRKKFPPDNSAPYGARYVGSMVADVHRTLVYGGIFMYPANKKSPKGKLRLLYECNPMAYVMEKAGGLATTGKEAVLDIVPTDIHQRAPIILGSPEDVTELLEIYQKHAAK

SEQ ID NO: 12042 - protein, 364 aa, Ralstonia eutropha
MPEVQRMTLTQFLIEERRRYPDASGGFNGLILNVAMACKEIARAVAFGALGGLHGKASTQAGEEGAVNVQGEIQQKLDVLSNTTFLRVNEWGGYLAGMASEEMEAPYQIPENYPRGKYLLVFDPLDGSSNIDVNVSVGSIFSVLRAPEGADTVTEQDFLQPGSAQVAAGYALYGPTTMLVLTVGNGVNGFTLDPNLGEFFLTHPHLRVPPDTQEFAINASNSRFWEAPVQRYIGECMAGKSGPRGKDFNMRWIASMVAEAHRILMRGGVFMYPRDTKDPAKPGRLRLLYEANPIAFLMEQAGGRASTGRQTLMSVAPGALHQRIGVIFGSRNEVERIEGYHTNQTDPDLPSPLFNERSLFRASA

SEQ ID NO: 12043 - protein, 244 aa, Vibrio harveyi
MNLEGKIALVTGASRGIGRAIAELLVERGATVIGTATSEGGAAAISEYLGENGKGLALNVTDVESIEATLKTINDECGAIDILVNNAGITRDNLLMRMKDDEWNDIINTNLTPIYRMSKAVLRGMMKKRAGRIINVGSVVGTMGNAGQTNYAAAKAGVIGFTKSMAREVASRGVTVNTVAPGFIETDMTKALNDDQRAATLSNVPAGRLGDPREIASAVVFLASPEAAYITGETLHVNGGMYMV

SEQ ID NO: 12044 - protein, 162 aa, Dictyostelium discoideum
MSLVKLESSDEKVFEIEKEIACMSVTIKNMIEDIGESDSPIPLPNVTSTILEKVLDYCRHHHQHPSPQGDDKKDEKRLDDIPPYDRDFCKVDQPTLFELILAANYLDIKPLLDVTCKTVANMIRGKTPEEIRKIFNIKNDFTPEEEEQIRKENEWCEDKGGN

SEQ ID NO: 12045 - protein, 569 aa, Arabidopsis thaliana
MEGLIQTRGILSLPASHRSEKVLQPSHGLKQRLFTTNLPALSLSLMVTRNFKPFSKSHLGFRFPTRREAEDSLARRKLRRPRRKCVDEGDTAAMAVSPKIFGVEVTTLKKIVPLGLMFFCILFNYTILRDTKDVLVVTAKGSSAEIIPFLKTWVNVPMAIGFMLLYTKLSNVLSKKALFYTVIVPFIVYFGAFGFVMYPRSNLIQPEALADKLLATLGPRFMGPLAIMRIWSFCLFYVMAELWGSVVVSVLFWGFANQITTVDEAKKFYPLFGLGANVALIFSGRTVKYFSNMRKNLGPGVDGWAVSLKAMMSIVVGMGLAICFLYWWVNRYVPLPTRSKKKKVKPQMGTMESLKFLVSSPYIRDLATLVVAYGISINLVEVTWKSKLKSQFPSPNEYSAFMGDFSTCTGIATFTMMLLSQYVFKKYGWGVAAKITPTVLLLTGVAFFSLILFGGPFAPLVAKLGMTPLLAAVYVVPPEVSSARVQVQHSSTPSAMQECLYPLDEVSKVKAKLQLMWSATIGKSGGALIQQFMILTFGSLANSTPYLGVILLGIVTAWLAAAKSLEGPV

SEQ ID NO: 12046 - protein, 105 aa, Methanosarcina barkeri
MQMIRAIIRPGMETKVIECLEKEGCISLTKMEVFGRGKQKGIHIADISYDELQKTMLLMVVEDEHKDRAIKTIMESARTGKYGDGRIFVTPVEEAYTIRTGKPGL

SEQ ID NO: 12047 - protein, 105 aa, Methanobacterium ivanovii
MKMIRAILRPDKVEEVVDALSNAGHVALTKMDVIGRGKQKGIRLDNIYYDELPKVMLLLVTPSEEIDDIIEIINETAFTGNFGDGKIFISPVEEAYTVRTRSKGL

SEQ ID NO: 12048 - protein, 123 aa, Methanosarcina barkeri
MKEVTAVVRPNKMSVTKDALDKIGYRRMTAIPVLGKGKQRGISGELNFYIQPKLLAKRYSTGMKYIPKRLLSIVVNDEDVDQVIKTIIGVNQTAQIGDGKIFVESIDEVIRIRTGEKGELALK

SEQ ID NO: 12049 - protein, 122 aa, Methanobacterium ivanovii
MKEIIAIIRPNKINRTKEVLDALGFSSMTANAVFGRGRQKAIVGEVTFAIQNKDLREEEGSMRYIPKRMISLVVPDEDASLVVESIMKVNKTGQIGDGKIFVCPIEDAVRVRTKESGEDAIL

SEQ ID NO: 12050 - protein, 105 aa, Methanosarcina barkeri
MKMVRAILRPEWTEEVTDGLAEAGYYSLTKINVFGRGKQKGITVGDVHYDELAKTMIMMAVEDEAVDKVIKIISGKAYTGNMGDGKIFVNTIEAAYTISSGEKGL

SEQ ID NO: 12051 - protein, 125 aa, Methanosarcina barkeri
MKEITAIIRMNKAQRTKDVLLECGFPSFTIRRVMGRGKQRGLCHEFNPPLPDPEKEAETCIRFIPKRMFTIVVDDENVSEVVQKIIEVNQTGNAGDGKIFVSDVTEAIRIRTGESGEATVNKELV

SEQ ID NO: 12052 - protein, 112 aa, Oryza sativa
MALAKAKETVASAPVVVYSKSYCPFCVRVKKLFGQLGATFKAIELDGESDGSELQSALAEWTGQRTVPNVFINGKHIGGCDDTLALNNEGKLVPLLTEAGAIASSAKTTITA

SEQ ID NO: 12053 - protein, 102 aa, Ricinus communis
MAMTKTKELVSSNAVVVFSKTYCPYCTSVKKLLDQLGAKYKVVELDTESDGSEIQTALAEWTGQRTVPNVFIGGKHIGGCDSTTAKHSQGQLVPLLTEAGAV

SEQ ID NO: 12054 - protein, 256 aa, Gluconobacter oxydans
MSHPDLFSLSGARALVTGASRGIGLTLAKGLARYGAEVVLNGRNAESLDSAQSGFEAEGLKASTAVFDVTDQDAVIDGVAAIERDMGPIDILINNAGIQRRAPLEEFSRKDWDDLMSTNVNAVFFVGQAVARHMIPRGRGKIVNICSVQSELARPGIAPYTATKGAVKNLTKGMATDWGRHGLQINGLAPGYFATEMTERLVADEEFTDWLCKRTPAGRWGQVEELVGAAVFLSSRASSFVNGQVLMVDGGITVSL

SEQ ID NO: 12055 - protein, 125 aa, Chironomus thummi thummi
MSGRGKGGKVKAKAKSRSSRAGLQFPVGRIHRLLRKGHYAERIGAGAPVYLAAVMEYLGAEILELAGNAARDNKKTRIIPRHLQLAIRNDEELNKLLSGVTIAQGGVLPNIQAVLLPKKTESKKA

SEQ ID NO: 12056 - protein, 129 aa, Chlamydomonas reinhardtii
MAGRGKGKTSGKKAVSRSAKAGLQFPVGRIARYLKKGKYAERIGAGAPVYLAAVLEYLTAEVLELAGNAARDNKKNRIVPRHIQLAIRNDEELGKLLGEVTIASGGVLPNIHAVLLPKKTKGGKGEETA

SEQ ID NO: 12057 - protein, 103 aa, Chlamydomonas reinhardtii
MSGRGKGGKGLGKGGAKRHRKVLRDNIQGITKPAIRRLARRGGVKRISGLIYEETRTVLKTFLENVIRDSVTYTEHARRKTVTAMDVVYALKRQGRTLYGFGG

SEQ ID NO: 12058 - protein, 267 aa, Clostridium sordellii
MNKLENKVALVTSATRGIGLASAIKLAQNGAIVYMGVRRLEATQEICDKYKEEGLILKPVFFDAYNIDIYKEMIDTIIKNEGKIDILVNNFGTGRPEKDLDLVNGDEDTFFELFNYNVGSVYRLSKLIIPHMIENKGGSIVNISSVGGSIPDISRIGYGVSKSGVNNITKQIAIQYAKYGIRCNAVLPGLIATDAAMNSMPDEFRKSFLSHVPLNRIGNPEDIANSVLFFVPSEDSSYITGSILEVSGGYNLGTPQYAEFVGSKVVE

SEQ ID NO: 12059 - protein, 2035 aa, Homo sapiens
MASAVSPANLPAVLLQPRWKRVVGWSGPVPRPRHGHRAVAIKELIVVFGGGNEGIVDELHVYNTATNQWFIPAVRGDIPPGCAAYGFVCDGTRLLVFGGMVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIDTLTWNKPSLSGVAPLPRSLHSATTIGNKMYVFGGWVPLVMDDVKVATHEKEWKCTNTLACLNLDTMAWETILMDTLEDNIPRARAGHCAVAINTRLYIWSGRDGYRKAWNNQVCCKDLWYLETEKPPPPARVQLVRANTNSLEVSWGAVATADSYLLQLQKYDIPATAATATSPTPNPVPSVPANPPKSPAPAAAAPAVQPLTQVGITLLPQAAPAPPTTTTIQVLPTVPGSSISVPTAARTQGVPAVLKVTGPQATTGTPLVTMRPASQAGKAPVTVTSLPAGVRMVVPTQSAQGTVIGSSPQMSGMAALAAAAAATQKIPPSSRPTVLSVPAGTTIVKTMAVTPGTTTLPATVKVASSPVMVSNPATRMLKTAAAQVGTSVSSATNTSTRPIITVHKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGTKPTILGISSVSPSTTKPGTTTIIKTIPMSAIITQAGATGVTSSPGIKSPITIITTKVMTSGTGAPAKIITAVPKIATGHGQQGVTQVVLKGAPGQPGTILRTVPMGGVRLVTPVTVSAVKPAVTTLVVKGTTGVTTLGTVTGTVSTSLAGAGGHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSTVGQQNGSVVRVCSNPPCETHETGTTNTATTATSNMAGQHGCSNPPCETHETGTTNTATTAMSSVGANHQRDARRACAAGTPAVIRISVATGALEAAQGSKPQCQTRQTSATSTTMTVMATGAPCSAGPLLGPSMAREPGGRSPAFVQLAPLSSKVRLSSPSIKDLPAGRHSHAVSTAAMTRSSVGAGEPRMAPVCESLQGGSPSTTVTVTALEALLCPSATVTQVCSNPPCETHETGTTNTATTSNAGSAQRVCSNPPCETHETGTTHTATTATSNGGTGQPEGGQQPPAGRPCETHQTTSTGTTMSVSVGALLPDATSSHRTVESGLEVAAAPSVTPQAGTALLAPFPTQRVCSNPPCETHETGTTHTATTVTSNMSSNQDPPPAASDQGEVESTQGDSVNITSSSAITTTVSSTLTRAVTTVTQSTPVPGPSVPPPEELQVSPGPRQQLPPRQLLQSASTALMGESAEVLSASQTPELPAAVDLSSTGEPSSGQESAGSAVVATVVVQPPPPTQSEVDQLSLPQELMAEAQAGTTTLMVTGLTPEELAVTAAAEAAAQAAATEEAQALAIQAVLQAAQQAVMGTGEPMDTSEAAATVTQAELGHLSAEGQEGQATTIPIVLTQQELAALVQQQQLQEAQAQQQHHHLPTEALAPADSLNDPAIESNCLNELAGTVPSTVALLPSTATESLAPSNTFVAPQPVVVASPAKLQAAATLTEVANGIESLGVKPDLPPPPSKAPMKKENQWFDVGVIKGTNVMVTHYFLPPDDAVPSDDDLGTVPDYNQLKKQELQPGTAYKFRVAGINACARGPFSEISAFKTCLPGFPGAPCAIKISKSPDGAHLTWEPPSVTSGKIIEYSVYLAIQSSQAGGELKSSTPAQLAFMRVYCGPSPSCLVQSSSLSNAHIDYTTKPAIIFRIAARNEKGYGPATQVRWLQETSKDSSGTKPANKRPMSSPEMKSAPKKSKADGQ

SEQ ID NO: 12060 - protein, 2090 aa, Mesocricetus auratus
MASAVSPANLPAVLLQPRWKRVVGWSGPVPRPRHGHRAVAIKELIVVFGGGNEGIVDELHVYNTATNQWFIPAVRGDIPPGCAAYGFVCDGTRLLVFGGMVEYGKYSNDLYELQASRWEWKRLKAKTPKNGPPPCPRLGHSFSLVGNKCYLFGGLANDSEDPKNNIPRYLNDLYILELRPGSGVVAWDIPITYGVLPPPRESHTAVVYTEKDNKKSKLVIYGGMSGCRLGDLWTLDIETLTWNKPSLSGVAPLPRSLHSATTIGNKMYVFGGWVPLVMDDVKVATHEKEWKCTNTLACLNLDTMAWETILMDTLEDNIPRARAGHCAVAINTRLYIWSGRDGYRKAWNNQVCCKDLWYLETEKPPPPARVQLVRANTNSLEVSWGAVATADSYLLQLQKYDIPATAATATSPTPNPVPSVPANPPKSPAPAAAAPAVQPLTQVGITLVPQAAAAPPSTTTIQVLPTVPGSSISVPTAARAQGVPAVLKVTGPQATTGTPLVTMRPAGQAGKAPVTVTSLPASVRMVVPTQSAQGTVIGSNPQMSGMAALAAAAAATQKIPPSSAPTVLSVPAGTTIVKTVAVTPGTTTLPATVKVASSPVMVSNPATRMLKTAAAQVGTSVSSAANTSTRPIITVHKSGTVTVAQQAQVVTTVVGGVTKTITLVKSPISVPGGSALISNLGKVMSVVQTKPVQTSAVTGQASTGPVTQIIQTKGPLPAGTILKLVTSADGKPTTIITTTQASGAGSKPTILGISSVSPSTTKPGTTTIIKTIPMSAIITQAGATGVTSTPGIKSPITIITTKVMTSGTGAPAKIITAVPKIATGHGQQGVTQVVLKGAPGQPGAILRTVPMSGVRLVTPVTVSAVKPAVTTLVVKGTTGVTTLGTVTGTVSTSLAGAGAHSTSASLATPITTLGTIATLSSQVINPTAITVSAAQTTLTAAGGLTTPTITMQPVSQPTQVTLITAPSGVEAQPVHDLPVSILASPTTEQPTATVTIADSGQGDVQPGTVTLVCSNPPCETHETGTTNTATTTVVANLGGHPQPTQVQFVCDRQEAAASLVTSAVGQQNGNVVRVCSNPPCETHETGTTNTATTATSNMAGQHGCSNPPCETHETGTTSTATTAMSSMGTGQQRDTRHTSSNPTVVRITVAPGALERTQGTVKPQCQTQQANMTNTTMTVQATRSPCPAGPLLRPSVALEAGNHSPAFVQLALPSVRVGLSGPSNKDMPTGHQLETYHTYTTNTPTTALSIMGAGELGTARLIPTSTYESLQASSPSSTMTMTALEALLCPSATVTQVCSNPPCETHETGTTNTATTSNAGSAQRVCSNPPCETHETGTTHTATTATSNGGAGQPEGGQQPAGGRPCETHQTTSTGTTMSVSVGALLPDATPSHGTLESGLEVVAVSTVTSQAGATLLASFPTQRVCSNPPCETHETGTTHTATTVTSNMSSNQDPPPAASDQGEVVSTQGDSANITSSSGITTTVSSTLPRAVTTVTQSTPVPGPSVPNISSLTETPGALTSEVPIPATITVTIANTETSDMPFSAVDILQPPEELQVSPGPRQQLPPRQLLQSASTPLMGESSEVLSASQTPELQAAVDLSSTGDPSSGQEPTSSAVVATVVVQPPPPTQSEVDQLSLPQELMAEAQAGTTTLMVTGLTPEELAVTAAAEAAAQAAATEEAQALAIQAVLQAAQQAVMAGTGEPMDTSEAAAAVTQAELGHLSAEGQEGQATTIPIVLTQQELAALVQQQQQLQEVQAQAQQQHHLPTEALAPADSLNDPSIESNCLNELASAVPSTVALLPSTATESLAPSNTFVAPQPVVVASPAKMQAAATLTEVDNGIESLGVKPDLPPPPSKAPVKKENQWFDVGVIKGTSVMVTHYFLPPDDAVQSDDDSGTIPDYNQLKKQELQPGTAYKFRVAGINACGRGPFSEISAFKTCLPGFPGAPCAIKISKSPDGAHLTWEPPSVTSGKIIEYSVYLAIQSSQAGGEPKSSTPAQLAFMRVYCGPSPSCLVQSSSLSNAHIDYTTKPAIIFRIAARNEKGYGPATQVRWLQETSKDSSGTKPASKRPMSSPEMKSAPKKSKADGQ

SEQ ID NO: 12061 - protein, 366 aa, Sorghum bicolor
RPLEYAWNKAANILFAESPAGVVFSYSNTSSDLSMGDDKMAQDTYTFLVKWFERFPHYNYREFYIAGESGHFIPQLSQVVYRNRNNSPFINFQGLLVSSGLTNDHEDMIGMFELWWHHGLISDETRDSGLKVCPGTSFMHPTPECTEVWNKALAEQGNINPYTIYTPTCDREPSPYQRRFWAPHGRAAPPPLMLPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVSPSGAGHLVPVHRPAQAFLLFKQFLKGEPMPAEEKNDILLPSEKAPFY

SEQ ID NO: 12062 - protein, 503 aa, Tritrichomonas foetus
MAKYYNEPCHTFNEYLLIPGLSTVDCIPSNVNLSTPLVKFQKGQQSEINLKIPLVSAIMQSVSGEKMAIALAREGGISFIFGSQSIESQAAMVHAVKNFKAGFVVSDSNVKPDQTFADVLAISQRTTHNTVAVTDDGTPHGVLLGLVTQRDYPIDLTQTETKVSDMMTPFSKLVTAHQDTKLSEANKIIWEKKLNALPIIDDDQHLRYIVFRKDYDRSQVCHNELVDSQKRYLVGAGINTRDFRERVPALVEAGADVLCIDSSDGFSEWQKITIGWIREKYGDKVKVGAGNIVDGEGFRYLADAGADFIKIGIGGGSICITREQKGIGRGQATAVIDVVAERNKYFEETGIYIPVCSDGGIVYDYHMTLALAMGADFIMLGRYFARFEESPTRKVTINGSVMKEYWGEGSSRARNWQRYDLGGKQKLSFEEGVDSYVPYAGKLKDNVEASLNKVKSTMCNCGALTIPQLQSKAKITLVSSVSIVEGGAHDVIVKDRINDYHPK

SEQ ID NO: 12063 - protein, 512 aa, Trypanosoma brucei brucei
MENTNLRTKTLRDGTTAEELFSQDGLSFNDFIILPGFIDFDSSKVNVSGQFTKNILLHLPLVSSPMDTVTESSMARAMALMGGIGVIHNNCTVEQQARMVRSVKLYRNGFIMKPKSVSPDVPVSTIRNIKSEKGISGILVTEGGKYDGKLLGIVCTKDIDFVKDASAPVSQYMTRRENMTVERYPIKLEEAMDVLNRSRHGYLPVLNDKDEVVCLCSRRDAVRARDYPNSSLDRNGHLLCAAATSTREADKGRVAALSEAGIDVLVLDSSQGNTIYQVSFIRWVKKTYPHLEVVAGNVVTQDQAKNLIDAGADSLRIGMGSGSICITQEVLACGRPQATAIYKVARYAASRGVPCVADGGLRNVGDVCKALAVGANVAMLGSMIAGTSETPGEYFFKDGMRLKGYRGMGSIDAMLQGRESGKRYLSENETLQVAQGVAGAVLDKGSVLKLLAYIHKGLQQSAQDIGEVSFDAIREKVYEGQVLFNRRTLTAQSEGAVHSLHHYERKLFASKL

SEQ ID NO: 12064 - protein, 89 aa, Blepharisma japonicum
KGLGKVGAKKRHRRVIRENIQGITKPAIRRLARRGGVKRTLSGLVYDETRNVLKVFLENVVRDAVTYTEHARRKTVTALDVVYALKRQG

SEQ ID NO: 12065 - protein, 859 aa, Vibrio harveyi
MTTTRSNIKKRRSLATLITKIIILVLAPIILGIFIQSYYFSKQIIWQEVDRTKQQTSALIHNIFDSHFAAIQIHHDSNSKSEVIRDFYTDRDTDVLNFFFLSIDQSDPSHTPEFRFLTDHKGIIWDDGNAHFYGVNDLILDSLANRVSFSNNWYYINVMTSIGSRHMLVRRVPILDPSTGEVLGFSFNAVVLDNNFALMEKLKSESNVDNVVLVANSVPLANSLIGDEPYNVADVLQRKSSDKRLDKLLVIETPIVVNAVTTELCLLTVQDNQSVVTLQIQHILAMLASIIGMIMIALMSREWIESKVSAQLESLMSYTRSAREEKGFERFGGSDIEEFDHIGSTLESTFEELEAQKKSFRDLFNFALSPIMVWSEESVLIQMNPAARKELVIEDDHEIMHPVFQGFKEKLTPHLKMAAQGATLTGVNVPIGNKIYRWNLSPIRVDGDISGIIVQGQDITTLIEAEKQSNIARREAEKSAQARADFLAKMSHEIRTPINGILGVAQLLKDSVDTQEQKNQIDVLCHSGEHLLAVLNDILDFSKIEQGKFNIQKHPFSFTDTMRTLENIYRPICTNKGVELVIENELDPNVEIFTDQVRLNQILFNLVSNAVKFTPIGSIRLHAELEQFYGAENSVLVVELTDTGIGIESDKLDQMFEPFVQEESTTTREYGGSGLGLTIVKNLVDMLEGDVQVRSSKGGGTTFVITLPVKDRERVLRPLEVSQRIKPEALFDESLKVLLVEDNHTNAFILQAFCKKYKMQVDWAKDGLDAMELLSDTTYDLILMDNQLPHLGGIETTHEIRQNLRLGTPIYACTADTAKETSDAFMAAGANYVMLKPIKENALHEAFVDFKQRFLVERT

SEQ ID NO: 12066 - protein, 270 aa, Schizosaccharomyces pombe
MSTLDLNHLADLYDRKDWNACKKELLKLKVELAKQNLFVPTSDKEKASFARNVFEYGVLVSIQTCDIESFARYASQVIPFYHDSLVPSSRMGLVTGLNLLYLLSENRIAEFHTALESVPDKSLFERDPYVEWVISLEQNVMEGAFDKVASMIRSCNFPEFSYFMKIVMSMVRNEIATCAEKVYSEIPLSNATSLLYLENTKETEKLAEERGWDIRDGVIYFPKEANALETEDGMLIDEEDELELPPTASKHTISSIRQLLSYTSELEQIV

SEQ ID NO: 12067 - protein, 809 aa, Oryctolagus cuniculus
MESAGTGRSLRTPPPRLLLLLLLQVAGPAGALAETLLNAPKAMGTSSSPLSPASVVAPGTTAFEESRLPVFTLDYPHVQIPFEITLWILLASLAKIGFHLYHKLPTIVPESCLLIMVGLLLGGIIFGVDEKSPPAMKTDVFFLYLLPPIVLDAGYFMPTRPFFENLGTIFWYAVVGTLWNSIGIGVSLFGICQIEAFGLSDITLLQNLLFGSLISAVDPVAVLAVFENIHVNEQLYILVFGESLLNDAVTVVLYNLFKSFCQMKTIETIDVFAGIANFFVVGIGGVLIGIFLGFIAAFTTRFTHNIRVIEPLFVFLYSYLSYITAEMFHLSGIMAITACAMTMNKYVEENVSQKSYTTIKYFMKMLSSVSETLIFIFMGVSTVGKNHEWNWAFVCFTLAFCLIWRALGVFVLTRVINWFRTIPLTFKDQFIIAYGGLRGAICFALVFLLPAAVFPRKKLFITAAIVVIFFTVFILGITIRPLVEFLDVKRSNKKQQAVSEEIHCRFFDHVKTGIEDVCGHWGHNFWRDKFKKFDDKYLRKLLIRENQPKSSIVSLYKKLEIKHAIEMAETGMISTVPSFASLNDCREEKIRKLTPGEMDEIREILSRNLYQIRQRTLSYNRHNLTADTSERQAKEILIRRRHSLRESIRKDNSLNRERRASTSTSRYLSLPKNTKLPEKLQKRKNISNADGDSSDSEADAGTTVLNLQPRARRFLPEPFSKKASQAYKMEWKNEVDAGSGQGQPSPPAAPRSKEGGTQTPAVLRQPLLSKDQGREDSLTEGGRPKPPPRLVRRASEPGNRKSRLGSDKP

SEQ ID NO: 12068 - protein, 434 aa, Lupinus luteus
SPPVHPPPHEKPPIVHPPPHEKPPLFEPPFEKPPPAHPPPVHPPPHEKPPIEYPPPHTKPPIEYPPPHVKPPIQYPPPHEKPPIEYPLPHEKPPVYEPPYEKPPPVHPPPHEKPPIEYSPPHEKPPVHEPPYEKPPLVHPPPHDKPPIEYHPPHEKPPIEYPPPHEKPPIEYPPPHEKPPIEYPPPHEKPPVYEPPYEKPPPVHPPPDEKPPIEYPPPLEKPPVHEPPYEKPPPAQPPPHDKPPIEYPPPHEKPPVYEPPYERSPPVHPPSHEKPPFVYPPPHEKSPMHEPPYEKAPPVHLPPHEKPPIEYAPPHEKPPVEYPPPHVKPPVEYPSPAEKPPTHEKPPIEFPPHEKPPVYEPPYEKPPSVCPPPHEKPPHHEKRSALYPPHHRKPPNHHKPLPYKKPPFYKSPPVEKPSSYESQPYGRLPVLPEK

SEQ ID NO: 12069 - protein, 197 aa, Onchocerca volvulus
MHCLQVVIAIVLYSFGKISAENANCKKCTPMLVDSAFKEHGIVPDVVSTAPTKLVNVSYNNLTVNLGNELTPTQVKNQPTKVSWDAEPGALYTLVMTDPDAPSRKNPVFREWHHWLIINISGQNVSSGTVLSDYIGSGPRKGTGLHRYVFLVYKQPGSITDTQHGGNRRNFKVMDFANKHHLGNPVAGNFFQAKHED

SEQ ID NO: 12070 - protein, 523 aa, Aspergillus saitoi
MRITSAIASLLLVGTATSLQNPHRRAVPPPLTHRSVASRAVPVERRSNDFEYLTNKTARFLVNGTSIPEVDFDVGESYAGLLPNTPTGNSSLFFWFFPSQNPDASDEITIWLNGGPGCSSLDGLLQENGPFLWQPGTYKPVPNPYSWTNLTNVVYIDQPAGTGFSPGPSTVNDEEDVAAQFNSWFKHFVDTFDLHGRKVYITGESYAGMYVPYIADAMLNEEDTTYFNLKGIQINDPSINSDSVMMYSPAVRHLNHYNNIFRLNSTFLSYINGKADKCGYNAFLDKAITYPPPTPFPTAPEITEDCQVWDEVVMAAYDINPCFNYYHLIDFCPYLWDVLGFPSLGFGPDNYFNRSDVQKILHVPPTDYSVCSETVIFANGDGSDPSSWGPLPSVIERTNNTIIGHGWLDYLLFLNGSLATIQNMTWNGKQGFQSPPVEPLFVPYHYGLAELYWGDEPDPYNLDAGAGYLGTAHTERGLTFSSVYLSGHEIPQYVPGALTASWSSCLVELIVFPRRGTTPLNFS

SEQ ID NO: 12071 - protein, 884 aa, Giardia intestinalis
MSTRRVYFFGETPENQPANSELCRKVLGGKGISLAAMIKLGMPVPLGFTITCQTCVEYQKTASWPKGLKEEVASNLKLLEEKMGKTFGDNTNPLLVSVRSGAAVSMPGMMDTILNLGLNDESVKGLAAVTGNARFAYDSYRRFMQMFGDVCLGIDHDKFEHALDAVKTRYGRKTDPELTADELEEVCEAYRKICVAATGKTFPQCPHEQLELAINAVFKSWTNPRAQAYRTLNKLDHNMGTAVNVQSMVFGNTGDDSGTGVGFTRCPKTGEKFSYLYGEFLQNAQGEDVVAGIRTPVNLKEMPTINASWKACYDELSLIYAKLEGYYNDMVDLEFTVENGKLWMLQARAGKRTGFAMVRIAIDMCKEGMLTEEEALLRIDANKINEFLFKRFDPSVKPVVLGKGIPASPGAAVGVICFCPMRTCELAEQGKKVILTRIETSPEDILGMDRAVGILTARGGQTSHAAVVARGMGKCCVAGADCCQINYATKTLVIGDRKFKEGDFISINGTTGEIYNGAVQTIEPGITDDLQTIMDWSDKYRVLKIRTNADTPHDAAVARKFGAEGIGLCRTEHMFFAADRIMAMREMILSDDEGARRTALNKLLPFQREDFIGIFKAMDGKGVNIRLLDPPLHEFLPHTRDLQKKLAEDMNKKHRHIHERVEDLHEVNPMLGFRGVRLGIVYPEISEMQVRAILEAACIVSREGVTVKPEIMIPVLFSENEMEIMHALVNRVAASVFKEHGTTVDYEVGTMIELPRACVMADKIAQTAQYFSFGTNDLTQTTFGISRDDAGKFIPKYIDRGIFKVDPFVTLDQQGVGALMKMAIEGGRSTRTDMKIGICGEQTDPASILFLHKIGLNYVSCSPYRVPVARVAAAIAAIKARTNQ

SEQ ID NO: 12072 - protein, 572 aa, Staphylococcus aureus
MSKLIKGIAASDGVAIAKAYLLVEPDLTFDKNEKVTDVEGEVAKFNSAIEASKVELTKIRNNAEVQLGADKAAIFDAHLLVLDDPELIQPIQDKIKNENANAATALTDVTTQFVTIFESMDNEYMKERAADIRDVSKRVLSHILGVELPNPSMIDESVVIVGNDLTPSDTAQLNKEFVQGFATNIGGRTSHSAIMSRSLEIPAIVGTKSITQEVKQGDMIIVDGLNGDVIVNPTEDELIAYQDKRERYFADKKELQKLRDADTVTVDGVHAELAANIGTPNDLPGVIENGAQGIGLYRTEFLYMGRDQMPTEEEQFEAYKEVLEAMGGKRVVVRTLDIGGDKELSYLNLPEEMNPFLGYRAIRLCLAQQDIFRPQLRALLRASVYGKLNIMFPMVATINEFREAKAILLEEKENLKNEGHDISDDIELGIMVEIPATAALADVFAKEVDFFSIGTNDLIQYTLAADRMSERVSYLYQPYNPSILRLVKQVIEASHKEGKWTGMCGEMAGDETAIPLLLGLGLDEFSMSATSILKARRQINGLSKNEMTELANRAVDCATQEEVIELVNNYVK

SEQ ID NO: 12073 - protein, 284 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLAAPLLSCRILPCTCASGPLHVLLACCLPLPCTCASVPLHVLLACCLPVLRAPQPSGLHLSWPIFLL

SEQ ID NO: 12074 - protein, 118 aa, Saccharomyces cerevisiae
ASQSRSAKAGLTFPVGRVHRLLRRGNYAQRIGSGAPVYLTAVLEYLAAEILELAGNAARDNKKTRIIPRHLQLAIRNDDELNKLLGNVTIAQGGVLPNIHQNLLPKKSAKATKASQEL

SEQ ID NO: 12075 - protein, 345 aa, Rattus norvegicus
MPRIDADLKLDFKDVLLRPKRSSLKSRSEVDLERTFTFRNSKQTYSGIPVIVANMDTVGTFEMAVVMSQHAMFTAIHKHYSLDDWKHFAENHPECLQHVAVSSGSGQNDLEKMSLILEAVPQVKFICLDVANGYSEHFVEFVKLVRSKFPEHTIMAGNVVTGEMVEELILSGADIIKVGVGPGSVCTTRTKTGVGYPQLSAVIECADSAHGLKGHIISDGSCTCPGDVAKAFGAGADFVMLGGMFSGHTECAGEVIERNGQKLKLFYGMSSDTAMKKHAGGVAEYRASEGKTVEVPYKGDVENTILDILGGLRSTCTYVGAAKLKELSRRATFIRVTQQHNTVFG

SEQ ID NO: 12076 - protein, 335 aa, Rattus norvegicus
MALLARAFFAGVSRLPCDPGPQKFFSFGTKTLYQSIDAPQSKFFPPILKPMLPPNAFQGKVAFITGGGTGLGKAMTTFRSSLGAQCVIASRNIDVLKATAEEITSKTGNKVYAIRCDVRDPDMVHNTVLELIKVAGHPDVVINNAAGNFISPSERLSPNGWRTITDIVLNGTAYVTIEIGKQLIKAQKGVAFLAITTIYAESGSGFVMPSSSAKSGVEAMNKSLAAEWGRYGMRFNIIQPGPIKTKGAFSRLDPTGKFEKDMIERIPCGRLGTVEELANLATFLCSDYASWINGAVIRFDGGEEVFLSGEFNSLKKVTKEEWDVIEGLIRKTKGS

SEQ ID NO: 12077 - protein, 322 aa, Lupinus luteus
MAPKATKAEKKIVYDGKLCQLLDEYTQILVVNADNVGSKQLQNIRQGLRGDSVVLMGKNTMMKRSVRIHAEKTGNQAFLNLIPLLIGNVGLIFTKGYLKEVSEEVAKYKVGAPACVGLVAPIDVVVPPGNTGLDPSQTSFFQVLNIPTKINKGTVEIITPVELIKKGDKVGSSEAALLAKLGIRPFSYGLVVLSVYDNGSVFKPEVLDLTEDDLLEKFAIGVSQCYFSDTSHFIPNPSAAPHVFINAYKNVLAVAVATEYSFPQADEVKEYLKDPSKFAAVAAAAAPAADSGAAPAAAAKAEKEEEPAEESDDEMGFGLFDE

SEQ ID NO: 12078 - protein, 320 aa, Glycine max
MAPKQTKAEKKIAYDAKLCDLMEEYGQILVVNSDNVGSNQLQNIRKGLRGDSVVLMGKNTMMKRSVRMHAEKTGNNAYLNLIPLLVGNVGLIFTKGDLKEVSEEVAKYKVGAPARVGLVAPIDVVVPPGNTGLDPSQTSFFQVLNIPTKINKGTVEIITPVELIRKGDKVGSSEAALLAKLGIRPFSYGLVVLSVYDNGSVFSPEVLDLTEDDLIGKFAAGVSMVTSLSLAISYPTLAAAPHMFVNAYKNVLAVAVETDYSFPEADKVKEYLKDPSKFAVAAVAAPAAASGAPAAAAKEEEKKEEPAEESDDDMGFSLFD

SEQ ID NO: 12079 - protein, 323 aa, Trypanosoma cruzi
MPSVSEAKREYEERFNGCLTKYGRVLFCLMDNVRSQQVHDVRRDLRGLGELVMGKKTLQKKIVERRAEDKKASAYDKLLYNTCIEKKLLCGNTALIFTNEEIPVITAVLDKHRVQAPARVGAIAPCDVIVPAGNTGMEPKATSFFQALNIATKIAKGTVEIVSDKKVLSVGDRVDNSTATLLQKLDISPFYYQVEVQSVWDRGMLFLREDLSITDDVVEKYLLEGISNVAALSLGAGIPTAATLPHMIMDAFKTLLGASVATEYEFDEFDGKNLRKAALEGNLGGGVADAAAAADTGAAAAPAAAAEPEEEDDDDDFGMGALF

SEQ ID NO: 12080 - protein, 300 aa, Agrobacterium tumefaciens
MARNSLPTITAGEAGLNRYLDEIRKFPMLEPQEEYMLGKRYAEHGDRDAAHKLVTSHLRLVAKIAMGYRGYGLPIGEVVSEGNVGLMQAVKKFDPERGFRLATYAMWWIKASIQEYILRSWSLVKMGTTANQKRLFFNLRRLKGRIQAIDDGDLKPEHVKEIATKLQVSEEEVISMNRRLHGDASLNAPIKASEGESGQWQDWLVDDHESQEAVLIEQDELETRRRMLAKAMGVLNDRERRIFEARRLAEDPVTLEELSSEFDISRERVRQIEVRAFEKVQEAVQKEALEAARALRVVDA

SEQ ID NO: 12081 - protein, 285 aa, Enterobacter cloacae
MTKEMQTLALAPVGNLESYIRAANTWPMLTAEEEKELAEKLHYQGDLEAAKTLILSHLRFVVHVARNYAGYGLPQADLIQEGNIGLMKAVRRFNPEVGVRLVSFAVHWIKAEIHEYVLRNWRIVKVATTKAQRKLFFNLRKTKQRLGWFNQDEVEMVARELGVSSKDVREMESRMAAQDMTFDMSADDDASDSQPMAPVLYLQDKTSNFADGIEEDNWEDQAANKLTFAMEGLDERSQDIIRARWLDEDNKSTLQELADRYGVSAERVRQLEKNAMKKLRAAIEA

SEQ ID NO: 12082 - protein, 284 aa, Proteus mirabilis
MTQEMQSLALVPQGSIEAYIRAANSYPMLTAEEEKELAERLHYEGDLEAAKTLILSHLRFVIHVARSYSGYGLPQADLIQEGNIGLMKAVRHFNPEVGVRLVSFAVHWIKAEIHEYVLRNWRIVKVATTKSQRKLFFNLRKNKKRLGWFNQDEVELVAKELGVSESDVREMESRMSAQDMAFDMSADDSDDPHPVAPVLFLEDKSSDFADGIEEDNWDNHAADRLTLAIKTLDERSQDIIRARWLEDDNKSTLQELADKYGVSAERVRQLEKNAMKKLRLAIED

SEQ ID NO: 12083 - protein, 285 aa, Serratia marcescens
MTKEMQTLALVPQGSLEAYIRAANAYPMLTAEEERELAERLHYQGDLDAAKQLILSHLRFVAHIARNYSGYGLPQADLIQEGNIGLMKAVRRFNPEVGVRLVSFAVHWIKAEIHEYVLRNWRIVKVATTKAQRKLFFNLRKTKQRLGWFNQDEVELVARELGVTSKDVREMESRMAAQDMTFDPTPDDEARDGQSMAPVLYLQDKSSDFAEGIEEDNWESNAADKLAYALEGLDERSQHIIRARWLDDDNKSTLQELADQYGVSAERVRQLEKNAMKKLKMAIEA

SEQ ID NO: 12084 - protein, 302 aa, Zymomonas mobilis
MATSSTLPAVVPALGGDQSLNHYLADIRKFPILKPEEEYMLAKRFQEHQDPKAASRLVTSHLRLVAKIAMGYRGYGLPVSELISEGNIGLMQGVKKFDPERGFRLATYAIWWIKASIQEYILRSWSLVKMGTTAAQKKLFFNLRRLKSNMNAFEDGDLKPDEVDSIATNLGVSNEEVVNMNRRMAMGGDSSLNITMREDGEGQMQDWLVDQEPLQDQQIEEEEESLVRHKLLIEAMDRLNDREKHILTERRLSDNPKTLEELSQVYGVSRERVRQIEVRAFDKLQKAIMELAGDRKLLPAMA

SEQ ID NO: 12085 - protein, 377 aa, Leptospira interrogans
MANDQHTELETEFTLDQVKDQLIEQGKKRSSLNYKDIMEKLSPFDQDPEQMDEFYEHLGDLGIEVVNENDEEVSNLRQGEDHDGNDNDDFNFDDDLSLPPGIKINDPVRMYLKEIGRVPLLSADDEVELAKRIMNGDEEAKRRLAEANLRLVVSIAKRYVGRGMLFLDLIQEGNMGLIKAVEKFDHNKGFKFSTYATWWIRQAITRAIADQARTIRIPVHMVETINKLIRVSRQLLQELGREPTPEEIAAEMELSVEKVREIMKIAQEPVSLETPIGEEDDSHLGDFIEDQEALTPADAAAYELLKEQLEDVLDTLTEREENVLRLRFGLDDGRTRTLEEVGKVFGVTRERIRQIEAKALRKLRHPSRSKRLKDFLE

SEQ ID NO: 12086 - protein, 416 aa, Microcystis aeruginosa
MMQAHDVLTLTEPPLDLDLIDLDEDFDDEDIELELEETSDSNDGKKTRRLASARRRDAARKKPYTEDSIRIYLQEIGRIRLLRAEEEIELARKIADLLKLERIREDFCLYSDAEWGKQVFLFERIEKIIVEKSEKEPKLSDIKAYLGKTELTAPLLEEWLAKSKEYLSAFKRRLYHGRRAKEKMVQSNLRLVVSIAKKYMNRGLSFQDLIQEGSLGLIRAAEKFDHEKGYKFSTYATWWIRQAITRAIADQSRTIRLPVHLYETISRIKKTTKILSQEMRRKPTEEEIATKMEMTIEKLRFIAKSAQLPISLETPIGKEEDSRLGDFIEADGETPEDEVSKNLLREDLENVLDTLSPRERDVLRLRYGLDDGRMKTLEEIGQIFNVTRERIRQIEAKALRKLRHPNRNSILKEYIR

SEQ ID NO: 12087 - protein, 642 aa, Neisseria gonorrhoeae
MSKNQNHEEYQDDARPLTIEEQRARLRQLIIMGKERGYITYSEINDALPDDMSDADQIDNIVSMISGLGIQVTEHAPDAEDILLSDNAAVTDDDAVEEAEAALSSADSEFGRTTDPVRMYMREMGQVDLLTREDEIIIAKKIENALKNMVQAISACPGSIAEILELIEKICKDEIRVDEVVEAIIDPNEVLRNELGLGHLETTAPEKPSNDNSDENEDDEESEEDADEISAANLAELKQKVIGHFAQIEKDYKKMIGCLEKHHSRHKDYLAYRDAIANKLLEVRFATRQIDSLSSSLRGKVENIRKLEREIRDICLDRVHMERDYFIQNFLPEITNLQWIEEEIAKGRVWSNALDRFRHAILEKQTELADMEKETRISIEELKEINKNMVSSEKVSAAAKQEMIQANLRLVISIAKKYTNRGLQFLDLIQEGNIGLMKAVDKFEYRRGYKFSTYATWWIRQAITRSIADQARTIRIPVHMIETINKMNRISRQHLQETGEEPDSAKLAELMQMPEDKIRKIMKIAKEPISMETPIGDDDDSHLGDFIEDANNVAPADAAMYTSLHEVTKEILESLTPREAKVLRMRFGIDMNTDHTLEEVGRQFDVTRERIRQIEAKALRKLRHPTRSDRLRSFLDSEDSKL

SEQ ID NO: 12088 - protein, 615 aa, Pseudomonas fluorescens
MSGKAQQQSRLKELISRGREQGYLTYAEVNDHLPEDISDPEQVEDIIRMINDMGINVFESAPDADALLLAEADTDEAAAEEAAAALAAVETDIGRTTDPVRMYMREMGTVELLTREGEIEIAKRIEEGIREVMGAIAHFPGTVDHILSEYTRVTTEGGRLSDVLSGYIDPDDGITPPAAEVPPPVDTKTAKADDDSEDEEAEATEDEEEAESGPDPVIAAQRFGAVADQMEVTRKALKKHGRENKQAIAEMLALAELFMPIKLVPKQFEGLVERVRSALDRLRQQERAIMQLCVRDARMPRADFLRQFPGNEVDESWTDALAKGKSKYAEAIARLQPDIIRCQQKLTALEVETGLKIAEIKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELGERMEMPEDKIRKVLKIAKEPISMETPIGDDEDSHLGDFIEDSTMQSPIDVATVESLKEATREVLSGLTAREAKVLRMRFGIDMNTDHTLEEVGKQFDVTRERIRQIEAKALRKLRHPTRSEHLRSFLDE

SEQ ID NO: 12089 - protein, 614 aa, Pseudomonas putida
MSGKAQQQSRIKELITRGREQGYLTYAEVNDHLPEDISDPEQVEDIIRMINDMGINVFESAPDADALLLAEADTDEAAAEEAAAALAAVETDIRRTTDPVRMYMREMGTVELLTREGEIEIAKRIEEGIREVMGAIAHFPGTVDYILGEYDRVNRGCRLSDVLSGYIDPDDNIAAPTEEVPIPGTKAAAAKEEADDDEEESEGGDDEEEPKAALTRSSQPSVSVRYPSSFSDHQGPEEKRSYPQGKRRALQALADLFMPIKLVPKQFEVLVERVRDALNRLRQQERAIMQLCVRDARMPRADFLRMFPSNETDQTWSGDLAKRNTKWAAALGEKDAAIVACQQKLIDLETETGLTVAEIKEINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELGERMEMPEDKIRKVLKIAKEPISMETPIGDDEDSHLGDFIEDSTMQSPIYVATVESLKEATRDVLSGLTAREAKVLRMRFGIDMNTDHTLEEVGKQFDVTRERIRQIEAKAWRKLRHPTRSEHLRSFLDE

SEQ ID NO: 12090 - protein, 486 aa, Trichomonas vaginalis
MACKSPAGAPFEYRIADINLHVLGRKELTLAEKEMPGLMVLRERYSASKPLKGVRISGSLHMTVQTAVLIETLTALGADVRWASCNIFSTQDTAAAAIVVGPTGTPEKPAGIPVFAWKGETLPEYWENTYRALTWPDGQGPQQVVDDGGDATLLISKGFEFETAGAVPEPTEADNLEYRCVLATLKQVFNQDKNHWHTVAAGMNGVSEETTTGVHRLYQLEKEGKLLFPAINVNDAVTKSKFDNIYGCRHSLIDGINRASDVMIGGKTALVMGYGDVGKGCAQSLRGQGARVIITEVDPICALQAVMEGYQVRRIEEVVKDVDIFVTCTGNCDIISVDMMAQMKDKAIVGNIGHFDNEIDTDGLMKYPGIKHIPIKPEYDMWEFPDGHAILLLAEGRLLNLGCATGHPSFVMSMSFTNQTLAQLDLYEKRGNLEMKVYTLPKHLDEEVVRLHLGSLDVHLTKLTQKQADYINVPVEGPYKSDAYRY

SEQ ID NO: 12091 - protein, 437 aa, Leishmania donovani
MADYKVKDISLAEWGRKAIELAENEMPGLMELRREYGPSQPLKGAKIAGCLHMTVQTAVLIETLKALGADVRWSSCNIFSTQDNAAAAIAKAGVPVFAWKGETDEEYEWCIAQTVKGFSGDGLPNMILDDGGDLTNLVIDHHPELVPKIFGISEETTTGVKNLYKRLSKGNLPMCAINVNDSVTKSKFDNLYGCRESLVDGMKRATDVMIAGKTCCVCGYGDVGKGCAAALRAFGARVVVTEVDPINALQASMEGYQVALVEDVMADAHIFVTTTGNDDIITSEHFPHMRDDAIVCNIGHFDTEIQVGWLEANAKEHVEIKPQVDRYTMENGRHIILLAKGRLVNLGCASGHPSFVMSNSFTNQVLAQIELWSNRDNGKYPRGDKAGVFFLPKALDEKVAALHLAHVGAKLTKLTPKQAEYINCPVNGPFKPDHYRY

SEQ ID NO: 12092 - protein, 485 aa, Medicago sativa
MALLVETTTSGREYKVKDMSQADFGRLEIELAEVEMPGLMSCRTEFGPSQPFKGARITGSLHMTIQTAVLIETLTALGAEVRWCSCNIFSTQDHAAAAIARDSAAVFAWKGETLQEYWWCSERALDWGPGGGPDLIVDDGGDVTLLIHEGVKAEEVFEKTGQLPDPSSTDNAEMQIVLTIIRDGLKTDPKRYQKMKTRIVGVSEETTTGVKRLYQMQASGTLLFPAINVNDSVTKSKFDNLYGCRHSLPDGLMRATDVMIAGKVAVVCGYGDVGKGCAAALKQGGARVIVTEIDPICALQALMEGLQVLTLEDVISEADIFVTTTGNKDIIMVSDMKKMKNNAIVCNIGHFDNEIDMHGLETYPGVKRITIKPQTDRWVFPETKSGIIVLAEGRLMNLGCATGHPSFVMSCSFTNQVIAQIELWKEKTSGKYEKKVYVLPKHLDEKVAALHLGQLGAKLTKLSKDQADYISVPVEGPYKPAHYRY

SEQ ID NO: 12093 - protein, 485 aa, Nicotiana sylvestris
MALLVEKTTSGREYKVKDMSQADFGRLEIELAEVEMPGLMACRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKNGTIPDPNSTDNAEFQLVLTIIKESLKTDPLKYTKMKERLVGVSEETTTGVKRLYQMQANGTLLFPAINVNDSVTKSKFDNLYGCRHSLPDGLMRATDVMIAGKVALVAGYGDVGKGCAAALKQAGARVIVTEIDPICALQATMEGLQVLTLEDVVSDVDIFVTTTGNKDIIMVDHMRKMKNNAIVCNIGHFDNEIDMLGLETYPGVKRITIKPQTDRWVFPDTNSGIIVLAEGRLMNLGCATGHPSFVMSCSFTNQVIAQLELWNEKSSGKYEKKVYVLPKHLDEKVAALHLGKLGAKLTKLSKDQADYISVPVEGPYKPAHYRY

SEQ ID NO: 12094 - protein, 485 aa, Phalaenopsis sp.
MALLVEKTTSGREYKVKDLSQADFGRLEIELAEVEMPGLMACRAEFGPSQPFKGARISGSLHMTIQTAVLIETLTALGAEVRWCSCNIFSTQDHAAAAIARDSAAVFAWKGETLQEYWWCTERCLEWGAGGGPDLIVDDGGDATLLIHEGVKAEEEYEKNGKIPDPASTDNAEFQIVLGLIRDSLSVDPKKYRRMKERLVGVSEETTTGVKRLYQMQYSGTLLFPAINVNDSVTKSKFDNLYGCRHSLPDGLMRATDVMIAGKVAVVCGYGDVGLGCAAALKTAGARVIVTEIDPICALQALMEGLPVLRLEDVVSEADIFVTTTGNKDIIMVDHMRKMKNNAIVCNIGHFDNEIDMLGLESFPGVKRITIKPQTDRRVFPDTNSGILVLAEGRLMNLGCATGHPSFVMSSSFTNQVIAQLELWKERASGKYEKKVYVLPKHLDEKVAALHLGKLGAKLTKLTPSQADYISVPVEGPYKPAHYRY

SEQ ID NO: 12095 - protein, 479 aa, Plasmodium falciparum 3D7
MVENKSKVKDISLAPFGKMQMEISENEMPGLMRIREEYGKDQPLKNAKITGCLHMTVECALLIETLQKLGAQIRWCSCNIYSTADYAAAAVSTLENVTVFAWKNETLEEYWWCVESALTWGDGDDNGPDMIVDDGGDATLLVHKGVEYEKLYEEKNILPDPEKAKNEEERCFLTLLKNSILKNPKKWTNIAKKIIGVSEETTTGVLRLKKMDKQNELLFTAINVNDAVTKQKYDNVYGCRHSYTDGLMRATDFLISGKIVVICGYGDVGKGCASSMKGLGARVYITEIDPICAIQAVMEGFNVVTLDEIVDKGDFFITCTGNVDVIKLEHLLKMKNNAVVGNIGHFDDEIQVNELFNYKGIHIENVKPQVDRITLPNGNKIIVLARGRLLNLGCATGHPAFVMSFSFCNQTFAQLDLWQNKDTNKYENKVYLLPKHLDEKVALYHLKKLNASLTELDDNQCQFLGVNKSGPFKSNEYRY

SEQ ID NO: 12096 - protein, 417 aa, Sulfolobus solfataricus
MSYKIKDLSLASEGKKQIEWAERHMPTLMEIRKRFKAEKPLKGINISAVLHVTKETAALVKTLKIGGANVALAGSNPLSTQDDVAAALVEEGISVFAWKGENETEYYSNIESIVKIHEPNIVMDDGADLHAYIHEKVSSKLDIYGGTEETTTGVIRLKAMEKDGVLKYPLVAVNNAYTKYLFDNRYGTGQSAIDGILRATNILIAGKIAVVAGYGWVGRGIANRLRGMGARVIVTEVDPIRALEAVMDGFDVMPIAEASKVGDIFVTATGNTKAIRVEHMLNMKDGAILSNAGHFNVEVDVKGLKETAVKVRNIRPYVDEYTLPNGKRVYLLADGRLVNLAAAEGHPSEVMDMSFANQALAVEYLVKNRGKLEKKVYNMPMELDYEVARIKLKSMGIQIDELTEEQKEYLEQWKSGT

SEQ ID NO: 12097 - protein, 433 aa, Xenopus laevis
MSDKLSYKVADISLADWGRKAIEIAENEMPGLMKMREMHSESKPLKGARIAGCLHMTLQTAVLIETLTALGAEVQWSSCNIFSTQDHAAAAIAKTGVPVYAWKGETDEEYIWCIEQTIYFKDGKPLNMILDDGGDLTNLVHSKYPQLLKGIKGISEETTTGVHNLYKMKSSGTLQVPAINVNDSVTKSKFDNLYGCRESLIDGIKRATDVMIAGKVAVVAGYGDVGKGCAQALRAFGARVIITEIDPINALQAAMEGYEVTTMDEASKEGNIFVTTTGCADIVEGRHFENMKDDSIVCNIGHFDIELDVKWLNENAVKKVNIKPQVDRYLLKNGRHIILLAEGRLVNLGCAMGHPSFVMSNSFTNQVMAQIELWTNTDKYPVGVYFLPKKLDEAVAAAHLDKLGVKLTKLTDKQAKYLGLDKEGPFKPDHYRY

SEQ ID NO: 12098 - protein, 363 aa, Pseudomonas fluorescens
MNDIQLDQASVKKRPSGAYDATTRLAASWYVAMRSNELKDKPTELTLFGRPCVAWRGATGRAVVMDRHCSHLGANLADGRIKDGCIQCPFHHWRYDEQGQCVHIPGHNQAVRQLEPVPRGARQPTLVTAERYGYVWVWYGSPLPLHPLPEISAADVDNGDFMHLHFAFETTTAVLRIVENFYDAQHATPVHALPISAFELKLFDDWRQWPEVESLALAGAWFGAGIDFTVDRYFGPLGMLSRALGLNMSQMNLHFDGYPGGCVMTVALDGDVKYKLLQCVTPVSEGKNVMHMLISIKKVGGILRRATDFVLFGLQTRQAAGYDVKIWNGMKPDGGGAYSKYDKLVLKYRAFYRGWVDRVASER

SEQ ID NO: 12099 - protein, 738 aa, Saccharomyces cerevisiae
MHKERPLNKASMIRSPVDEIYMEQTQTAEGTDLLIGDEKTNDLPFVQLFLEEIGCTQYLDSFIQCNLVTEEEIKYLDKDILIALGVNKIGDRLKILRKSKSFQRDKRIEQVNRLKNLMEKVSSLSTATLSMNSELIPEKHCVIFILNDGSAKKVNVNGCFNADSIKKRLIRRLPHELLATNSNGEVTKMVQDYDVFVLDYTKNVLHLLYDVELVTICHANDRVEKNRLIFVSKDQTPSDKAISTSKKLYLRTLSALSQVGPSSSNLLAQNKGISHNNAEGKLRIDNTEKDRIRQIFNQRPPSEFISTNLAGYFPHTDMKRLQKTMRESFRHSARLSIAQRRPLSAESNNIGDILLKHSNAVDMALLQGLDQTRLSSKLDTTKIPKLAHKRPEDNDAISNQLELLSVESGEEEDHDFFGEDSDIVSLPTKIATPKNWLKGACIGSGSFGSVYLGMNAHTGELMAVKQVEIKNNNIGVPTDNNKQANSDENNEQEEQQEKIEDVGAVSHPKTNQNIHRKMVDALQHEMNLLKELHHENIVTYYGASQEGGNLNIFLEYVPGGSVSSMLNNYGPFEESLITNFTRQILIGVAYLHKKNIIHRDIKGANILIDIKGCVKITDFGISKKLSPLNKKQNKRASLQGSVFWMSPEVVKQTATTAKADIWSTGCVVIEMFTGKHPFPDFSQMQAIFKIGTNTTPEIPSWATSEGKNFLRKAFELDYQYRPSALELLQHPWLDAHII

SEQ ID NO: 12100 - protein, 368 aa, Gallus gallus
MAAVAGAAAAGGSAGAGGPEMVRGQVFDVGPRYTNLSYIGEGAYGMVCSAYDNVNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLNCIINLKARNYLLSLPHKNKVPWNRLFPNADPKALDLLDKMLTFNPHKRIEVEQALAHPYLEQYYDPSDEPVAEAPFKFDMELDDLPKEKLKELIFEETARFQPGYRS

SEQ ID NO: 12101 - protein, 489 aa, Eptatretus stoutii
MDSKEKQLTFRLAFAVTVAALGSLLFGFNIGVMNAPEQIIKDFFNETWMGRSGVEIEKATLLTLWSFTVAIFTVGGMVGSLSVGLFVNRFGRRNPMCLNNLLAVLGGAFMAMSKDASSYETLILGRFVIGLYCGLATGFVPMYLGEISPTNLRGAVGTIHQLAIVFGILISQVLGLNFIFGSENRWPILLGLAIIPAVVQALALPFCPKSPRFLLINQTKEKEAKDVLKQLRGVEDVGTEMLEMKEEHRRMTQEPKVSILQLFRHPNYRQAIIISIVLQLSQQLSGINAVFYYSTGIFSKAGVDQAEYATIGAGVVNAAFTIVSLFLVERLGRRLLHLVGLGGMAVCTVIMTLSLHFMTKAPAVSYLAIIAFFGFVAFFEIGPGPIPWFIVAELFSQGPRPAAVAVAGCSNWTSNFLVAMLFPFAQELMGPFVFLIFTVLLIFFTIFTYFRVPETKGRTFDDIASEFRVKAGMKPEAAENIQLNTDSSV

SEQ ID NO: 12102 - protein, 582 aa, Drosophila melanogaster
MFSKRTLLICALALILGSAQARPNTSAVGVAPRKVSQDIVDAVTQLNLGQSAPIDAVDVGLDPTPSARVPRPEPLKSGDENAKGDEGHKMERYPLSSVDFARVKTPFIIGIWILSASIAKIGFHMTPKLHLIFPESCLLIVVGVVIGVVLYFCTDVAVSPLTPNTFFFYMLPPIILDAGYFMPNRLFFDNLGTILLMAVVGTIFNIATIGGSLYACGKMGIYGESETPGLMDVFLFASLISAVDPVAVLAVFEEIHVNEILYIVVFGESLLNDAVTVVMYHMMESYNEIGLDKIIAQDIASGVGSFFVVALGGTAIGIIWGFLTGLVTRFTDHVRVIEPIFIFVMAYLAYLNAEIFHMSGILAITFCGITMKNYVESNISQKSHTTVKYALKMLSSSAETIIFMFLGVATVNNMHVWNTWFVVLTIAFCSVFRVIGVILLSALANRFRLHKLSRVDQFVMSYGGLRGAVAFALVLLVDENVVKQKNMFVTTTIAVIYFTVFLQGITIKPLVKILNVKRANKRKPTMNERIHERFMDHLMAGIEDIVGKTGNYNVRDKFKRFDNRFIRPLLIRDLKVFLHLSL

SEQ ID NO: 12103 - protein, 314 aa, Drosophila melanogaster
MSNKINPKRREPTAAAAGAGATGVATNTSTSTGSSSAGNTSSANTSSSSSSSLSSAGGGDAGMSADLTSLFECPVCFDYVLPPILQCSSGHLVCVSCRSKLTCCPTCRGPLANIRNLAMEKVASNVKFPCKHSGYGCTASLVYTEKTEHEETCECRPYLCPCPGASCKWQGPLDLVMQHLMMSHKSITTLQGEDIVFLATDINLPGAVDWVMMQSCFGHHFMLVLEKQEKYDGHQQFFAIVQLIGSRKEAENFVYRLELNGNRRRLTWEAMPRSIHEGVASAIHNSDCLVFDTSIAQLFADNGNLGINVTISLV

SEQ ID NO: 12104 - protein, 231 aa, Drosophila melanogaster
MANKVLRKVTHCVFDMDGLLLDTERLYTVATEMILEPYGKTYPFEIKEQVMGLQTEPLARFMVEHYELPMSWEEYARQQRANTEILMRNAQLMPGAERLLRHLHANKVPFCLATSSGADMVELKTAQHRELFSLFNHKVCGSSDKEVVNGKPAPDIFLVAAGRFGVPPKPSDCLVFEDSPNGVTAANSAGMQVVMVPDPRLSQEKTSHATQVLASLADFKPEQFGLPAFTD

SEQ ID NO: 12105 - protein, 582 aa, Drosophila melanogaster
MPQMRAAAAEAVAAGSANGQPLVKIGHYLLGATLGTGTFGKVKIGEHQITRVKVAVKILNRQKIKSLDVVGKIRREIQNLKLFRHPHIIKLYQVISTPSDIFMIMEYVSGGELFDYIVKHGKLQEHQARRFFQQIISGVDYCHRHMIVHRDLKPENLLLDHNMHVKIADFGLSNMMLDGEFLRTSCGSPNYAAPEVISGKLYAGPEVDIWSCGVILYALLCGTLPFDDEHVPTLFRKIKSGIFPIPEYLNKQVVNLVCQMLQVDPLKRANIEEIKKHEWFQKDLPAYLFPSSIEQDSNVIDTYAVAEVCTKFGVKETEVHNSLLSGDPHDQLAIAYHLIIDNKRFADDAANQINEINNFFVAGSPPPPPPPPVPQSSMDHQAPLATVTVGGGTSASSGTATPVPPVAGGTPSSTIPIRPHPERIAPMRDRQLAMSVQTSGGGAFPEKTARGGTPIKRAKWHLGIRSQSKPNDIMLEVYRAMKALSYEWKIINPYHVRVRRQNVKTGKFSKMSLQLYQVDAKSYLLDFKSLTNDEVEQGDDVIMESLTPPPLSVSGVMPLQPTGHHTMEFFEMCAALIIQLAR

SEQ ID NO: 12106 - protein, 162 aa, Drosophila melanogaster
MPSIKLQSSDEEIFDTDIQIAKCSGTIKTMLEDCGMEDDENAIVPLPNVNSTILRKVLTWAHYHKDDPQPTEDDESKEKRTDDIISWDADFLKVDQGTLFELILAANYLDIKGLLELTCKTVANMIKGKTPEEIRKTFNIKKDFSPAEEEQVRKENEWCEEK

SEQ ID NO: 12107 - protein, 355 aa, Drosophila melanogaster
MGCAVSTARDKEAIERSKNIDRALRAEGERAASEVKLLLLGAGESGKSTIVKQMKIIHDTGYSQEECEEYRRVVFSNTVQSLMVIIRAMGRLKIEFADPSRTDIARQFFTHASAADEGILLPEIVLLMKKLWADGGVQQSFARSREYQLNDSAGYYLNSLDRIAQPNYIPTQQDVLRTRVKTTGIIETHFSCKQLHFKLFDVGGQRSERKKWIHCFEGVTAIIFCVALSGYDLVLAEDEEMNRMIESLKLFDSICNSKWFVETSIILFLNKKDLFEEKIKRSPLTICFPEYTGTNTFEEAANYIRMKFENLNKRKDQKEIYTHLTCATDTNNVKFVFDAVTDVIIKNNLKQIGLF

SEQ ID NO: 12108 - protein, 309 aa, Saccharomyces cerevisiae
MDSKEVLVHVKNLEKNKSNDAAVLEILHVLDKEFFPTEKLLRETKVGVEVNKFKKSTNVEISKLVKKMISSWKAQLIKNKRCRQPQQHHQDHAPGNAEDKTTVGESVNGVQQPASSQSDAMKQDKYVSTKPRNSKNDGVDTAIYHHKLRDQVLKALYDVLAKESEHPPQSILHTAKAIESEMNKVNNCDTNEAAYKARYRIIYSNVISKNNPDLKHKIANGDITPEFLATCDAKDLAPAPLKQKIEEIAKQNLYNAQGATIERSVTDRFTCGKCKEKKVSYYQLQTRSADEPLTTFCTCEACGNRWKFS

SEQ ID NO: 12109 - protein, 136 aa, Citrus sinensis
AVSRKKCVPLKSDLGEFPVPDPAILVKSLNLKDFNGKWYISSGLNPPFDTFDCLLHEFHTESNKLIGNLSWRIRTPDGGFFTRPAMQRFFQDPIHPGILYKHDNEYLHYKDDWYILSSKIQNEPDDYVFVYYRGSN

SEQ ID NO: 12110 - protein, 353 aa, Saccharomyces cerevisiae
MPKRIVYNISSDFQLKSLLGEGAYGVVCSATHKPTGEIVAIKKIEPFDKPLFALRTLREIKILKHFKHENIITIFNIQRPDSFENFNEVYIIQELMQTDLHRVISTQMLSDDHIQYFIYQTLRAVKVLHGSNVIHRDLKPSNLLINSNCDLKVCDFGLARIIDESAADNSEPTGQQSGMTEYVATRWYRAPEVMLTSAKYSRAMDVWSCGCILAELFLRRPIFPGRDYRHQLLLIFGIIGTPHSDNDLRCIESPRAREYIKSLPMYPAAPLEKMFPRVNPKGIDLLQRMLVFDPAKRITAKEALEHPYLQTYHDPNDEPEGEPIPPSFFEFDHHKEALTTKDLKKLIWNEIFS

SEQ ID NO: 12111 - protein, 236 aa, Oryza sativa (indica cultivar-group)
MAGADVDVGTELRLGLPGGGGGAAEAAAKAAKRGFEETIDLKLKLPTAGMEEAAAGKAEAPAAEKAKRPAEAAAADAEKPPAPKAQAVGWPPVRSFRRNIMTVQSVKSKKEEEADKQQQQPAANASGSNSSAFVKVSMDGAPYLRKVDLKMYNSYKDLSLALQKMFGTFTATGNNMNEVNGSDAGTTYEDKDGDWMLVGDVPWQMFVESCKRLRIMKGSEAIGLAPRAKDKYKNKS

SEQ ID NO: 12112 - protein, 323 aa, Nostoc sp. PCC 7120
MITTTSNTKFSTDIVRNYLQDIVRVPLLTHEEEIVYSKQVQQMMVLQKKKETLKKQLNHEPSQKELAKYVQLSEIEVKDIFQQGTQAKQKMMVANLRLVVAIAKKYQRRNLELMDLIQEGSLGLERGVEKFDPTRGYKFSTYAYWWISQAMTRAISQQSRTIRLPIHITEKLNKFKKVQRELSQKLKRSPSADEIAEKMKLNPAQIRELLMISRQPASLDKQVGDNEDTELQELLTEVPETSPEIQVTQNLMRQDIYLSLRELTPQQQQVLILHYGLEDNYELTLTQVAQHLNISERRVRYLEKQALSYLRRCQTNLREYIFS

SEQ ID NO: 12113 - protein, 332 aa, Nostoc sp. PCC 7120
MPNSTSQVTKLKSKNNEFSYTADAVSIYLHKIGRVPLLSHEQEIFFAQQVQQMMVMFTAKEELAEKLQREPTLQEWADKMQLKEDVLLQQLSQGQIAKQKMIQANLRLVVSIAKKYQKRNLEFLDLIQEGALGLERGVEKFDPTLGYKFSTYAYWWIRQGITRAIAQQSRTIRLPIHMADKLNKIKCVQRELSQKLGYIAGVTEIAQALNLEPSQIREYLQLVRQPVSLDMRIGFEQDTQLQDLLKDDGMSPERYAERELLYQDIHNLLAKLTPQQKEVLILRFGLAGGCELTLVQISQRMGISRERVRQVEKQALTLLRRYGIDSRSYLAD

SEQ ID NO: 12114 - protein, 449 aa, Saccharomyces cerevisiae
MGLCASSEKNGSTPDTQTASAGSDNVGKAKVPPKQEPQKTVRTVNTANQQEKQQQRQQQPSPHNVKDRKEQNGSINNAISPTATANTSGSQQINIDSALRDRSSNVAAQPSLSDASSGSNDKELKVLLLGAGESGKSTVLQQLKILHQNGFSEQEIKEYIPLIYQNLLEIGRNLIQARTRFNVNLEPECELTQQDLSRTMSYEMPNNYTGQFPEDIAGVISTLWALPSTQDLVNGPNASKFYLMDSTPYFMENFTRITSPNYRPTQQDILRSRQMTSGIFDTVIDMGSDIKMHIYDVGGQRSERKKWIHCFDNVTLVIFCVSLSEYDQTLMEDKNQNRFQESLVLFDNIVNSRWFARTSVVLFLNKIDLFAEKLRKVPMENYFPDYTGGSDINKAAKYILWRFVQLNRANLSIYPHVTQATDTSNIRLVFAAIKETILENTLKDSGVLQ

SEQ ID NO: 12115 - protein, 833 aa, Saccharomyces cerevisiae
MNNAANTGTTNESNVSDAPRIEPLPSLNDDDIEKILQPNDIFTTDRTDASTTSSTAIEDIINPSLDPQSAASPVPSSSFFHDSRKPSTSTHLVRRGTPLGIYQTNLYGHNSRENTNPNSTLLSSKLLAHPPVPYGQNPDLLQHAVYRAQPSSGTTNAQPRQTTRRYQSHKSRPAFVNKLWSMLNDDSNTKLIQWAEDGKSFIVTNREEFVHQILPKYFKHSNFASFVRQLNMYGWHKVQDVKSGSIQSSSDDKWQFENENFIRGREDLLEKIIRQKGSSNNHNSPSGNGNPANGSNIPLDNAAGSNNSNNNISSSNSFFNNGHLLQGKTLRLMNEANLGDKNDVTAILGELEQIKYNQIAISKDLLRINKDNELLWQENMMARERHRTQQQALEKMFRFLTSIVPHLDPKMIMDGLGDPKVNNEKLNSANNIGLNRDNTGTIDELKSNDSFINDDRNSFTNATTNARNNMSPNNDDNSIDTASTNTTNRKKNIDENIKNNNDIINDIIFNTNLANNLSNYNFNNNAGSPIRPYKQRYLLKNRANSSTSSENPSLTPLISNLIMTAKFQKFLLMTKKKKKPDFRPFTSRDPNNQTSENTFDPNRFTMLSDDDLKKDSHTNDNKHNESDLFWDNVHRNIDEQDARLQNLENMVHILSPGYPNKSFNNKTSSTNTNSNMESAVNVNSPGFNLQDYLTGESNSPNSVHSVPSNGSGSTPLPMPNDNDTEHASTSVNQGENGSGLTPFLTVDDHTLNDNNTSEGSTRVSPDIKFSATENTKVSDNLPSFNDHSYSTQADTAPENAKKRFVEEIPEPAIVEIQDPTEYNDHRLPKRVKK

SEQ ID NO: 12116 - protein, 273 aa, Datura stramonium
MEESKVSMMNCNNEGRWSLKGTTALVTGGSKGIGYAIVEELAGLGARVYTCSRNEKELDECLEIWREKGLNVEGSVCDLLSRTERDKLMQTVAHVFDGKLNILVNNAGVVIHKEAKDFTEKDYNIIMGTNFEAAYHLSQIAYPLLKASQNGNVIFLSSIAGFSALPSVSLYSASKGAINQMTKSLACEWAKDNIRVNSVAPGVILTPLVETAIKKNPHQKEEIDNFIVKTPMGRAGKPQEVSALIAFLCFPAASYITGQIIWADGGFTANGGF

SEQ ID NO: 12117 - protein, 260 aa, Datura stramonium
MAGRWNLEGCTALVTGGSRGIGYGIVEELASLGASVYTCSRNQKELNDCLTQWRSKGFKVEASVCDLSSRSERQELMNTVANHFHGKLNILVNNAGIVIYKEAKDYTVEDYSLIMSINFEAAYHLSVLAHPFLKASERGNVVFISSVSGALAVPYEAVYGATKGAMDQLTRCLAFEWAKDNIRVNGVGPGVIATSLVEMTIQDPEQKENLNKLIDRCALRRMGEPKELAAMVAFLCFPAASYVTGQIIYVDGGLMANCGF

SEQ ID NO: 12118 - protein, 260 aa, Hyoscyamus niger
MAGRWNLEGCTALVTGGSRGIGYGIVEELANLGASVYTCSRNQKELDECLTQWRSKGFNVEASVCDLSSRSEREEFMKTVSNHFHGKLNILVNNAGIVIYKEAKDYTMEDYSHIMSINFEAAYHLSVLAHPFLKASERGNVVFISSISGASALPYEAVYGATKGAMDQLTRCLAFEWAKDNIRVNGVGPGVIATSMVEMTIQDPEQKENLDKLIDRCALRRMGEPKELAAVVAFLCFPAASYVTGQIIYVDGGFMANGGF

SEQ ID NO: 12119 - protein, 268 aa, Datura stramonium
MAGREIGGGDRRWSLRGMTALVTGGTRGIGYAIVEELANFGAEVYTCSRSQNDLDECLEKWRRKGFKVSGPVCDVSSISQRQTLMESVTSSFNGKLNILINNAGTTIPKEATNFTAEDYSIIMGTNFEASYNLCQLAHPLLKASGNASIVFNSSAAGVIAVPLSSIYAASKGAINQVTKSLACEWAKDSIRVNAVAPWIINTPIIEAACQVPSQKKNIESLIGRAPMKRAGEPSEVSSLVTYLCLPTASYITGQIICVDGGYTVNGFI

SEQ ID NO: 12120 - protein, 1153 aa, Saccharomyces cerevisiae
MPNPNTADYLVNPNFRTSKGGSLSPTPEAFNDTRVAAPATLRMMGKQSGPRNDQQQAPLMPPADIKQGKEQAAQRQNDASRPNGAVELRQFHRRSLGDWEFLETVGAGSMGKVKLVKHRQTKEICVIKIVNRASKAYLHKQHSLPSPKNESEILERQKRLEKEIARDKRTVREASLGQILYHPHICRLFEMCTMSNHFYMLFEYVSGGQLLDYIIHDGSLKEHHARKFARGIASALQYLHANNIVHRDLKIENIMISSSGEIKIIDFGLSNIFDYRKQLHTFCGSLYFAAPELLKAQPYTGPEVDIWSFGIVLYVLVCGKVPFDDENSSILHEKIKKGKVDYPSHLSIEVISLLTRMIVVDPLRRATLKNVVEHPWMNRGYDFKAPSYVPNRVPLTPEMIDSQVLKEMYRLEFIDDIEDTRRSLIRLVTEKEYIQLSQEYWDKLSNAKGLSSSLNNNYLNSTAQQTLIQNHITSNPSQSGYNEPDSNFEDPTLAYHPLLSIYHLVSEMVARKLAKLQRRQALALQAQAQQRQQQQQVALGTKVALNNNSPDIMTKMRSPQKEVVPNPGIFQVPAIGTSGTSNNTNTSNKPPLHVMVPPKLTIPEQAHTSPTSRKSSDIHTELNGVLKSTPVPVSGEYQQRSASPVVGEHQEKNTIGGIFRRISQSGQSQHPTRQSGTYSSKENLQHICQNQMKFPSKYRKAIVVLYQTYIPSARRYPSYVPNSVDVKQKPAKNTTIAPPIRSVSQKQNSDLPALPQKRQLIVQKQRQKLLQENLDKLQINDNDNNNVNAVVDGINNDNSDHYLSVPLSVPKGRKLHPSARAKSVGHARRESLKFTRPPIPAALPPSDMTNDNGFLGEANKERYNPVSSNFSTVPEDSTTYSNDTNNRLTSVYSQELTEKQILEEASKAPPGSMPSIDYPKSMFLKGFFSVQTTSSKPLPIVRHNIISVLTRMNIDFKEVKGGFICVQQRPSIETAAVPVITTTGVGLDSGKAMDLQNSLDSQLSSSYHSTASSASRNSSIKRQGSYKRGQNNIPLTPLTTNSIHQRKTSIPMSPNYGNQSNGTSGELSSMSLDYVQQQDDILTTSRAQNINNVNGQTEQTNTSGIKERPPIKFEIHIVKVRIVGLAGVHFKKVSGNTWLYKELASYILKELNL

SEQ ID NO: 12121 - protein, 471 aa, Aedes aegypti
MVKFHLLVLIAFTCYTCSDATLWNPYKKLMRGSASPPRPGESGEPLFLTPLLQDGKIEEARNKARVNHPMLSSVESYSGFMTVDAKHNSNLFFWYVPAKNNREQAPILVWLQGGPGASSLFGMFEENGPFHIHRNKSVKQREYSWHQNHHMIYIDNPVGTGFSFTDSDEGYSTNEEHVGENLMKFIQQFFVLFPNLLKHPFYISGESYGGKFVPAFGYAIHNSQSQPKINLQGLAIGDGYTDPLNQLNYGEYLYELGLIDLNGRKKFDEDTAAAIACAERKDMNSANRLIQGLFDGLDGQESYFKKVTGFSSYYNFIKGDEESKQDSVLMEFLSNPEVRKGIHVGELPFHDSDGHNKVAEMLSEDTLDTVAPWVSKLLSHYRVLFYNGQLDIICAYPMTVDFLMKMPFDGDSEYKRANREIYRVDGEIAGYKKRAGRLQEVLIRNAGHMVPRDQPKWAFDMITSFTHKNYL

SEQ ID NO: 12122 - protein, 472 aa, Spinacia oleracea
MALVARSICVSYDEIAGICNNVSHRNFKKWVQWKNPFLFQDDARRNIRFNDRKLSCTKFIGASEKLQHSKSPKSGLISCGWEVNSSKVVSNAVIPKKWNLLKLKVVEVTAIVACTFFVMSSAQAVDALKTCTCLLKECRIELAKCIANPSCAANVACLQTCNNRPDETECQIKCGDLFANKVVDEFNECAVSRKKCVPQKSDVGEFPVPDPSVLVKSFNMADFNGKWFISSGLNPTFDAFDCQLHEFHLEDGKLVGNLSWRIKTPDGGFFTRTAVQKFAQDPSQPGMLYNHDNAYLHYQDDWYILSSKIENQPDDYVFVYYRGRNDAWDGYGGAFLYTRSATVPENIVPELNRAAQSVGKDFNKFIRTDNTCGPEPPLVERLEKTVEEGERTIIKEVEQLEGEIEGDLEKVGKTEMTLFQRLLEGFQELQKDEEYFLKELNKEERELLEDLKMEAGEVEKLFGRALPIRKLR

SEQ ID NO: 12123 - protein, 503 aa, Pisum sativum
MAITVSSRQLFIDGEWRVPILNKRIPNINPSTENIIGDIPAATKEDVDLAVDAAKRAISRKNGRDWSAASGSLRARYLRAIAAKIKEKKDELGKLESIDCGKPLEEALADLDDVVACFEYYAGLAEELDSKQKAPISLPMDTFKSYILKEPIGVVALITPWNYPFLMATWKIAPALAAGCAAILKPSELASVTCLELGEICKEVGLPRGVLNIVTGLGHEAGASLASHPDVDKISFTGSSATGSKIMTTAAQLVKPVSLELGGKSPIVVFEDVDLDKVAEWTGFGCFFTNGQICSATSRLIVHESIAVEFVDKLVKWAENIKISDPLEEGCRLGPIVSEAQYKKVLNCISSAKSEGATILTGGRRPEHLKKGYFVEPTIITDVTTSMQIWREEVFGPVLAVKTFSTEEEAINLANDTHYGLGSAVMSNDLERCERLSKALQAGIVWINCAQPSFIQAPWGGIKRSGFGRELGEWGLENYLSVKQVTRYTSDEPWGWYQPPSKL

SEQ ID NO: 12124 - protein, 510 aa, Sorghum bicolor
MAVFISSSGSPGRATATTTTTTTLLLAVLAAAAAAGLLLAPVAARGSPPEHDKQLQLQQQEDDRIPGLPGQPNGVAFGMYGGYVTIDDNNGRALYYWFQEADTADPAAAPLVLWLNGGPGCSSIGLGAMQELGPFRVHTNGESLLLNEYAWNKAANILFAESPAGVVFSYSNTSSDLSMGDDKMAQDTYTFLVKWFERFPHYNYREFYIAGESGHFIPQLSQVVYRNRNNSPFINFQGLLVSSGLTNDHEDMIGMFELWWHHGLISDETRDSGLKVCPGTSFMHPTPECTEVWNKALAEQGNINPYTIYTPTCDREPSPYQRRFWAPHGRAAPPPLMLPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVSPSGAGHLVPVHRPAQAFLLFKQFLKGEPMPAEEKNDILLPSEKAPFY

SEQ ID NO: 12125 - protein, 373 aa, Strongylocentrotus purpuratus
MASSVPSRSTPERYVQAAEIGSGAYGIVYKARDTETGHFVALKSVRIPIGEEGMPVSTIREISLLRHLCQLDHPNIVKLLDVCDVMDVGRSEMMLTLVFELVDQDLAQYLEKCPPPGLSSCTIKFLMHQLLSGVEYLHSHRVTHRDLKPQNILVASDKKLKLTDFGLSRVYSFQMALTPVVVTMWYRAPEVLLQASYATPVDMWSVGCIFAELYRRRPLFRGQSDKDQLHKIFEVIGLPPEDQWPDVALPWSSFRQTGQRSFLDLVQEICNQGLDLLERMLCFNPDHRMTAEQGLLHGFFGDEEEDDEEDDDTEVEDDDDEEDEDDEGVDVGQERSQSASTSSMSQATDDSGSHSQFFSDSSQSQDVTPTNKR

SEQ ID NO: 12126 - protein, 371 aa, Lytechinus variegatus
MASPVPSQSSPERYVQAAEIGSGAYGIVYKARDTETGHFVALKSVRIPIGEEGMPVSTIREISLLRHLCQLDHPNIVKLLDVCDVMDVGRSEMMLTLVFELVDQDLAQYLERCPPPGLSSSTIKVLMQQLLSGVEYLHSHRVTHRDLKPQNILIACDKKLKLTDFGLSRVYSFQMALTPVVVTMWYRAPEVLLQASYATPVDMWSVGCIFAELHRRRPLFRGQSDKDQLHKIFEVIGLPPEDQWPDVALPWSSFRQTGQRSFLDLVQEICNHGLDLLERMLCFNPDHRITAEQSLSHSYFDDEQGDEEEEDDDDTEVEEEDDDEGVDVGQERSLSVASSRMSLSTDDSGSHSQFGVSDDSQSQEITPTNVR

SEQ ID NO: 12127 - protein, 484 aa, Agrobacterium tumefaciens
MIKLKNAALLRDACLVNGRWLKAADGKTIAVENPANSMIIGHVPSLSADEVEAAVESANKAFSEWSRRAAKDRAAILRRWFDLMVANADDLGALMTAEQGKPFAEARGEALYAASFVEWFAEEAKRVYGDTIPSPTTDKRITILKQPIGVCAAITPWNFPAAMITRKAAPALAAGCTMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPGVLIGPLIDQDAVAKVEDHVADALGKGAKIVTGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSGLGREGSHYGIDEYLEIKYLCSAIG

SEQ ID NO: 12128 - protein, 263 aa, Agrobacterium tumefaciens
MTDIRLYMLQSGTLKCKVHNIKMNQGNGADYEIPVPFFLITHPGGHTVIDGGNAIEVATDPRGHWGGICDVYWPVLDKDQGCVDQIKALGFDPADVKYVVQSHLHLDHTGAIGRFPNATHIVQRSEYEYAFTPDWFAGGGYIRKDFDKPGLKWQFLNGTQDDYYDVYGDGTLTTIFTPGHAPGHQSLLVRLPNSKPLLLTIDAAYTLDHWEEKALPGFLASTVDTVRSVQKLRTYAEKHDATVVTGHDPDAWANFKKAPEFYA

SEQ ID NO: 12129 - protein, 441 aa, Brassica napus
MVGAKPIENGSDGGASTGLLHGRYELGRLLGHGTFAKVYHARNVTTGKSVAMKVVGKEKVVKVGMVDQIKREISVMRMVKHPNIVELHEVMASKTKIYFAMELVRGGELFAKVAKGRLREDVARVYFQQLISAVDFCHSRGVYHRDLKPENLLLDEEGNLKVTDFGLSAFTEHLKQDGLLHTTCGTPAYVAPEVILKKGYDGAKADLWSCGVILFVLLAGYLPFQDDNLVNMYRKIYRGDFKCPGWLSSDARRLVTKLLDPNPNTRITIDKVMDSHWFKKSSTRSRNEPVAATPEAEEDVDVSVHKSKEETETLNAFHIIALSEGFDLSPLFEEKKKEEKMEMRFATSRPASSVISSLEEAAKVGNKFDVRKSECRVRIEGKQNGRKGKLAVEAEIFAVAPSFVVVEVKKDHGDTLEYNNFCSTALRPALKDIFWTSTTPA

SEQ ID NO: 12130 - protein, 294 aa, Helianthus annuus
MEQYEKVEKIGEGTYGVVYKARDKVTNETIALKKIRLEQEDEGVPSTAIREISLLKEMQHGNIVRLQDVVHSDKRLYLVFEYLDLDLKKHMDSCPEFSKDPRLVKTFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRIMGTPNEETWPGVTSLPDFKSAFPKWSSKDLATVVPNLEKTGLDLLRKMLCLDPSKRITARTALEHEYFKDIGFVP

SEQ ID NO: 12131 - protein, 164 aa, Datura ferox
FSSKLPWKETLSFRYSAQKDSSHIVEEYFQRTLGESFNHLGNTYQEYCNSMSTLSLGIMELLGMSLGVEKNHFKEFFEENESIMRLNYYPPCQKPELTLGTGPHCDPTSLTILHQDCVGGLQVFVDNEWRSISPNFNAFVVNIGDTFMALSNGRYKSCLHRAVV

SEQ ID NO: 12132 - protein, 706 aa, Sinorhizobium meliloti
MQNRVVSCRFTGSTARRATMPEGIRGRSHILFLVPLSRAESVGRLHQVQRFKVNLPVFVGSVAVIALFVGIGVIAPKRAESIFSGMQTAILSGFGWLYLLSVAVFLFSMLFLAFSRYGELKLGPDDSEPEFRYLSWIAMLFAAGMGIGLMYFAVGEPMTHFASPPEAEPLTIAAQREAMSVTFFHWGVHAWAIYSVVGLSLAYFGYRYNLPLTVRSGLYPLLKEGIHGPIGHVVDIFAICGTMFGLATSLGFGILQINSGLNYLLGIPQSIYVQLLLVTVVTAIATISVVTGVEKGVRILSETNLFLAVLLMLFVLVVGPTGTLMRDFVQNIGLYLDSLVLRTFNIYAYEPRPWIDSWTLFYWAWWISWSPFVGMFIARISRGRTVREFVTAVLFVPAMFTFLWMTVFGNTAIYVDTTIANGELARDVKADLSVALFQFFEYLPWPAVTSTLAVLLVSIFFVTSSDSGSLVIDTIASGGETATPALQRIFWCSLSGIVAAVLLSTGGLTALQSATISTALPFSLVMLILVWSLFVGMRADLARTQSPGSLGPRAYPASGVPWQRRLAMTLSTPDRRAVEKFLQASVLPALEAVARELTRRSRPASVGRDAETGALTLTVPAEGHRDFVYGVQMSEHKLPAFTAYDATVADVRYEARTFFSDGSRGYDIMGMADNQIINDVLFQFERYTGFVRSPESSLLATSPEER

SEQ ID NO: 12133 - protein, 355 aa, Arabidopsis thaliana
MACINGENRDFSSSSSLSSLPMIVSRNFSARDDGETGDEFPFERIFPVYARGTLNPVADPVLLDFTNSSYDPIWDSIREEAKLEAEEEPVLSSFLYASILSHDCLEQALSFVLANRLQNPTLLATQLMDIFCNVMVHDRGIQSSIRLDVQAFKDRDPACLSYSSAILHLKGYLALQAYRVAHKLWKQGRKLLALALQSRVSEVFGIDIHPAARIGKGILLDHGTGVVIGETAVIGDRVSILHGVTLGGTGKETGDRHPNIGDGALLGACVTILGNIKIGAGAMVAAGSLVLKDVPSHSMVAGNPAKLIGFVDEQDPSMTMEHDATREFFQNVAVAYRETIPNGSSVSGSCRERRH

SEQ ID NO: 12134 - protein, 473 aa, Oryza sativa
MALKVVSFPGDLAAVSFLDSNRGGAFNQLKVDLPFQTRDRRAVSLRRTCCSMQQAPPPAWPGRAVVEPGRRSWDGPKPISIVGSTGSIGTQTLDIVAENPDKFRVVALAAGSNVTLLADQVKTFKPKHVAVRNESLVDELKEALADCDWKPEIIPGEQGVIEVARHPDAVTVVTGIVGCAGLKPTVAAIEAGKDIALANKETLIAGGPFVLPLAQKHKVKILPADSEHSAIFQCIQGLPEGALRRIILTASGGAFRDWPVDKLKEVKVADALKHPNWNMGKKITVDSATLFNKGLEVIEAHYLFGAEYDDIEIVIHPQSIIHSMIETQDSSVLAQLGWPDMRIPILYTMSWPDRIYCSEVTWPRLDLCKLGSLTFKAPDNVKYPSMDLAYAAGRAGGTMTGVLSAANEKAVELFIDEKIGYLDIFKVVELTCDAHRNELVTRPSLEEIIHYDLWAREYAASLQPSTGLSPVPV

SEQ ID NO: 12135 - protein, 974 aa, Gossypium hirsutum
MMESGVPVCHTCGEHVGLNVNGEPFVACHECNFPICKSCFEYDLKEGRKACLRCGSPYDENLLDDVEKTTGDQSTMAAHLSKSQDVGIHARHISSVSTLDSEMTGDNGNPIWKNRVESWKEKKNKKKKPATTKVEREAEIPPEQQMEDKPAPDASQPLSTIIPIPKSRLAPYRTVIIMRLIILGLFFHYRVTHPVDSAFGLWLTSVICEIWFAFSWVLDQFPKWYPVNRETYIDRLSARYDREGEPNELAAVDFFVSTVDPLKEPPLITANTVLSILALDYPVDKVSCYISDDGAAMLTFESLVETADFARKWVPFCKKFSIEPRAPEFYFSQKIVYLKDKVQPSFVKERRAMKRDYEEYKIRINALVAKAQKTPEEGWTMQDGTPWPGNNPRDHPGMIQVFLGYSGAHDIEGNELPRLVYVSREKRPGYQHHKQAGADNALVRVSAALTNAPFILNLDCDHYVNNSKAVREAMCCLMDPQGGRDVCYVQFPQRCDGIDRSERYAKRNTVFFDVNMKGRDGSQGPVYVGTGCVCNRQALYGYGPPSMPSFPKSSSSSCSCCCPGKKEPKEPTELYRDAKREELDAAIFNLREIDNYDEYERSMLISQTSFEKTFGLSSVFIESTLMENGGVAESANPSTLIKEAIHVIGCGYEEKTAWGKEIGWIYGSVTEDILTGFKMHCRGWRSIYCMPLRPAFKGSAPINLSDRLHQVLRWALGSLEIFLSRHCPLWYGFGGGRLKWLQRLAYINTSVYPFTSLPLIAYCSLPAICLLTGKFIIPTLSNLASVLYLGLFLSIIVTAVLELRWSGVSIEDLWRNEQFWVIGGVSAHLFAVFQGFLKMLAGIDTNFTVTAKAADDADFGELYIVKWTTLLIPPTTLLIVNMVGVVAGFSDALNKGYEAWGPLFGKVFFSFWVILHLYPFLKGLMGRQNRTPTIVVLWSVLLASVFSLVWVRINPFVSTADSTTVSRANSSIDC

SEQ ID NO: 12136 - protein, 197 aa, Strongylocentrotus purpuratus
  unsure (1)..(197): unsure at all Xaa locations
METTEQGDGQVLSMSSDQFLTSGLYGQTSADDSLPGVADDEGPLXEKGACSPLREQDRFLPIANVARIMKDGIPKSGKISKEAKECVQECVSEFISFITSEASERCHQEKRKTINGEDILYAMSNLGFDNYVDPLKSYLQKYRESMKGDKVIXQARQDELGDMSADTFATELMSXDQAGTQVYQQYPSQVQIPMTFT

SEQ ID NO: 12137 - protein, 256 aa, Staphylococcus epidermidis
MAKESKSANEVSPEQINQWIKQHQENEDSQAQDKLVKHYRKLIESLAYKYSKGQSHHEDLVQVGMVGLIGAINRFDLSFDRKFEAFLVPTVIGEIKRYLRDKTWSVHVPRRIKEIGPRIKKVSDELTNELERSPSISEIAQRLEVSDEEVLEAMEMGQSYNALSVDHSIEADKDGSTVTLLDIMGQQDDNYDLTEKRMILERILPILSERERQIIQCTFIEGLSQKETGERIGLSQMHVSRLQRTAIKKLQEAARQ

SEQ ID NO: 12138 - protein, 1315 aa, Botryotinia fuckeliana
MEDSTIAHTTAILQTLALSSIDLPLTNVYGNKGIRLPGADTAEKLALERELAALVSRVQRLEARAITVNNQTLPDTPNELGAPSAFADVLTGAPSRASKSTTSRQQLVNSLLAAREAPTGGERPPKFTKLSDEELEALREHVDHQSKQLDSQKSELAGVHAQLFEQKQRQEQALNVLEVERVAALERELKKHQQANEAFQKALREIGEIVTAVARGDLSKKVQIHSVEMDPEITTFKRVINTMMDQLQIFSSEVSRVAREVGTEGILGGQAKISGVDGTWKELTDNVNVMAQNLTDQVREIASVTTAVAHGDLTQKIERPAQGEILQLQQTINTMVDQLRTFAAEVTRVARDVGTEGILGGQAEIEGVQGMWNTLIVNVNAMANNLTTQVRDIAIVTTAVAKGDLTQKVQAECKGEIKQLKETINSMVDQLQQFAREVTKIAREVGTEGRLGGQATVHDVEGTWRDLTENVNGMAMNLTTQVREIAKVTTAVARGDLTKKIEVEVQGEIASLKDTINTMVDRLSTFAFEVSKVAREVGTDGTLGGQAQVDNVEGKWKDLTENVNTMARNLTTQVRGISTVTQAIANGDMSQKIEVAAAGEILILKETINNMVDRLSIFSNEVQRVAKDVGVDGKMGGQADVAGIGGRWKEITTDVNTMANNLTTQVRAFGDITNAATDGDFTKLITVEASGEMDELKRKINQMVYNLRDSIQRNTLAREAAEFANRTKSEFLANMSHEIRTPMNGIIGMTQLTLDTDLTQYQREMLNIVHNLANSLLTIIDDILDLSKIEANRMIMEEIPYTLRGTVFNALKTLAVKANEKFLDLTYRVDSSVPDHVVGDSFRLRQVILNLVGNAIKFTEHGEVSLTIQKAEQDHCAPNEYAVEFCVSDTGIGIQADKLNLIFDTFQQADGSMTRKFGGTGLGLSISKRLVNLMRGDVWVKSQYGKGSSFYFTCTVRLATSDISFIQKQLKPYQGHNVLFIDKGQTGHGKEIITMLTQLGLVPVVVDSEQHTILLGNGRTKEKIASTYDVIVVDSIESARKLRSIDEFKYIPIVLLAPVIHVSLKSALDLGITSYMTTPCLTIDLGNGMIPALENRAAPSLADNTKSFDILLAEDNIVNQRLAVKILEKYHHVVTVVGNGQEALDAIKEKRYDVILMDVQMPIMGGFEATAKIREYERSLGTQRTPIIALTAHAMLGDREKCIQAQMDEYLSKPLKQNHLIQTILKCATLGGALLEKGREVRQSANEESPNSQNGPRGTQHPASSPTPAHMRPAIEPRAYTTTGPINHGSAESPSLVTADAEDPLARLLMRAHSS

SEQ ID NO: 12139 - protein, 126 aa, Nicotiana tabacum
LSLNPFGQVPAFEDGDLKLFESRAITQYIAHVYADNGYQLILQDPKKMPSMSVWMEVEGQKFEPPATKLTWELGIKPIIGMTTDDAAVKESEAQLSKVLDIYETRLAESKYLGGDSFTLVDLHHIP

SEQ ID NO: 12140 - protein, 502 aa, Saccharomyces cerevisiae
MLCAISGKVPRRPVLSPKSRTIFEKSLLEQYVKDTGNDPITNEPLSIEEIVEIVPSAQQASLTESTNSATLKANYSIPNLLTSLQNEWDAIMLENFKLRSTLDSLTKKLSTVMYERDAAKLVAAQLLMEKNEDSKDLPKSSQQAVAITREEFLQGLLQSSRDFVARGKLKAPKWPILKNLELLQAQNYSRNIKTFPYKELNKSMYYDKWVCMCRCEDGALHFTQLKDSKTITTITTPNRTGGEHPAIISRGPCNRLLLLYPGNQITILDSKTNKVLREIEVDSANEIIYMYGHNEVNTEYFIWADNRGTIGFQSYEDDSQYIVHSAKSDVEYSSGVLHKDSLLLALYSPDGILDVYNLSSPDQASSRFPVDEEAKIKEVKFADNGYWMVVECDQTVVCFDLRKDVGTLAYPTYTIPEFKTGTVTYDIDDSGKNMIAYSNESNSLTIYKFDKKTKNWTKDEESALCLQSDTADFTDMDVVCGDGGIAAILKTNDSFNIVALTP

SEQ ID NO: 12141 - protein, 387 aa, Nostoc sp. PCC 7120
MEIQLGRGKTARRAYGIDEIALVPGNRTLDPSLADTRWKIGNIEREIPIIASAMDGVVDVKMAVRLSQLGALGVINLEGIQTRYADPEPILDRISSVGKDEFVSLMQELYAEPIKPELITKRIQEIKEQGGIAAVSATPVGASKYGEVVAKAGADLFFIQATVVSTAHLSPESVVPLDLAEFCRSMPIPVILGNCVTYEVTLNLLKAGAAAVLVGIGPGAACTSRGVLGVGVPQATAIADCAAARDDYYQETGNYIPIIADGGLITGGDICKCIACGADGVMIGSPFARAAEAPGRGFHWGMATPSPVLPRGTRIRVGTTGTLEQILTGPAGLDDGTHNLLGALKTSMGTLGAKDIKEMQQVEVVIAPSLLTEGKVYQKAQQLGMGK

SEQ ID NO: 12142 - protein, 715 aa, Nostoc sp. PCC 7120
MSELWTYFFNSTPFIPHGHCYLWQTDLVWLHIISDGLIALAYYSIPATLFYFVRKRQDLPFYWIFLLFSGFIVACGTTHIMEVWTLWYPTYWVSGFLKAITAIISVFTALTLIPLVPKALLLPSSAQLERANKDLQNEIGERLKVEAELRKYQNHLEELVTIRTNEITNANEKLQQQINERQHIVEILRESEERYRYLAEAIPQLVWTADANGECDYFNQNWCDYTGLNLEESLGSGWLAALHLEDLERSYETWSKAVETGALYENEYRFKRAADGSYRWLLGRGLPLKDHQGRVVKWFGTCTDIHEQKQILEERARLLELEQTARAEAETANRIKDEFLAVLSHELRTPLNAILGWSKLLQERKLDPTRTFQALATIERNATLQVQLIEDLLDISRILQGKLVINITKVNLVTVILAALETMRLAAESKLIQVLTNFPPNIGQVMGDSARLQQVVWNLLSNAVKFTPNGGKIEVTLDKMEGYAQIVVSDTGKGIQPEFLPYVFDYFRQADSSSTRRFGGLGLGLAIVRKIVEIHGGTVTAQSLGEEQGASFTVRLPILPEEDGSVTYQQHRSASLVTNSLPLEGIKVLVVDDDADSRDFLAFILEQEGADVSLATSALEVLQLLPEIKPDVLVSDISMPDMDGYTLIRQMRTWTAEQGGAIPAIALTAFARQYDREQALQAGFQLHLPKPLNAEEFIAAVVELVKSQHSIVSFH

SEQ ID NO: 12143 - protein, 363 aa, Nostoc sp. PCC 7120; identical to SEQ ID NO: 1137

SEQ ID NO: 12144 - protein, 222 aa, Nostoc sp. PCC 7120
MLADIRAAIFDMDGLLFDTESIARWAWQQALASHGYIMSDNFYSEFVGRDLSWREKILKQRYGNDFPFDAIKRHRIEIGDRRELQEGLPMKVGALNLLCQLNSLGIIIALGTGTSRSRTIRRLSNAGILPYFTTIVTSEDVPQGKPAPDIYLEVSRRIHVAPVQCVVFEDSCVGVEAAFSAGMYPIMVPDIEQPSPEIRCLTYKILDSLEQASEFLEQRLEA

SEQ ID NO: 12145 - protein, 1178 aa, Nostoc sp. PCC 7120
MTHPFLKRLHSPELPVIVFDGAMGTNLQTQNLTAEDFGGVQYEGCNEYLVHTKPEAVAKVHRDFLAVGADVIETDTFGATSIVLAEYDLADQTYYLNKKAAELAKSVAAEFSTPDKPRFVAGSIGPTTKLPTLGHIDFDTLKTCFAEQAEALLDGGVDLLLVETCQDVLQIKAALNGIEEVFGKRGERIPLMVSVTMESMGTMLVGSEINAVLTILEPFPIDILGLNCATGPDLMKPHIKYLAEHSPFVVSCIPNAGLPENVGGQAHYRLTPMELRMALMHFVEDLGVQVIGGCCGTRPEHIQQLAEIAKDLKPKVRQPSLEPAAASIYSTQPYEQDNSFLIVGERLNASGSKKCRDLLNAEDWDGLVSMARSQVKEGAHILDVNVDYVGRDGVRDMHELVSRIVNNVTLPLMLDSTEWEKMEAGLKVAGGKCLLNSTNYEDGEPRFLKVLELAKKYGAGVVIGTIDEEGMARTAEKKFQIAQRAYRQSVEYGIPPTEIFFDTLALPISTGIEEDRENGKATIESISRIRKELPGCHVILGVSNISFGLNSASRMVLNSVFLHEAMTAGMDAAIVSASKILPLSKIEERHQEVCRQLIYDQRKFEGDICIYDPLTELTKLFEGVTTKRNKGVDESLPIEERLKRHIIDGERIGLEAQLTKALEQYPPLEIINTFLLDGMKVVGELFGSGQMQLPFVLQSAETMKAAVAYLEPFMEKSESGNNAKGKVIIATVKGDVHDIGKNLVDIILSNNGYKVINLGIKQPVENIIEAYNQHKADCIAMSGLLVKSTAFMKENLEVFNEKGINVPVILGGAALTPKFVHKDCQNTYKGKVIYGKDAFSDLHFMDKLMPAKATGKWDNSLGFLDEVETEETEPTNHKSPIPSPQSPVPSPQSPVPIDTRRSEAVAIDIPRPTPPFWGTQLLQPSDISLEEIFWHMDLQALIAGQWQFRKPKEQSKEEYQAFLNEKVYPVLETWKQRIIAENLLHPQVIYGYFPCQSEGNTLYVYETNSPNATEITQFEFPRQKSSKRLCIADFFAPKDSGIIDVFPMQAVTVGEIATEFAQKLFANNQYTDYLYFHGLAVQVAEALAEWTHARIRRELGFGAEEPDNIRDILAQRYQGSRYSFGYPACPNIQDQFKQLDLLETSRINLYMDESEQLYPEQSTTAIITYHPVAKYFTA

SEQ ID NO: 12146 - protein, 670 aa, Nostoc sp. PCC 7120
MSISTSVLSDLLQSLPYLRPQLYFKASLTALSHAMEDQVLAATLDQPLVIASFQRERFYRQEAHRYQRLAQRSSQIYVLSAPETDFANSSEYYEKVAFEPDDALSQEWHLVVVADNYATCLVCRESLGSIAKNRQIPEFSPGLDMDAGRRFEGIWTSERGVSIKAAQLLLDRILVYRPDLAKKVTKACQRFGIGETKIYSNASSFVTEYACDIDTDPFVQRLVTYLQASQYKLHKAYRSIAAQARKERLVNSISTAIRRSLDPHQVLQIAAQELGQHLGASRCLIYRAQASDAQAVIEHEFLTPGTVSISGQTRELKNNSLFKEVVDHGEGVCVTDTLNDFRITNSPTLSLIAKKLAIRSWLIEPVVFQGRLLGIVELHYCSLPPHQWQPGELDLVEAIATQIGAALIQAEAYANLEELNQQLEALDRTRSNLIAITGHELRTPLSTIQVCLESLATEPDMPVELQQVMLNTALSDSERMRKLVQDFLTLSNLESGRVEWHPESLTLQECIDLALSRLRIRPGVEKPPAIKTQIDGNLPLVRADGDWLVEVLAKLVDNACKFTPTQGEIKISATHNGSQMVEVTVADTGRGIEPNRLEIVFDRFYQEEGALRRTAGGTGLGLAICRQIVNGWGGAIWAASTGKDQGSQFHFTIPVAQNSQEESWSKVKSR

SEQ ID NO: 12147 - protein, 181 aa, Nostoc sp. PCC 7120
MGTEIYLDGSGNPDSDWSEILNDGWNRELVLSVTKKFPELMLQPDSEQRPFKVSFFLHQEASFKVIPQLETELAKCKLNIKLIYSSGIDLDIVPLNSDKGQAMQFLRQKWKFAAERTVVCGDSGNDIALFAVGNERGIIVGNARPELLQWHSEYPADHRYLAKNFCAGGIIEGLQFFGFLE

SEQ ID NO: 12148 - protein, 996 aa, Nostoc sp. PCC 7120
MVLQVQTSTYEAKTQEIARQLLGATQENRSFFASLRDQMRWDDKLLAWAMSNPGLRVQLFRFIDTLPALHSKAEIAAHLQEYLGDESVELPAALKGMLNFANPDSVPGQVAATTVSTAVETLAHKYISGENIKQVIKTVERLRKEKMAFTIDLLGEAVITETEAQSYLERYLELIAQLTEASKNWGTIAAIDEADGEQLAKVQVSVKLTAFYSQFDPLDAKGSEEKVSDRIRILLRRAKELGAAIHFDMEQYAYKDLTLNILQKILLEDEFRQRTDIGITIQAYLRDSEQDARNAIAWLKQRGYPLTIRLVKGAYWDQETIKAAQKHWPQPVFNDKAATDANFEAITQLLLENHQYVYSAIGSHNVRSQALAMAIAETLNVPRRRFEMQVLYGMGDKLAKALVDRGYRVRVYCPYGDLLPGMAYLIRRLLENTANSSFLRQNLENRPVEELLAAPKVDLAQAKVHSPEAFPQGKHFVGAADTDYAEEEDRTKAARAFAVVRGELGKTYLPLINGEYVQTAEVIDSVNPSNFSEVIGKVGLISVEQAEQAMQAAKAAFPGWRRTSVKERAGILRRAGDLMEQRRAELSAWIVLEVGKPVKEADGEVSEAIDFCRYYADEMERLHQGINYDVDGETNRYIYQPRGIVVVISPWNFPLAIACGMTVAALVTGNCTLLKPAETSSVITAKLTEILVEAGIPKGVFQYVPGKGSQVGAYLVSHPDTHLIAFTGSQEVGCRIYAEAATLKPQQRHMKRVIAEMGGKNAIIVDESADLDQAVVGVVQSAFGYSGQKCSACSRVVVVEAIYDAFIHRVVEATKSLNIGEAELPSTQVGPVIDANARDRIREYIEKGKAESQVALELSAPNHGYFVGPVIFGEVPPHGTIAQQEIFGPVLAVIKAKDFAQALAIANDTDYALTGGLYSRTPSHIQQAQEEFEVGNLYINRNITGAIVARQPFGGFKLSGVGSKAGGPDYLLQFLEPRTITENIQRQGFAPIEGAE

SEQ ID NO: 12149 - protein, 573 aa, Nostoc sp. PCC 7120
MQVVVVKDITASQANQEGMRITESVRRKQNQTLVQLARSKTFQQGPLNAVLQEITEAAAQTLLVARVSVWLYNQDASAIECIDLYDVNQQIHSSGQSLLKESYPVYFQTLEEERSIAVYDAINDKRTQELSATYLSVSGVVSLLDAPIWVGGRLVGVVFHEHCGELRQWTVDEENFAGSIADFVSLAMETKERNIAQEALRKSEAQFRAIFELSSIGIGLVDMKAQIVDANPALCQILGYQREELCGKSFTDYISQQRGDVERYKQLMTEICIDAQQRHEKPHLEIERAFLHRDGRLVWARLSVSVIPGSSGEPEYFLAIIDDITERKQTEMKLRASQAAAEAGSRAKSEFLATMSHELRTPLNAIMGLSQLLQQEIVGSLNEKQQEYINCIYSSGEHLLALINDILDLSKVEAGKEELFLIPLLVIDVCNDVLLTVRDRAISKGLKLTQEIDPEANICIADDRRIKQMLLNLLTNAIKFTSVGEVSLIVKRVPEGINFIISDTGIGIDSNQFPLLFEPFKQLDSRLNRQYEGTGLGLALTRKLARLHGGDVTVTSTVGVGSQFTLFLPDQEI

SEQ ID NO: 12150 - protein, 635 aa, Nostoc sp. PCC 7120
MHLSEITHPNQLHGLSIRQLQQIARQIRDKHLQTVAEFGGHLGPGLGVVELTLGLYQTLDLDRDKVIWDVGHQAYPHKLITGRYSDFHTLRQKDGIAGYLKRGENKFDHFGAGHASTSISAALGMALARDMNGEKFKAVAVIGDGALTGGMALEAINHAGHLPKTNLLVVLNDNEMSISPNVGAIPRYLNKMRLSPPVQFIKDNFEEQFKHIPFVGESLSPELGRIKEGMKRLAVPKVGAVFEELGFTYMGPVDGHNLEELIATFQQAHQIAGPVLVHVATIKGKGYELAEKDQVGYHAQTPFNLTTGKAIPSNKPKPPAYAKVFSHTLVKLAEQNPKIIGITAAMATGTGLDKLQAKLPNQYIDVGIAEQHAVTLAAGLATEGMRPVAAIYSTFLQRAYDQIIHDVCIQNLPVFFCLDRAGIVGSDGPTHQGMYDIAYLRCIPNIVMMAPKDEAEMQRMVVTGIEHTTGPIAMRFPRGNGYGVPLMEEGWEPLEIGKGEILRNGDDVLIIGYGTMVYPSMQAAEILSEHGIEATVINARFVKPLDTELIVPLAQKIGRVVTLEEGCVMGGFGSAVAEALLDADVVVPVKRIGIPDVLVEHATPDESKAELGLTSRQIAERVLQAYFQKQPSPVS

SEQ ID NO: 12151 - protein, 820 aa, Nostoc sp. PCC 7120
MPMSTLSFWQFFPSAKKPVCDSPSSLQTNPVRHSRSLLAKVIVGGTTLFVVVGAYFSYQTVRSIMLTNLKGQVLSEVEQSRDEIDHWLAMLKVRVEMLANTDLVRSVDWAIASKYLKAEDQRIEDFSLFGLTTPEGWRESTVPNSKRANVTDRRWFQRSIAGYVHVGDPMIARANGISSVPISSPIRRDGNLSSSPIGVVHGSVSVDRIKYVTETLKYGENSYAFTLNSAGQAIIHPNPAFMTTIEKPGIKLVEAADSGLAAIAQKMVNQQQGIELVTLDKTKKYVAFLPLKEANWSVALVIPRENIESQLKLLDIIALAILALAGTLIGVLVYVQSAEQTQLKQSKALADAAKESADSANNAKSEFLANMSHELRTPLNGILGYAQILGRSKVLPDKERQGVNIIHQCGSHLLTLINDILDLSKIEARKLELASQAFHLPSFMQGVVEICHIRVQQKGIEFHYEPDADLPAGISADEKRLRQVLINLLGNAIKFTDRGSVALRVQRTGLEESDPRTKLRFSIVDTGVGIASADINKLFQTFEQVGEQKRKVEGTGLGLAISQQLVQLMGGQIQVKSQLGVGSEFFFEIILPLASDWSQQQTASVGNIIGYEGVKRHILVVDDRWENRAVLLNLLEPLGFIITEAENGQAGLDQLQQHLPDLVITDLVMPVMDGFEMLRKIREQEQLRSLKILVSSASVAQIDQQMSIDAGGDDFLAKPVQVNDLFTLLEKHLELTWKTEDITHKSADQQQLTELIPPPLADLQSWLELVQEGRLKKLIAAAEQLAQESDRYQPFTQQIIQLAKQFQSEQLEQFIQQYLS

SEQ ID NO: 12152 - protein, 1645 aa, Nostoc sp. PCC 7120
MLIDYQRTKVLLIDNSLENWHCLSGFLAETKYLLQRVGTAKISISSVSELMPDIILIDSSIDKIDGHYFCQNLKAEETLQNISILLLTYIDQLSEYSSYFQIGVSDFISKPLCQEELFLRMRNQLKISSQQKNQLEEYHEPFPIGNGLISLNNAVNHNVISNKKECCFQLSDLNNEESINQSLNSQSLVSSNNKITRSKNNTQEYQINAVKLYKHNLVLTKLAKNQVLYQGNLKTALAEITNVAAHNLGIERASIWLYDETLTKIQCADLFEYSRNQHSAGLSLSAKEYPTYFQALHQDEAIAVDDAYTDPRTKEFAQSYLTPLNITAMLDTPIRLAGKTVGVLCLEAVKLPHHWTPEDQNFARSLTNLVSLALEARERQRAEAAHRISEQKLASAFRASPDPIALCTYPETRYIEVNDSFCRLFGYSRSQVIGNTDKELNIWVNLEECHFLSQILEKAKAIRNHEVDFRTSNGEIKTTLFSAEMIEIDGQKYILGTAKDITERKQAEAESRLLLLTTQAIARAVDVKSALTLVLRVICQTIGWDFGEAWTPNRESHVLEHSLVCYCEEASLEEFCHQSQNLRIAPGEGLPGRVWQTKQSEWIEDVSLVKQGQFLRSPQAAKVGLKAGFGIPIIAGKEVLAVLIFFKRSSIPVDKRLLMLLGAVATQLGSLIERKLIESAHRNSEERLQLALEASDLGLWDWNITTGKIYRDWQWQKMLGYTQEDIEDDERVIEQLLHPEDLATVKSAITAHLQGVTPVYEMEFRMRCAAGGWKWVQSRGQIVERNEQGQPLRMTGTTKDITERKILEKELELREARLNAFFSGAPVGMSILDNQLRFVQINELIAHIHGKPAQEHIGKTLEEIAPRIAPLVTPLCQKVLLTGQPILNVELSLPAVNQADSLRHFLVSYFPIPGEGNQLSGVGKVIVEISDVYDELRLRKRAEEALKESIERERAIAQVIQRMRQTLDLDTIFAATTEELRQVLNCDRAVVYRFDSQGSGEFVAESWGKGWISLIEKQKNVPHLTENTAKDQSCLAKLLEYTPQATPDKNFLCVADIYQAGFGSCYIEFLERLQAKAYIIVPILSGDQVWGLLATYQNSGPRQWKTGEINIVIQIGNQLEVALQQAQLLTQTQRQSQALEAAAIAADAANRAKSEFLANMSHELRTPLNAILGFTQIMSHDKTLSKDNQQNLTIINRAGEHLLDLINDVLEMSKIEAGRTTLNINSFDLIHLLDNLQEMMQGRATAKGLHLKFEYAPNIAQHIQADESKLRQVLLNILGNAIKFTETGSIILRVKMGTGDWGLGTEEDTKTHLSIPNTQSPITNPQSLIFEIQDTGIGICDDEVCVLFEAFGQTEAGRKSQQGTGLGLAISRKYVQLMGGDISVSSAVGVGSTFSFQIQVGLVSAHEIPYQPTTRSVIGLAPQQRECRILVVDDVADSRLLLVKLLSSVGFVVQEAANGQEALAIWQQWHPQLILMDMRMPIMDGYEATHFIRSAEIENHTTIPNPHTIIIALTAHAFEEQRQAMLQVGCDDLINKPFSEKEILEKLNKYLGIKYLYQEDSSQTLKARTKIFTHDNLLPLLSTLPRDWLINLYNAAAQCSDDLILKLVGEISAENTALKEYFVDLAHNFQFEKIMEIVSTIKDIS

SEQ ID NO: 12153 - protein, 102 aa, Nostoc sp. PCC 7120
MSIYVGNLSYEVTQDTLSAVFAEYGTVKRVQLPTDRETGQPRGFGFVEMGSEAEEAAAIEALDGAEWMGRDLKVNKAKPREDRGPSGGNRGGYGGGGGRNRY

SEQ ID NO: 12154 - protein, 1002 aa, Nostoc sp. PCC 7120
MSSQLDECNRLLWEKCPVGLVLWRKNGALIDANSTYAAILGSTVPETLNFNYWQITPENYLASERTILEQLEQTGCHQAYEKEYLHQDGHLVPVKVSTVIIEKDGEKLMWSSVEDISNIRQAQKERQQSEKILKQSEARYRSLVTTNTQIIWVSSPEGICFELKDWIAYTGQTLAEAENGGWIDAVHPDDRGYTGEAWGIAVANRSQYQIEYRIRGKDGNYRYFWVWGAPVIEEDGDVREWIGTCTDIHDRKLAEAENQRLKERYRSLVTASSQIVWGTTPEGWGISSEMLTWIAYTGQSEAEVEGWGWLDPIHPDDRTRSFEAWNASVVKRSIYQTEYRLRGKDGTYRYFSVCGVPVLKQDGSIQEWIGTCTDIHDRKLAEMALRQLNHQLEARVAERTAALQNTLAEAQGLNAILDNLADGLLVVDTTGQITHYNPAFLAMHGLTATTLNGHYQELPIFGLADLIERTRSHPGEVFAADVALAKDRIGQAVGTAIFKRTDTKEAAACFGSALLIRDVTAEKEIDKMKTDFISTVSHELRTPLTSVLGFASIIQEKLQTDVFPVLSTEDRKLQKTIKRVGDNLNIIVSEAERLTSLINDVLDIAKMEAGKVEWQMQPINPGELLDWAANSTAALFETNGLQLLTEIESGLPQIIGDRNRLLQVLINLISNAVKFTEFGSVTCRVKQDKDGVCISVIDTGVGIAPEDQPKVFEKFRQVGDTLTDKPKGTGLGLPICKQIVEHHGGRIWVESEPGHGSVFSFQIPIYASNHKINANLNLDALVRQLKEHVITANKVCSENRKTILVVDDDANIRELLRQQLENEGYNVREAKDGMDAIHQIKISSPDLIVLDVMMPQINGFDVAAVLKNDPLTADIPIIILSIVENKERGHHIGIDRYLTKPINTEELLNEIGSLLSQGTSSKKVLVVDQNASTLKTISDVLQTQGYNVIEASDRQECIHKALSAKPDMIIIDSIFSQEADLVKTLKFEKELENVFFIMLSDR

SEQ ID NO: 12155 - protein, 1186 aa, Nostoc sp. PCC 7120
MKRDTTGKFVSNWDSEPKHRYSVSLTSTAWRSLDEEAHKQGISRSELIEHFARNLGSEQSLADEAISTNAGNPEQQLILATVFHQDITNNQQLQLITSPETERQITTILESITDAFVAFDENWHYTYVNQAAVKILHKTPAELIGKHVWDEVFPELVGGLAYQELHRAVVEQVAVSWEEFGEPVQCYLEANAYPFSQGVAVYFRDITERKQAEAERERLLHELETERARFEAVLRQMPAGVMIADAASGKLVLTNEQAKQILRYQFEDSLELKEYAPVTPFAAFRCDGQPYDPYEYPLPRSLLTGEVISQEEMLLRWEDNSHIFISVNSAPILDSQGQIAAAAIVFQDVTERKHLESELQQREQEFKMVAENAPDIISRIDREFRHLYVSPAVEAATGIPPEEFIGKTNTELGMPEEICNFWCENLQRAFDTGEKQVVEFSFPTPTGLRWYQSLIVPEFASDGYATTLINVARDVTDYKQIEQALRDNEERLRLALTVAQAAQRQLATIFETSPVGIALLDSQQRYVAINQALAQINGLTREQHLGRSIAELFGQSDPQLVQVFHDIYTTGEPFISPSFAVNVPGRSDRQPGYYNVYYLPTTNSNHQVEDVLVYVLDVTEQIRLERGQRFLSETSKVLASSLDYQTTLERLAQLAVPELADWCTVHMMAEDGLIEQIAVAHVDPAKLEWAEEIRRKYPLNLNDPRGAALTLRTGQSDLLIDISDELLVQSARDPEHLEILRRVGFKSAMTVPLRTQTRTLGVISFISAESGHKYDQGSMQLAEELAYRASLAIDNAHLYRLAQSDRTKAEAANRIKDEFLAVLSHELRSPLNPILGWSRILRSKQLSPTKVEQALETIERNAKLQAQLIEDLLDVSRILQGKMTLNVASVNLAATIAAALETVQLAAEAKNIHIQTTLKPISATVVGDQNRLQQVVWNLLSNAVKFTPSGGQIEVQLEQVNLYAQIQVKDSGKGIAREFLPYVFEYFRQEDGATTRQFGGLGLGLAIVRHFTELHGGTVQVSSLGQDLGATFTVRLPLNLVEQELPADDEQLKNVTDLTGTHILVVDDDADMRELAEFILIQFGAQVTTAASAVEALNIFSQFIPDLLLCDIGMPEMDGYSLMRQIRQWLPQEGGTIPAIALTAYAGEINQQQALAAGFHQHISKPVEPEELVQAIFQLLHPCFFS

SEQ ID NO: 12156 - protein, 345 aa, Nostoc sp. PCC 7120; identical to SEQ ID NO: 872

SEQ ID NO: 12157 - protein, 805 aa, Nostoc sp. PCC 7120
MHELFHPIFANGEEKAALQQLIIALDASGKRYFLRNEILHTFSQYCQQAQKPTYFYYSSSVGKLIQYTHEIVLAEDGTWFVVRPRIASQEVWRLTSDLAKFDSMSIDAFLDVSDRLVNAYEPNILEIDLNSFYEASPSISDPRNIGQGLAFLNRYLCSQIATDPQYWVELVYLALRGLQYDGINLMIGDAIPSGIHLAKQIHAAIKFLSALPPEEPYEKFYIELQKLGFEPGWGNTAQRILETITLLDKLIDSPQPAVLEAFVARVPAVFRVVLVSIHGWVAQEDVMGRDETLGQVIYVLEQARSLENKLQQEIKLAGLEVLGIQPHVIILTRLIPNCEGTYCNLRLEKLHNTENAWILRVPFGEFNPEITNNWISKFEIWPYLETFALDAEKQLLAQFQGKPNLIIGNYSDGNLVAFLLARRLKVTHCNIAHSLEKPKNLFSNLYWQDSEEKYHFSVQFTADLITMNAADFIITSSYQEIFGTPESIGQYESYKFFTMPHLYHVVDGIDLFNPKFNMVPPGVNEQVFFPYSQTADRDPNVSKHVHDLLFHRQDSQIFGYLDQPQKPPIFAVAPITSIKNLTGLAECFGRSQELQAHSNLILLTSKLNIDESTNPEEAREIEKLHNIINQYQLHGHIRWLGLRLPNQEVGEAYRLVADYRGIYIHFARFEAFGRSILEAMISGLPTFATKFGGSLEIMEDQNNGFRINPTDLEGTAEKILAFFQECDTHPEHWQEVSQWMSQRIHQKYNWQLHTSQLLALTKIYSFWNFIRPESSEARVRYMESLFHLIYKPRAEQILAKHMSCH

SEQ ID NO: 12158 - protein, 311 aa, Nostoc sp. PCC 7120
MDLLIMIPASTNYPPLLMAILQLIEPEVKDLGGFVARRSLPYPHRQMVGPFIFFDHLGPSVLPPNKGIDVRPHPHINIATLTYLFDGSIMHRDSLGIVQEIQPGAVNWMTAGKGIVHSERSPDFDRHNEANIHGIQTWIALPVEYEETEPWFTHYPDENLPTWDENNVTIKLIAGEAHGYTSPVKVFSPILYLDGLLSANGHFTIPTGYSERAVYSVTEGLSINDQPLEPYRLAILESGHEVKVSATDTARCIVIGGEPLGTRYKWWNFVSSRPERIEKAKADWRDCRFATVPDETELIPLPEVATEANPL

SEQ ID NO: 12159 - protein, 475 aa, Nostoc sp. PCC 7120
MVKDSLTFSSNTMTTTAVNPYLEGNFAPVHEEITTDTLKVIGELPPELSGMFVRNGPNPQWTPIGQYHWFDGDGMLHGVRISNGKATYRNRYVRTQRWQIEHEAGQAIWTGLMEPPQTELPSRNTGNTALIWHAGQLLALWEGGAPYAIQVPDLASIGEYTYNNQLSSAFTAHPKVDPVTGEMMFFGYSFAPPYLHYSVVSATGELVRTVPIDLPMGVMMHDFAITANYTIFMDLPLTFSVERMQRGEPMLMFESDRPSRFGILPRHGDNSQIRWFEAPSCYVFHTLNAYEDKDEVVLFACPMRSTTVLASPDSQTDPEADIPRLHRWRFHLKTGKVHEEMLDDVASEFPRINENFLGQPTQYGYTSRLAKGSIPLFEGLIKYDLSNAKSQNYEYGQGRYGSEAVFVPRPGATVEDDGWLITYVYDTGEESSELVVINAQDINSEPIARVLLPQRVPYGFHGIWVTEEQLNFRRI

SEQ ID NO: 12160 - protein, 1932 aa, Nostoc sp. PCC 7120
MATEQLTRESDELDLKQLLKTLTAVKKGDFSARMPIDQTGVAGKIADTLNDIIDQNERMAAELKRISNVVGKEGKITERASLGNVRGSWSDSVNSVNTLITDLVQPTAETTRVIRAVANGDLSQTIATEIDGRPLKGEFRQTANIVNTMVTRLSSFAGEVTRVAREVGTEGKLGVQAEVQGVAGTWKDLTDNVNLMAGNLTGQVRNIAEVATAIANGDLSKKITVDVKGEILELKNTVNTMVDQLNSFASEVTRVAREVGTEGKLGVQAEVRGVAGTWKDLTDNVNLMAGNLTAQVRNIAEVTTAVANGDLSKKITVNVKGEILELKNTVNIMVDQLNSFASEVTRVAREVGAEGKLGGQAEVRGVAGTWKDLTDSVNFMAGSLTAQVRNIAEVTTAVATGDLSKKITVDVKGEILELKNTINTMVDQLNSFASEVTRVAREVGTEGKLGVQAEVRGVAGTWKDLTDNVNLMAGNLTGQVRNIAEVATAIANGDLSKKITVDVRGEIFELKNTINIMVDQLSSFASEVTRVAREVGSEGKLGVQADVRGVAGTWKDLTDSVNFMAGSLTAQVRNIAEVTTAVATGDLSKKITVDVKGEILELKNTVNTMVDQLNSFASEVTRVAREVGTEGKLGVQAEVKGVAGTWKDLTDSVNFMAGSLTAQVRNIAEVTTAVANGDLSKKITVDVKGEILELKNTINTMVDQLNSFASEVTRVAREVGSEGKLGVQAYVRGVGGTWKDLTDNVNSMAGNLTAQVRNIAEVTKAVANGDLSKKITVDVKGEILDLKNTINTMVDQLSSFASEVTRVAREVGTEGKLGGQALVQGVAGTWKDLTDNVNSMAGNLTAQVRGIARVVTAVANGDLKRKLMLDAKGEIETLAETINEMIDTLATFANQVTTVAREVGIEGKLGGQAKVPGAAGTWKDLTDNVNELAATLTTQLRAIAEVATAVTKGDLTRSIAVEAQGEVAILKDNINQMIANLRETTQKNTEQDWLKTNLAKFTRMLQGQRDLETVSKLILSELAPLVGAQHGVFYLMEGAENQSYLQLLSTYAYRERKHLANRFQLGEGLVGQCALEKERILLTEVPSDYVKISSGLGEANPLNAVVLPVLFEGQVTAVIELASFRRFSEIHLTFFDQLTESIAIVLNTIAASMRTEELLKQSQSLAEELQTQQSELRETNQRLEQQAQSLKASEDLLRGQQEELQQTNAELEEKAELLALQKKEVERKNREIEQARRSLEEKAEQLALSSRYKSEFLANMSHELRTPLNSLLILAKLLTDNVDSNLTAKQVEYSQTIYSAGNELLALINDILDLAKIESGTMSIHATPIPLSELAEQIERGFGQIAQNKGLTFAVELAPELPTTVNTDIKRLQQVLKNLLSNAFKFTERGEVRLRIEVAKPGWNPNQQPLNPAQNVIAFAVSDTGIGIAADKQKIIFEAFQQADGTTSRKYGGTGLGLSISREIAHLLGGEIKLTSHPGQGSTFTFYLPQFSPESTLNHADAINRFGAESTLTQIDAINRVSTGYDSIVFDDRTTITNPSADNNILLIIEDDVNFARILVDMARQHGFQVLTAQSGTAGLKLAKDFQPMAILLDIRLPEMDGWTVLDRLKHDPTTRHIPVHIMTVEEGRQRGLQLGAIAYLQKPVTSEAISEALDKIRGFVERRVKNLLVVEDDELQRQSIVELIGNSDVATVAVGTGAAALEAIRTQQFDCLVLDLGLPDMTGFELMEQIKREANGATLPIIVYTGREISKNQETELRRIAETIIVKDVRSPERLLDETALFLHRVQANLPTPKREILEQLHSQDYSLVGKKVLIVDDDVRNIFALTSMLERYQMQVIYAENGREGISLLENTSDIDVVLMDVMMPEMDGYETMQLIRKKEQFKALPIIALTAKAMQGDRDQCIAAGASDYIAKPVDTEQLLSLLRVWLYR

SEQ ID NO: 12161 - protein, 922 aa, Nostoc sp. PCC 7120
MRSSVKTIIGYIHKVCFQDWRSIFMTAPVVAICVMTGGMAGLFQLLEWNTMEQYYALRPNESIDKRILIVTIDEQDITQIGKWPIPDLILAKLIIKLKAQRPAAIGLDIYRDLPVEPGHQEFLGVIKSTPNLIGIKKLVGDQVAPSPTLSELGQIALADLVVDTDGKVRRGLLSAGDSKEKIFLGLAPHLSLMYLQSKGIALEELDPTGTSLRLGKAIFTPLTGEEFSYRGTDVGGYQILLNYRGFQDNFDTVKMRDILSDSISSELIRDRIVLIGTTAKSINDFVNVGYSRNVQDEERRMAGVVVHANLVSQILSAALDGRPLLRVWPEPAEWLLVFCWSFVSSGVTWHGLQVNSQRKQSLPGWPILVILLSISIIFGSSYAAFMIGWWIPVMSPLLTTFLSTIVTTNLYKQSQLEKANQQLQDYSRTLEEKVRDRTQELETAKIAADVANQAKSEFLASMSHELRTPLNGILGYAQILERSENIAPAALEGINIIHQCGSHLLILINDILDLSKIEAGKLELHNTDFDFSYFLTGVVEMCRIRALQKGISFHYLPDPDLPQAINADEKRLRQIIINLLGNAIKFTETGGVNFTIQVLEAGADFNKIRFQVEDTGVGMTPEQLTKIFLPFEQVGDKNKQAEGTGLGLAISCRIAELMGSQIQVDSILGTGSKFWLDLNLNIISHWLQTSSVLQKKKIIGIQDKQPKVLIVDDKWENRAIICNFLRPIGFECLEAANGQEGLNIAATNEPDLIITDLAMPVIDGFEMIQTIRSLPQISKVPIFVSSASVFESDKNKSLQIGGTEFLPKPLELDKLLKYLQDYLQLDWIYAEDSKQTKISENQPSQHNNHQLIVAPPISELDKLLDLSMRGNIKGIHIILDEIEELDLNGDFIGFVTQVRQLSDSFQIKQIRALIKYLKAGVS

SEQ ID NO: 12162 - protein, 315 aa, Nostoc sp. PCC 7120
METITLGKNGPTVTPLCIGTWAWGDKLFWNYGNGYGSEQLQEAFTAALEAGVTFFDTAEVYGLGLSEELLGQFVKQAKQPVQIATKFGPLPWRFSGQSVSDALTDSLKRLQLERVDLYQVHWPFTFLLSQETLMNTLADEVKRGRIAAVGVSNYSASQMRQAHQILAARGVPLAVNQVRYSLVSRQIETEGIVATARELDVTILAYSPLAQGLLTGKYSADSDEVPTGARSIDPRFKKEGLQKIAPVISLLRSLGEKYDRTPAQVALNWLIAQGNVIPIAGVKTAQQVRQNAGALGWRLNDEEVQELEKVSRPWK

SEQ ID NO: 12163 - protein, 603 aa, Nostoc sp. PCC 7120
MQQYSSLPEHNSSIDTTPTLLAESQQLCAELWLERSLNQLQTRLHNCLESAFNTVATRTTEADIFQTVVNELDIALNSSNVGFPLCAVGIALLQPQAAVGKVYYISRPLSLGCQPPLLEERCKDGKKLRLQLQEAIKITDLQKLENQQPPRAWQLRDDFDGVIGWLLLATDNLKPHENTFTAPHPQLNTQLMERSAEQCVKALVHLKKIQSLQQKSQNLGISNQELERTNQLKNQFLANTSHEIRTPLSSIIGFTHLLLAQGYDPTRERHHEYLNIIQSSGKHLLALINDILDLSKIEANQLEVQWEKVNVPELCQNVLTLIKEKAANKGVKLSLELDPNIKTFVADPLRLKQMLLNLLFNALKFTNQGTVGLKVTQQDSFIHFTVWDTGSGISPENLALLFQPYFQIPNSSVAQHEGTGLGLVVTRKLAEIHNGSVEVESQVAHGSRFTIILPLQQNEQVLVGEDVEDEETKSAASLTPNSSKEILLVEDDLPNGELMQTHLSKLGYNVTWVKNAHEMWAKLDEQQAAVILMDVRLPDGDGLDLVKQLREKSQYQQIPIIAQTAMAMKGDRAVCLSAGVNDYISKPIDLNLLASLVAKYSQL

SEQ ID NO: 12164 - protein, 585 aa, Nostoc sp. PCC 7120
MTITANSQLPNRFPQNLESMNHKADGLLANLGAELVYVQDGVGRYLSFYWQKSELLGFNPEQIVCDGNGQEIFVPLDKVSYMKRLHCIMANLAPEKFPCWFSCHQNLFELELAITPIIPPLGTGATTVLVMGRLLQVKVNNQEVNVAITTPTQTDLASRSQQHQRLVNKITRNIRRTLDLDLIWQQTVDSLGKALRLERCIICPYQPSSSKVRVIAEYHQPDRPSMLGLEIDVTSEPAFAQALTTLEPIIMEVPGYELCPQQKILVVATCYQDQANGLIAINLRHECYPLTNAELELAKEVADQLGTAIAHATLYKELEAARQKAEEASRLKSEFLANVSHEIRTPLNGMIGFLKLILEGMADDVEEKNQFLSEAHQLSLHLLNIINDILDIAKIEAGKMELVCAPIKLEELFSDVDNFMRPQAEVKNLSFRMQLPPTSDEIVVQGNYQRLLQVMLNIVGNAIKFTHEGGITVTADVVLKKGKLQEQNFPGMVRVRIADTGIGVSLDQQDKLFQLFSQVDGSRTRQYGGTGLGLAISQKLVETMGGEVHFYSLGEGLGSTVTFTVPLYQQPVMLSSNDTDAECIG

SEQ ID NO: 12165 - protein, 811 aa, Nostoc sp. PCC 7120
MKPLASHDSISLKSHPRKQSSRNFLIRFILGGTTLIVSISAYFSYLAARNMALADIRQNAFLEVQTGVDQIEAWLSVRKVEVKTLANTSTVRSLNWAVAEPYLKTEVERIKEFFLFQMSIADGSYYTTKSGRANNNVKDREYFQQGIAGKSSVSDPFISRSTGIPLIAIATPILSTSNSPIGVFHGSVKVDHITKVINSLTYGKNSYAFALNSQGEVIVHPDSTLMSTIEKPAPSLLKINDHSLQAIAQRMVNKQQGIELMAIDGKQKYIAYIPLKAANWSVALVIPRENIESRLQFLDLIALIVGGLTITMITVLWRVQAFEQAQLKKSKEAADLANHAKSEFLANMSHELRTPLNGILGCAQILQRSSTLPEQEQHHINIIEQCGSHLLTLINDILDLAKIEAKKLELHGEDVHFPSFIQGIAEICQIRAAQKDILFVYEPASNLPIWLHIDAKRLRQVLLNLLGNAIKFTDHGQVKLKVETIEESSTQKPVKHRIRYCIEDTGIGITDAELSKIFLPFEQVGEKKRQTEGTGLGLAITRQLVQMMGSDIHVTSQVGHGSTFWFELEMVATNEWVQSMMTTSARKIIGFEGNPRRILIVDDRWENRTVLNDLLQPLGFEIMEAVNGQDGLEQAIAISTDLIITDLLMPEMDGFTLIQNLRQIPQFKNLKIIVSSASVFESDQHRSLAVGGDDFLSKPIQANELLRQLERHLNLVWIYQPSESETQAISDVVTQNNDPSTQLITPPPEVLRELLTLAKKGNFNAIIKCADQLEAEDTNLATFAHQLRQLARQFDEDVILEFLTQYEVEMA

SEQ ID NO: 12166 - protein, 250 aa, Nostoc sp. PCC 7120
MQQSLDGIENPPDSTHTSLVKNLLSGIFLEPLLSDFQIIFERDPAARNWLEVIFCYPGLHAICLHRFAHWLHRRGVVFFPRLISHLARFLTGIEIHPGAVIGKGVFIDHGMGVVIGETAIVGDYALIYQGVTLGGTGKESGKRHPTVGNHVVVGSGAKVLGNIQIGDRARIGAGSVVLRDVPHDCTVVGIPGRIITHKPKTDLSPLEHGKLPDVEADVIRSLLTRIEQLEQKLQTLTNQAKEPELLTKDK

SEQ ID NO: 12167 - protein, 425 aa, Nostoc sp. PCC 7120
MTATSPRLKHEVKDLALAPLGRQRIEWAGREMPVLRQIRDRFAQEKPFAGLRLVACAHITTETAHLAIALKAGGADAVLIASNPLSTQDDVAASLVLDHEIPVFAQKGEDNATYNRHVQIALDHRPNIIIDDGSDVVATLVQERQHQIADLIGTTEETTTGIVRLRAMFKDGVLTFPAVNVNDADTKHFFDNRYGTGQSTLDGIIRATNILLAGKNVVVVGYGWCGKGTALRARGMGANVIVTEIDPIKAIEAVMDGFRVLPMAEAAPQGDIFITVTGNKHVVRGEHFDVMKDGAIVCNSGHFDLELDLKYLAANAKEIKEVRPFTEEYKLTNGKSVVVLGQGRLINLAAAEGHPSAVMDMSFANQALACEYLVKNKGKLAPGLHSIPVEVDQEIARLKLQAMGIYIDSLTPEQIEYINSWTSGT

SEQ ID NO: 12168 - protein, 676 aa, Nostoc sp. PCC 7120
MLSSPDLSFSRNLPLVVFNQLGELLQQMAQSVETSTLLLTESLLSRVLVPMEWHGQRFTLVVSEGFSALLLGNGKQQEVPESESWVLAMPSPLNQSATGDRETQKPEIYSTSSIPQAAQPTLTLTELNTRLTFNSEAIASFLAKLRDLFGDDSYTHQHLERYRQILKPNDATLQSQFTLLLLEHLLPKQNESVTTSASVNNSEEVYSCQAVEDALKKQISQERLLNQVTTQIRKSLDLPVIMATAIAQVREFLELDRLVIYKFEGSGVNTQNTRSPRLQDWQNYGGCIVYEARATDIIPSVLDYQEQTCFSRHSQCWDKYRQGFTLVIDDIETAYALEECLLNFLRESQVRAKLAAPIIFEDKLWGLLIAHQCYNPRQWHDSDKNLLISIAEQLAIAIHQSELMRSLQDSAQRLTQEKQTLEQRVIERTMALRDALLAAEAASRLRSEFLATISHELLTPLTYVIGMSSTLLRWPLGELSQRQRDYLQTIHDSGEHLLDMINDILDLSQIEAGKTVLNIAEFSLVKIAENTIESLLEKALSEQVNLKLDLQIDPRRDRFTADAARIEQILWNLLTNAIKFTPEGGNVTLRIWVEEDTSIFQVEDTGIGIPEEQLPLLFEKFQQLDTPYRRRYEGTGLGLALTKQLVELHRGRIEVESTVGIGSIFTVWIPYQEIRA

SEQ ID NO: 12169 - protein, 416 aa, Nostoc sp. PCC 7120
MPATSFYADAAYNTQKSRQALDPDIAIDDSDLSVDEIQELEIAAADPATFGASANRRSTDLVRLYLQEIGRVRLLGRDEEVSEAQKVQRYLKLRIVLANAVKQGDEVATPYLHLIEVQERLASELGHRPSLERWAATAGINLCDLKPILSEGKRRWAEIAKMTVEELEKMQSQGLQSKEHMIKANLRLVVSVAKKYQNRGLELLDLVQEGTLGLERAVEKFDPTKGYRFSTYAYWWIRQGITRAIATSSRTIRLPVHITEKLNKIKKAQRKIAQEKGRTPTLEDLAIELDMTPTQVREVLLRVPRSVSLETKVGKDKDTELGELLETDGVTPEEMLMRESLQRDLQHLLADLTSRERDVILMRFGLADGHPYSLAEIGRALDLSRERVRQIESKALQKLRQPKRRNLIRDYLESLS

SEQ ID NO: 12170 - protein, 1333 aa, Nostoc sp. PCC 7120
MTEILSRTTQMPVSEVQEGMAVEPNHVYVIPPNTRMTIAQGVLKLIPLEKIRGVSMTVDSFLISLAEDRGNRAIGVILSGGDSDGARGLETIKAAGGITFAQCEESAKVSSMPNTAVASGHVDFILTPQKIAEELANISSHPYVNHPTPSKQVDIMPEGTDSLSIIFSLLRAATGVDFTYYKQTTLKRRIQRRMMLYKLEKLEDYAQYLQNNQAEVLALYQDLLIKVTGFFRDPEAFEALKTNVFPIITKNRTPDSPIRIWVAGCSTGEEAYSMAICLLEFLADKVANTPINIFATDINEVAIEKARIGVYKPSEVADVSPERLQRFFVQVEGGYQISKPVRELCIFARQNLISDPPFSRLDLITCRNVLIYLGATVQKKLLPIFHYGLKSTGFLMLGTSETVGEFFDLFNLVDRKNKIYSRKIAPARLGIDFISQNYPLEAFNPQPKINEDVLNNQEMQKEADRIVLNQYAPVGVIVNDDLEILQFRGQTSSYLQPAPGRPSFNLLKMAKEELRLELRTAIHQAKKQEMSVRKEGIELREGEQVRQVRIDAIPFQLTAGGERYFLVLFEDMPPSVTAAPQAASKNPNVSSRQRQQMNDEQEINRLGQELATTKEYLQSIIEEQQATNQDLRAANEEILSSNEELQSTNEELETAKEEIQATNEELNTINEELQRRNVESNQVSNDLQNLLSSINIPILMLGGDMRIRRFTPTAGRIFNLIVTDIGRPLSDINHKLTIPDLEAQILEVVGTLNLKTQEVQDNDGHWYDLRIRPYRTIDHKIDGAVVVLVDIDALKRSTEELRASKDYAEAIVATIRESLVILDIDLQVITANQFFYEKFQVTPEETEHHLIYEIGDGQWNIPQLRSLLEDVLPQQTQFQNLEVEHNFERIGQKIMRLNARKMTLLDNRRMILLVIEDITQQKQLEAERTHLLAQEQSARNAAEAANHAKDEFLSILSHELRNPLNSMLGWANLLRTHQLEEVTVNQGLEAIERSAQAQNHLISDLLDVSRISSGRLRMDAQEVELIPVIEAAIAVVRLAAEAKNIQIETKLDPTHTPMLGDPIRLQQVIWNLLSNAIKFTPTKGRIDVTLEYTYFQAQIQVKDTGAGIKADFLPYVFERFRQADGTRTRSNQGLGLGLSIVRHLVELHGGTVEVESQGEGQGSTFTIKLPVQANRKENPVATVQEPVTLTNVPEIPTDNLPSLEGVRVLIVDDEPDIRLLFKLVLEEYGVKVTEVASAREALSKLRENPGCYDILLSDIGLPEEDGYLLMRQVRALSAEEGGQIPAAALTAYAGDSEYTQALAAGFQTHIAKPIEPYQLVSLVASLAGRVRGV

SEQ ID NO: 12171 - protein, 1287 aa, Nostoc sp. PCC 7120
MLEFNHLRLHNMHGSLVAKIASAIATLVSSSILIGWLLDIQLLKTFFWSSSAIMKPNTALCFTLCGISAWLLVTKPLGEPHFSQRHKPYKKLSRAFSVSTTIIAGLKICEYLFGWELGIDKLLLGDVLTTINTPYPGRMGLNTAINFLLIGIALELLIYPRNHRSYWYAQMLVLFTTVISLQVVVSYAYKVKFSYTINPNITSMSLQTALLFIVLCIGILSGRAEKGLMKIVFSDSYGGLIARRLLVAAIAVPLFLGWLILEGQRAGRYGPAFAVSVFAVILIVIFAIIIWQNAVVIELLSQQRDRAQETLKAYEEKLASLVDANIIGIIFSDIYGGIQQANEAFLMMVGYSQEDLLTGRLNWKNITPPEYIYLDEQGIAEAQVNPKGACTPYEKEYIHQDGSRIPVLIGYVLLGEKREESVAFILDLSERQQAQQKILQLNKDLQRRVVELQTLLDVIPIGIGIAEDPECQHIKINPAFAKQLQLSTDVNASLSAPPDQRPTTFKVFHEGRELLPAELPMQYSAAHGAEVLDYEVDIVHDNGEIIKLLEYVAPLFDEDGNTRGCIGAFVDITERKQAEELLRNEQKWLEDVLNLMPRPLLFIEPETARVTFANRAADELAGGEFPRGVAAEEYHTVYHFTDINGNPVPNEQMPGVRVARGERLEGLELDWHTNDEVLSLLIFADTLPAMHGYPATCVVVFQNITQIKQAEKALSLGYQRLKLLFSTANDLLSSQEPVALIDSCFQKLAQQIGLDVYLNYLVEDNPQSMRLASYRGICPELAQEIEFLRFGEAVCGTTAQERHSIALENVQQSTDPKTQLIRSVGINAYYSYPLIAQGRLLGTLSFGSRSRANFTDNQKGMMQAVCDQIAIAMERVELINSLQRQTEQLTEANRMKDEFLAILSHELRSPLNAILGWAQLLQARRLSEAQTAKGLETIERNAKAQTQLIEDLLDISRMIRGKLRLNVRTCNLIPIIETAIENINLAAQAKEIDLTFFLENPATENLPFQVSGDSERLQQVIWNLLTNAIKFTPSGGKVEVRLTKNPGCEQNELITNNYAQIQVIDTGIGINSSFLPYVFDRFRQADSSITRSHGGLGLGLAIVRHLVELHGGTVHVHSPGEEQGSTFTVKLPLLSENKATSIEPISPRGENLTPLPLCPSLLGVRVLVVDDESDSRDFISTVLEQCQAQVRAVATAKEALQIISQWKPDVLVSDIGMPEEDGYSLIRKLRSLPPEQGGNIPATALTAYARAEDRTRAIQEGFQLHLPKPIEPTELATVVASLIKRGQ

SEQ ID NO: 12172 - protein, 680 aa, Nostoc sp. PCC 7120
MQPEPKVNILLVDDKVENLLALEAILERLGANLVRATSGEEALRCLLHQDFAVILLDVQMPGMDGFETATLIRNRGRSRQTPIIFLTAFSTSDQMLFKGYALGAVDYLLKPIDANILTSKVTVFVELFKKTQAIQHQAAQLAAINAELRQSEERFRSLSTCSPIGIFETDTAGCCKYTNPRYQAICGLDATESLDKRWLESVHSEDQERAIASWSTYIYQGGDYSDEFRFQTVDGSLRWVQVRSSPMLSGNGELLGYVGTLEDITARKQSEEIRAQVIREQTARQEAEATNRMKDEFLAVLSHELRTPLTSMLGWSKILRAKKLDEKATARALEAIERNANSQVQLIEDILDVSRIIRGQLRLNLSPVNLITVVEAALEAVRPLADTKNMTINTVLDYTLSPVSGDFARLQQIVWNLLTNAIKFTPKEGQVEIRLEGINGELSDDLTHAQIQVIDTGVGIASEFLPKVFERFRQADSTTTRSHNGLGLGLAIVRHLVELHNGTILAESPGVGKGATFTVRFPLIQENRETRPTPTEKLSGDAANSSPLAGLKVLIVDDETDTRNFLGFLFEEYGAISSTSASVETALAVIEQLKPDILISDIGMAEQDGYSLIRKLRSLPPEQGGKIPAIALTAYSREEDRQQIIEAGFQHHLSKPIDPNKLISVVASIFHLSPALSGSV

SEQ ID NO: 12173 - protein, 1194 aa, Nostoc sp. PCC 7120
MFNRLKIGSKIGAGFTISITILSTIGFISYQSIQELIAASRKERHTYQVLRQIADLNSLLSTAESGQRGYIITGEMRYLEPYQKATKSLDIRVKELQKLTSDNPQQHGYISRLEPLINERRAVMQTVLDLRQAQGFEAAQKSILSDRGRAVMAQIRNISQQMNAEELKLLEQRTAMAQNAANNTLATITYSIPLVSFILALIGYLLTRHISFPLQQISHAAERMSSGDLAVTLPNSIRQDEIGILTRTFNQMVANLSITTQKNEEQNWLKSNLAEFTQLLQGQRNLESMSSLILSKLTPLVESQQSVFYVIDRTHDEVTLKLIGSYAYNERRHLNNFVRLGEGLVGQCALEKQRILLTEVPSDYIRISSGLGAALPLNIIVLPVLFETEVIAVIEIASFHRFSQLHLTFIDQFSEVIGVFLNSIYASAQTQNLLDESVALAAELRQSNQLLEQQTQDLENSEFLLKQQQQELQQSNEELQQLNEELEEKAELLELQNNEVARKNQEIEKARKFIEEKAEQLALSSRYKSEFLANMSHELRTPLNSLLILAKLLADNSSGNLSNKQVEYSQTIYSAGTDLLELINDILDLAKIESGTLSVELEPIDFADLHDYIKRTFQQVAQDKGLSFSIERDERLPSTILSDPKRLQQILKNLLANAFKFTEQGGVNLRIGLDQINTNHPMITFAISDTGIGIPQEKQQIIFEAFQQVDGTTSRKYGGTGLGLSISRELAQMLGGRLGLVSQPGQGSTFTLYLPQTYPETKTTVISQQQTSPPHQMSPVFQENLQPIAIANSIADDRGIIQQGDRLLLIIDDDDKFARILLDMARQQGFKAIVSLNSKQGLALAQQYQPNAITLDIYMPDMDGWTLLDRLKHDPQTRHIPVHILSVDDREQRALQLGAITFLQKPVSPEILNHTLTEIKSFIDRKVKRLLVIEDDPVQAQSIIELIGNGDVQSIAVNTGAAALDILRSQHFDCIVLDLGLPDMSGLQLLEQIKQEPSLLKLPIIVYTGKEISRQEETQLRRLAESIIIKNVRSPERLLDETSLFLHRVQANLPQPQRQILEQLHQTDTILANRKILIIDDDLRNIFAITSLLESYQMQVLFAENGRDGIDILQANPDINAVLMDVMMPEMDGYETTRSIRQQKQFRTLPIIALTAKAMPGDREKCIEAGASDYITKPVDTEQLLSLLRVWLYR

SEQ ID NO: 12174 - protein, 251 aa, Nostoc sp. PCC 7120
MAILSENLRGQVAVVTGASRGIGRAIALELANYGATVVVNYASSSTAADEVVAEITGAGGEAVALKADVSQVEQVDNLINGAIDKFKRIDILVNNAGITRDTLLLRMKPEDWQAVIDLNLTGVFLCTRAVSKLMLKQRSGRIINITSVAGQMGNPGQANYSAAKAGVIGFTKTVAKELASRGITVNAVAPGFIATDMTSNLKSEGILQYIPLGRYGQPEEIAGMVRFLAADPAAAYITGQVFNVDGGMVMA

SEQ ID NO: 12175 - protein, 103 aa, Nostoc sp. PCC 7120
MSVYVGNLSYDVTEDSLNAVFAEYGSVKRVQLPTDRETGRMRGFGFVEMGSDAEETAAIEALDGAEWMGRDLKVNKAKPKEDRGSFGGGNRGGYGGGGGRNRY

SEQ ID NO: 12176 - protein, 499 aa, Nostoc sp. PCC 7120
MTTETKLQGNSQNENLLDNATEEQSSKEENIFQWTKQWYPVAVVEFLDPSRPHAMQLLGKDIVLWRDGSSQWRCFEDFCPHRLAPLSEGRVEADGTLLCAYHAWRFDAEGNCVSIPQSKDEQTAAKNCESQKSCAVVYPTQERQGLLWVWAEAGEQAKVESQLQTPRIVPELEDNSGKVIKSPWNFRDLPYGWDYFMENVSDPAHVPVSHHGIIGDRYQDAKFYDMIPIRHISTQDGFAFEIQPTQGNTVQAIHDFQPPCYMRIASTSEDGGQLILALYATPTRPGWCRHIGCQVFVKNPQGKKPQGLSFFGLPLPVWLVHVLASLFLHQDMVFLHYQEKIIAQRRNGKWLNAVYTPNPQDKMVITLRQWWENRAGGGIPWAEGYSSDIPPAEKDKQKLFDVWTTHTQHCTVCQDALKNINRLTVLAYISAAVCLFLAVILDARSVAMQAALGASIFTVPPVEFWLALGGGILLAVVGYQLKRFSRLFYVYEFEHSRND

SEQ ID NO: 12177 - protein, 517 aa, Nostoc sp. PCC 7120
MNITELIKISIILLLVATGVALLSRRLRVPYVTGLVLAGLPITELLSRPIGLDPALVLNLFLPILIFEAGINTDISRLRSTFKPIALLAGPGAILSSAIIAILLKFGLGLNWIPAFLVGVILANTDTVSMIAVFKEIPVPSRLSTIVEGETLFNDAAALVSFNLILQVYSTGSLTLIEGIQQLLFISVGGCLVGLVLGYLSIPVFNRLDDPLSSLLLTVAVALGTFQVGQFLGVSGAVAVVVAGLIFGNFGLSGNTSASSRITLLSFWEYASFTANTFIFLLIGVEINLVTLWQTLPAILLAVLAYQVGRVLTIYPLLAGVRWFDRPIPLRWQHLLFLGNIKGSLSMALALSLPTTLPGRESLIAIVFGCVLVSLVGQGLSLPFLVKRLKLSKFSHSQQQVEELQAQLITAKAAQDELDALLKTGVLPKAVYEEMRSAYQVQVAGAEKALREFYNRRPDEFDHKSGAFSKLDAIRRRLLLAEKGALTEAMRKRILSQDIGQNRIQTINEKLLQLDDD

SEQ ID NO: 12178 - protein, 1299 aa, Nostoc sp. PCC 7120
MTTDRDSSSKKFGLSPEQFAALFPFHLVIDRELKIVQAGEVIQRILEPMVLLDSYLGEHFQISRPKCLTSFEGICQQTRSLFILQAHYQEIQLKGQMLNLESRDHLLFLGSPWITDIADLKNLGLKINDFPLHDSVSDYLFLLQAKNSALADAQKLTTKLKDQKTELQTTALRLRTLIESLQSGILLEDANQHIILVNQEFCDYFRIPLPPQALQGMDCQQALEASKHLFTEPERFICTTDEIIRQGKMFLHQEWELQDGRTLEQNYIPIVVDHKLYGHLWKYRDITQYKKSEVALRLSEERLKLAVDAVEEGLWDWNLVTGEVYRSARWFTMLGYTPMEIGNDIKFRDKLIHPDDIPLMQQRLISHLKGDTPFYEVEIRLLAKSGEWRWILDRGKLVSRDSQGRAIRMVGTHLDITQRKQAEQDLQQQYQHTLLLKQITEEIRQSLQWEKILKTTVTEVQRILQVDRALIFQINSDGSGKVVQEAVMPGWSVTLDQDIYDPCLKDGYLNMYRDGRITAIADVYQGGLKPCYVEFLQQFQVKANLVVPIRVRRNLWGLLIVHQCDRPRQWTELELDLLKHLADQMGIALTQSQLLAQETRQAQLLALQNEELNVAKQVAEKANMAKSNFLATMSHEIRTPMNAIIGMSGLLLDTTLKPEQFDYVETIRNSSHTLLTIINDILDFSKIESGKLELEEQPFDLRLCVEEALDLLAPQAASKGIELMYQLEPDTPTLVVGDITRIRQILWNLVSNAVKFTKIGEICITIGAKQKIYKQTDPTRYEFQFAVQDTGIGIERDRLHRLFKPFSQVDASMTRRYGGTGLGLAISKRLSEIMGGKMWVESQSHQGSIFYFTATLQVNSSAINSAAKVDPELVGKRLLLAVGNANLRKCLTRQLQSLGLDVQAVDSNATALHCLWQHTSLALAVLDVDSPQINGLHLSTKIRAIPQHQNLPLVMLSAKGKQTLEVKQVASEFTAFLHKPLRHYQLHNTLLQIVRGKWLSKSTPQGIIPSYSRLPKPNLPAIDTHLAENLPLKILLVEDVLVNQKIAMNMLHLLGYRTDVANNGLEALEALQRQLYDVVFMDIQMPEMDGWETTHKIRQEFSPTLQPWIIAMTAHARPEDRQQCLAAGMDDYISKPISLEDITTALKKFGSQRQPALESPASVSISAPPAPTPQPKIEEVIDQQTLEYLRNLGGSDEADEDGGGSSIITELIQLYLEDTPAKIQAIQDAATLEDRSQLARIAHALRSPSVSIGAINLGKICETVEDEAKEQSMDQLTALVNQLNNEYQNVVAALKTLIF

SEQ ID NO: 12179 - protein, 105 aa, Nostoc sp. PCC 7120
MSIYVGNLSYEVTQEDISNVFAEYGSVKRVVLPTDRETGRLRGFAFVEMGSDAEETAAIEGLDGAEWMGRDLKVNKAKPKEDRGSFGGGNRGGYGGGGGGGRSRY

SEQ ID NO: 12180 - protein, 112 aa, Nostoc sp. PCC 7120; identical to SEQ ID NO: 836

SEQ ID NO: 12181 - protein, 1627 aa, Nostoc sp. PCC 7120
MKILIVEDDELNAYALTAVLTNQNYAVEVGSDGITAWELIQTYDYDLILLDVMLPRLDGISLCRQIRSSGRQMPILLLTGCDSSHEKAIGLDAGADDYVVKPFDEEELVARVRALLRRGVTTAQPILEWGNLQLDPSSCEVRYNQNLLSLTPKEYALLELFLRHSRRVFSCSMILEHIWSYEDTPGEEAVRTHIKGLRMKLRNAGAPGDLVETVYGIGYRLKAQEEEQGSKEEVKQPTSKGKSQQQTLTAIAGIWQKFYVRVDEQVKVLEQAAMTFERSQMITLTQEALNSELYSQAIREAHTLAGSLGTFGLPEGSKLARKIEQLLKSGKRLTPTEIQSLQNWVKLLRQEVAAHEPQAASPETTSAAILQPQPPQAEAKVLAVDDDPQILAILQTLLHPWGLQVITLDDPRQFWETLRDVNPDLLILDVEMPYTNGIELCQVVRNDPQWSELPILFLTVHKDGEIVNQVFSVGADDFVSKPIVGPELVTRIINRLERVKLLRRVSESRGVGEKISPPSPSFTDWRTIFNAEPECVMIVATDGTLLDINPAGVAAIEADSVGAVIGKRVYSLVVPECQQAFRQLNESVCQGKQGTLEFEIITCRGNRRWMATHAVPVRNEKDGNLVQLSITRDVTQYKQAELEIKRINRTLQTLSDCNQLVIRTQDESELLQKVCQILVDVGNYRLAWVAFAENDAEKSIHPVAQAGYEEGYLQSLNLTWADTVRGQGPTGTAIRTGKTAIIQNILTDPRFEIWRCQANNRGYASSISLPLMNNGQAFGALNIYAAEANAFDSDEVKLLEELTADVAYGIVALRNRRDRQIAEAALRESQERLSLTLEAVNLGIWDWNITTNQIIWSEGHARLFGIESGKFDGTYEAFQACIYPEDRGGLAEVINSARQQKTDYSHEFRIISPDGNIHWIEGTGKLYYNEMGEAVRMLGIVRDITSRKQIEATLQKINNELELRVAERTAELVNVNRQLQSELDERQRIEEALRISQVRLARILDIADDAIISINGNQQITLFNQGAEKIFGYSAEEIIGQRLDTLIPQRFTQTHRQHVADFGQAPSLARRMGERREIFGCRQDGTEFPAEASISKFQLDKEVFYTVILRDVTERKQIERMKDEFVSVVSHELRTPLTSIHGSLGMLASGLLSADSEQGKRLLEIATDSTERLVRLINDILDIERIESGRVKMERESCDLSDLIESAVSIMQPLANKAGVKLSVSSPSIQLWVDPDRIVQTLTNLLSNAIKFSTAEKTVWLVAQHYGDELLLTVKDNGRGIPADKLDSIFERFQQVDSSDSRNHDGTGLGLAICQSIIQQHGGRIWAESVLGEGSNFYFTLPILPISQNSELPDSLPHHPLSPEESPPSLISSTHSPLVLVCDDDPLIRTELQSLLEQGGYRVFTVATGQEAIASASTQHPDVIVLDLLMPGMNGWETMAMLKESTETKHIPIVICSVYKPTSNHQPSRDFVDWVSKPVQESYLLHSLRQAIAKSSHRVRILIVEDDADLAELFVTLFERHDIETFSAKTGREAIHLSQEVNPDLLILDLILPETDGFAVVDWLQKHQRLCNIPVVVYSAKDLDESERKRLKLGHTEFLTKGRVTTKEFEQRVIELLQRITPTNVRD

SEQ ID NO: 12182 - protein, 99 aa, Nostoc sp. PCC 7120
MSIYVGNLSYSVTQDDLTKVFSEYGSVTRVQLPTDRETGRVRGFGFVEMESSAAEDAAIQALDGAEWMGRVLKVNKARPREEKGARSGGGSWSRNNGGY

SEQ ID NO: 12183 - protein, 369 aa, Nostoc sp. PCC 7120; identical to SEQ ID NO: 1185

SEQ ID NO: 12184 - protein, 1817 aa, Nostoc sp. PCC 7120
MNRQHKHHRCNSVNLLSKQNLLPFLLGIVILLVVVMLWLRLQAEEEIKIQQLIKQQAIATQTELVTQLNTRILALKRIGKHWEMHGNIPQAQWELEAKAYLEDYGGYQAIKLVDPSWQVLRAVSVANNKAAENLEMIPKFPQWTGATSHETTVTRTVNLNQGDRVFFACVPLWMGDKFGGAVLGVFQVKQLFESVLHIAPGYKIRVFDGQELIYDQDRQSSTLPLWQQAVNIDFYGMTWQLQIYPTPELLKDLFSPLPTVVLVAGIFNAGAVTLLIYFAQATKLSNHKIGRINQELADRIEKQTQVEIALRASETRLRELVETVRVIPWEFDLKTQHFTYVGPQVETLLAYPVAQWYEENFWDNHLHTLDRDWAVRFCQEAANKGQNHELEYRMLAADGRVVWLRDVVNVVQVDGTPVMLRGFMFDITDLKRVEETLRLRERALAASSNGIVISDAKLPHYPVIYVNSAFEQITGYKATEVVGRNCRFLLGNDTQQSAIEELRSALKAGKNCKVILRNYRKDGSLFWNQLSVSPIYNDNGQLSHFIGIQTDISDRQQAEASLRRQALTFENIYDGVIITNLQGQILDWNPAAERMFGYSKNHICGQSISTLHKVDEDAALNSAIIAEITKQGRWSGEINFVRQDGSQGICETTIVALQDDQGQSMATISVNRDITERKHAELLLRRSEERFQAFMNHSPTPAWITDIDGTIVYVSETYRRTFQLPTQELIGKNIVDIYPPELTQTFRETIQIVARTRQVMETVESAPCSDGTGRDFLVYKFPISSKPDECLIGCIAIDITERKQAEAALRKSEERWQLVIEGNQDAIWDWNIITNETFRSARWAELIKEQNYQPIADHADCVSRIHPDDYERVMAVKQDCLSRKIPNYVVEYRLRCNDDSYRWVLVHATGQWDEQGNPVRMVGSIKDITERIEAQEALQRQLHRTLLLEKITQKIRQSLDSKEIFETAATQIGQALAVDRCLIHSYISHHDPHIPLVAEYNNVLDYCSMQKWEFTTTGNQHILKMMSQDKAIASANVYTDPLLQTAVPSCCEIGVKSMLAVRTSYQGEPSGAICLHQCGYFRQWTNEEIELLEAVAAQLGIALAQAQLLEQETRQREELTIKNFALEQAKRAAEAANRAKSEFLAMMSHEIRTPMNAVIGMTGLLLDTELTSQQRDFVETVLTSGDALLSIINDILDFSKIESGKLELEEQPFEVRTCVEQVIDLLAAKAAQKDIELAYLIHPQVPMQIAGDLTRLRQILTNLLNNAIKFTPEGEVVVSVRSQPSPNQKNKNCCEIIFTIKDTGIGIAPETMDLLFQPFVQADASMTRKYGGTGLGLVISKRLGEMMGGYLWVESRGCVGGNPPPGWQTKNSISSASVATGSTFYFSMTVPVVAHADLETPITSPVQLSGKRLLIVDDNPTNRQILRLQAEPWQMETYTAPSGAEALALIDQGMAFDIAILDVQMPEMDGLTLARQIRQRPSYQHLPLVILTSWGQPDTDLSDIEFAACLNKPIKQSQLYDVLASTLGNQPIRASVVPDRSTEINSCLAQQIPLRILLAEDIVVNQKVALLILKKMGYRADVVANGLEVLEALQRQFYDVVLMDVNMPEMDGLKASQIICQTWSPSSRPYIIAMTANAMRGDREACLAAGMDHYISKPLQLEELAKALGKCHPSGSAIEKALEKTSSQNQTFTDISDLKFATIDTKILQALRDMLGGDKVAFAELINCYLTESPKLIQNIDVAINTKDTQGIWKTAHKFKSSSGSVGAVFLAQLCKLLETKGRNNNLEGCVELGSQLRQEYELVQTALHREVNKETS

SEQ ID NO: 12185 - protein, 646 aa, Nostoc sp. PCC 7120
MAQPLTVLIIDDCVEDRQVYRRYLQQDQEHNYTILEKDSGEEALELCRQLQPDVILLDFLLPDQDGLEFLAELQKLVKGSMPAIVMLTGYGNEAIAVQAMKSGVHDYLVKEQTTAERLRSTLHSAIIQTRLRQELSRSEEQLHNSQKFIKRIAETTPGILYVYDLVEKRNVYLNGKVGDLLGYTPQTIQDLGKEFLIKLMHPEDLVQLPQVFQQFDSAKDGDIIEHEYRMHHANGGWCWFFSRNSVFTRNADGSPRQIVGTAFDITARKQVEEELRSSNERFRLAAAAINALIYEWDVKKGTVTRTEGLTRILGYSVEEATPTIEWWQEQIHPEDQDFLVQQFQNLPVNQNRYTFEYRIRHKNKQYLYVLDQGVITRDENGQPVRVVGSTTDISDRKRAETERNQLLQLEKLARAEAEAANHTKDEFVAMVSHDLRSPLNAILGWSQLLRTRQLDETTFTRALETIERNAQSQSKLLEDLLDMSRVLRGKLQLEFCQVDLAAIIGVAIETAYPSAKAKNIHLKSVIDESIPLIPGDINRLLQVLGNLLSNAIKFTPPEGQITVQLSYTDSEAHITVTDTGIGIKSEFLPYVFDRYRQADCQHKQHGLGLGLAIARYLIELHGGAIHVTSPGEGQGTTFTIKLLLYK

SEQ ID NO: 12186 - protein, 751 aa, Nostoc sp. PCC 7120
MNINDITIPFQVDLSNCSKEPIHIPGLIQPHGVLLVLQEVDLTILQVSNNTFNILGRHPEQLLNQHLSCLLEAEQLSLLKDCLAQEDLQIINPLEFIIKSHNESISFDVIAHRSNNLLILELEANLSDKTHSFFRFYHLVKLAMLKLQGTATTTEISQILAQEVRKITGFDRVMVYRFDEQWNGKVIAEVKPEYLTSYLGLNYPASDIPQQARKLYSQNWLRLIPDAKYQPVPIVPINNPLNDQPLDLSRSVLRSVSPLHIEYMQNMGVTASMSISIMKNQKLWGLIACHHQSPKYIPYEIRSACEFLGQMTSVEMSAKEDSEDTEDKIQVKSVHSKLVQYMSAENDFINALIDHQPNILDLVKAQGAAVCFNGNSCTVGQVPPMPDIQVLVEWMSQNIHEEIFATDSLATVYPDAEKLRDVASGLIALSISRSQKNYILWFRPEVVRTVDWGGNPHKPVEVIANGEIRLSPRKSFDLWKETVLLKSQPWKSHEVNAALELRSAIIGIVLQKADELAQLNIELERSNQELDAFAYIASHDLKEPLRGIHNYSNFLMEDYGEIIDAPGKEKLLTLIRLTQRMEDLIDSLLHFSRLGRVDLSMQDTDLNEIVHRILDMLSGRIEETGVEIRILQLLPVVYCDRIQIGEVFSNLIANSIKYNDKANKWIEIGYIDNPPLPPTFYVRDNGIGIREKHFETIFRIFKRLHSPSKYGGGTGAGLTIAKKIVERHGGKIWVESTYGEGSTFYFTLQDV

SEQ ID NO: 12187 - protein, 103 aa, Nostoc sp. PCC 7120
MSIYVGNLSYDVTEESLNAVFAEYGSVKRVQLPVDRETGRVRGFGFVEMGSDAEETAAIEALDGAEWMGRDLKVNKAKPREDRGGSRGSFGGNRSNNNFRNRY

SEQ ID NO: 12188 - protein, 464 aa, Nostoc sp. PCC 7120
MVSTHPAGVQDAGTQYLPQRRNTNTNISPNQELLPLTAKANSQGNLEIGGCDVTTLVEQFGSPLYILDEETLRTACQQYRDGFQKYYPGESQVLYASKAWNCLAVCAIAASEGLGIDVVSGGELYTALAAGVSPAKIYLHGNNKSREELVLAIESGVTIVADNWYELRILASLADSEEPIRLMLRLTPGIECHTHEYIRTGHLDSKFGFDPNDLAEVFEFVSQQPNLNCVGLHAHIGSQIFERQPHRDLAAVMVQWLRDANKYGLNVTELNVGGGLGIKYVESDDPPSIDEWVKAICEVVQAACAAENLPLPKLLSEPGRSLIATSCITAYTVGSSKTIPEIRTYVSIDGGMSDNPRPITYQSVYRAVIANKLSAPHTETVTIAGKHCESGDILIKNAQLPKTEPGDILVVMATGAYNYSMASNYNRLPRPAAVVVANGEANLILQRETYQDLIRQDCLPERLK

SEQ ID NO: 12189 - protein, 396 aa, Nostoc sp. PCC 7120
MEFSQVLADNTNIIIAKWVVAVREDRQIESADDLSYTAIKNHIPDVFKAMVTVLSQSQESDIKSIVTASWQHGLLRAEQGFDPSEIAREYRLLRKVVFDTIEVDLLQRTPGEIIRSMRLIDAVIDEAIARCFHSYVGERLRELEHLQSSLTLHNEELTRLVTSNEDKLSQLAHELKHPLTAIIGYSDLFLRQQRREITRIDNTVNIEHIERVLRNGRHLLRLINNVLELSRYEAGKIQLQPAPIHIRDLINNVCEMLEPLAAEKNLAILINWVQAPSEIITDGFQLQQIITNLVSNAIRYTESGNISIVCEAIDDQKWAIAVSDTGIGIAEKDQTKIFEPYFRVSSKDRPYLPDSTGLGLAIVSRLVKLLQGEINLVSKEGLGSTFTVTLPLKVKT

SEQ ID NO: 12190 - protein, 1290 aa, Nostoc sp. PCC 7120
MSNIQRSHLQRYCISIVSVLLALLLGLTLGRYLKVEISPLFFASVVFSSWYGGLAPGLVATVLAILVKNYFFITPFNSIAVSQGNDLLNLIVFASVAVLISSLNLQVLTAREVSEAKLGKLKVNYRQLLETAYEGIWIFDSEGKTEYVSPQLAQILGYSVERIGEFSIFNFLEPQARLEIEQWLEQQQKYNHQTKQQFDLRLQRRDGASLWVIVSLSSILDKHRRFSGAVAMLTDITEHKHEQAEPDLERQRLRAILDILPMGVVISDAKGQLLEINPGVKAIWGEDAPLLDNTSQYHQYKGWWPDTGQPLTAAEWTLARTLATGEAIIGEEIDIATFDGKRKTILNSAVPIYDATGAIVNAVTVNVDITERKRVEAALRQSEALAKARAEELETIMETVPAAVWIAHDPLCHSMSVNRAAYDMMRVPPGSVMTATPASGGYPFPFKIQKNGQDIPLNELAMQQAGLTGQEVEAEVEFFFSPEDVRHIYGKAIPLCDPDGNVRGVIGAFLDVTERQQLMSLLQQKQEWLDLAQKSGKIGSFDWKLTSNINVWSQELEEIYGLQPGEFGGTFADWAKHVHPDDLARVEVELRELLNTGSKEFFSDFRIIRQDGSICWLQSRARVFYDDHGQPLRMVGVNVDVTERKQAEAALQQSEARLKRLLQSSIIGIIEADPERINFANDAFLKIVGYTHEDLLTGKLRWQDMTPPEYSELDQAKVEEVINSGFCIPFEKEYIRKDGSRVPILLGAARLSSSPLTWVCFILDLTERKQAQAALQQSELMFRTLADTMPQMFWITQPNGYHEYFNQRWYDYTGTTLEQTQGAGWQNILHPDDVQRTIEQWQDSLDTGKDYDIEYRLRRAADGEYRWHLGRAFPLRDENGRILKWFGSCTDIHDQKLAIEERAQAWEQERAARIELERANRMKDDFLAIVSHELRSPLNPILGWAKLLKSRKLDALKTNQALEVIERNAKLQARLIDDLLDVSRILRGKLSLNVCTVDLVTTIEAALETVRLTAESKSIHIQTELTSHVCRVEGDPNRLQQVVWNLLTNAVKFTPEGGQIEVSLERVGSLAHIQVRDTGKGISLDFLPYVFERFRQADEVTTRKFGGLGLGLAIVRHLVELHGGAVQVTSPGEGLGTTFTVKLPLIAVSQIYEEHFVADTTPNLQGLRMVVVDDDADTLELLSFILEQYGVEVKAVNSANEALEAIAHTKPDLLLSDIGMPEVDGYMLIKQIRSMEVASGTKLPAIALTAFAGETNFQKIMSAGFQRHLTKPVEPSELATAIANLIQSNS

SEQ ID NO: 12191 - protein, 410 aa, Nostoc sp. PCC 7120
MAHPQPQAENRKSRVLVAVGGGIAAYKVCEVVSNLFKSGVEVRVILTRSAQEFITPLTLSTLSRHPAYTDDDFWQSTHSRPLHIELGEWADLLVIAPLTANTLAKLTYGMADNLLTNTVLASNCPALLAPAMNTDMWEQLTVQRNWQQLLTDSRYHGIGTASGLLACDRVGAGRMAEPPEILAYTQSLLHTQGKRDLAGKRVLISAGGTREYLDPVRFIGNPSTGKMGLALAQAALHRGAKVTLVHGVASWVVPLGVQAIPIINAEEMQQVMLEYLPNADIIVMSAAVADVKPQDYSTEKLPKRSLPQSLPLEPVPDIVAQLGKLKQPHQRLIGFAAQTGDIVTPAKEKLYSKKLDAIVANPIDKADSGFGSDNNQAIFLDNQDRQVTIPPCSKLQLAHHLFDFVSNLTL

SEQ ID NO: 12192 - protein, 1286 aa, Nostoc sp. PCC 7120
MGILKNKSRSFSMFNCTTSLTPSELKSAIIRDPLIIKPETTVMDAIAQMSGVRVMCDTAKLDEVHLEARSSCVLIVAAGRLLGIFTERDVVKLCSQRRCLENLAIREVMIHPVVTLRESEFTDLFFAVNLLQQYRIRHIPILDEQERVVGLLTNESLRHTSRSVDLLRLRLVSEVMTCEVICATPDSSMLAIAQQMTENRVSSVMIVQLGQFQDKPQEIPVGIVTERDIVQFQALGLNLETCQVQTVMSSPIFAVRPDDSLRFVQQIMEQRLIRRLAVTGDQGELLGIVTQSSLLQALNPLEVYKLAQMLEEKVVRLETEKVQLLENRTVELEQLVADRTASLKAKAGREQIVSDISRQIRSSLSLQTILDTTVEQVRQLLGCDRVNIWYFETEWESIVMAESTTSSTSLLGERIEELCFQQHSAEIYRQGRIRVVPDIYTIEMTDCHREFLIRLQTRAKILVPLLCGDELWGLLNVSESQHPREWQTEEVELLQGLSVHLAIAIHQATTHQKLQEQLIALQQRSDQLRGSEQRYITLSQNLEAKIEERTAELQAREAQLQKTSDRLSISLKSGAIGCWDWDIVENNIFWDERMYELYGVTKTSDSRLVYDTWANRLHPDDRANIEVLVQQAILGQAEYDTEFRVIHPDGSIHFIKAYGVVVRDAEGNPQKMIGVHFDISDRKKSEEIIRQQVEREKLLREITQRIRQSLDLQTIFDIACQEICQVIQADRVGIFKFYPESNFNDGEFVAESVVKEFPSVIAIRVHDHCFGENYSSLYALGRSYVVDDIYHSDMTTCHTDILAQFHVRANVIMPLLCGAELWGLLCIHQCATTRHWQQSEIDFTQQLATQLAIAIQQASLVEQLQQELAERHQAELKLTQSNQQLAISNQELARATRLKDEFLANMSHELRTPLNAILGMTEGLQEGVFGMINNKQFKALETIERSSSHLLDLINDILDVAKIEAGQIKLDCTTISVANLCESSLVFIKQQALQKRIQVEIKIPFNLPDLFVDERRIRQVLINLLNNAVKFTPEAGRISLEVTQLSPDISTVQNFLQIAVIDTGIGIMQENINKLFQPFIQIDSALNRQYEGTGLGLALVKKIVELHGGRVGLTSELGIGSCFTIELPCIPSTPASPDLIRDLLTTPTPELDSPTADEAVSLAPVILLAEDNKANIKTFSSYLSAKGYDILLATNGQQAIELATIHQPDLILMDIQMPGIDGLEAIRQIRLDPQLVNIPIVALTALAMTGDRDRCLQAGANDYLTKPVKLKQLATTIQQLLITTKK

SEQ ID NO: 12193 - protein, 889 aa, Nostoc sp. PCC 7120
MTDSMKIAIMRRWLMISLLGLFALVIAHGMALIYRIQPGVSLWFPPSGVAIALTFWFGPCGIILTGLASFLMSPFWGLHGWERLIALVDIIEPLSAWLLYRRLWKGSRTINTLKDATLFTVSAPLVACATLAIIGSVCLVAIGKMPLASLSSNIPHWWLGNAIGVMAIAPTALLVFTPYFQSQGWLHPTESLNSGFVSQNFHPSRCLLLEFSAILLLCLAIATLTVAETNQNGFKLQQLSFLGFVPVLWAATRFGVTSGMLTSSFCVLVTLFAYLVAYPKAMYLATFPVQAEVLHVHKLSLLVQCAVSLFVGIAITERSSIQVELAVEKVRRGEYQTRAELSEKLIQLNESLVAINDCLEESHREKDELLQREQALRSRLSNILSSMTDAFIAVNRDWDITYCNHQAAKIQDLEPEDLIGKNYWEQWTRTKGTDFEREYRRSLAENIPVHFEILYELWDMWLEVHAYPSEDGLGIFFRNITERKQAEQEREYLLMREQIARGEAERANRLKDDFLAVLSHELRTPLNPILGWATLLKKRNLEEATRRRGIETIERNAKLQIQLIEDLLDVSRIQQGKLSLNIQSVNLVHTIEEALETVRLAIEAKSIHIKTALGVNVGMVAGDAARLQQIIWNLLANAIKFTPPAGQIQVVLERVNNSAQIQIQDNGKGISSEFLPYVFEYFRQADGTITRQFGGLGLGLAIVKHLTELHGGTVKAESAGEGMGAIFTVNLPLMLNAPQKVPQVGQPDNTWSLGGLYILVVDDDVDTGEFLTLMLEQSGAEVTAVTSAGEALEVIARTKVDLLLSDIGMPGIDGYMLMQLIRAMPSAKGGKIPAIALTAYAGEINQKQALAAGFQLHLVKPVEAEKLLQGISEVLAASPPEFSYVSVEN

SEQ ID NO: 12194 - protein, 143 aa, Nostoc sp. PCC 7120
MDEFMQAAIQEAKQGRQEGGIPIGSVLVKDGKILGRGHNKRVQDRDPVTHAEIDCLRNAGRIGSYRGTTLYSTLMPCYLCAGAVVQFGIKKVIVGESRTFPGAKDFMVSHGVEVIDLNLDECEQMMSEFVQTNPELWNEDIGN

SEQ ID NO: 12195 - protein, 429 aa, Nostoc sp. PCC 7120
MKLTMFQNKKHRIALISVSGDPAVEIGQEEAGGQNVYVREVGYALAEQGWQVDMFTRRISPDQAEIVQHSPNCRTIRLQAGPVEFIGRDHVFDYLPEFVAEFQRFQKRQGYNYQLIHTNYWLSSWVGMQLKKQQPLVLVHTYHSLGAIKYQTIADIPAIANQRLAIEKACLESVDTVVATSPQEQQHMRALVSKKGRIEMIPCGTDINNFGNIEKSAAREKLGIEPDAKMVFYVGRFDPRKGIETLVRAVAQSRLRGEANLQLVIGGGSRPGQSDGRERDRIANIVAELELNDCTTFAGRLDHEILPYYYAAADVCVVPSHYEPFGLVAIEAMASKTPVIASNVGGLQFTVVPEVTGLLAPPQDESAFATAIDRILANPTWRDQLGTAARQRVETTFSWAGVASQLSQLYTHLLTQNAPEKKEKEAVAA

SEQ ID NO: 12196 - protein, 775 aa, Nostoc sp. PCC 7120
MDKLYWLDQIKLQDRAKVGDKAFYLSRIRQRGYPVVPGFVVSEEVLRLFLETLNSSESLVANLPNSSLHLDVANWRQLQQVAGRLRQEIIHATVPSQWVNTILTAAREWQTNFLIFRPSLTLATKTHRLGNTSGLLDAAFCYCNEDAIAHTLKHTWSQLFRARSLLYWQRIGVNLQEVNLAILVQPVQNAIASGLLIANSSGCKIQATWGLGLALSQGEIIPDTYQVQQETGIVLERHLGNKMFAYRLDSSELNDARLSRKEVFTLNHPCIGAYSVQESHQQQYALAEEYLQQVITLGHQLESELGNSFTIEWTIAEENSTPCLYITQVSTPQSAIPNLRFIKGAGAARGRVTANAYVVNDSQRKPEQLPKGVILVVPAITPDWLSLVEQAVGIVTVQGGVTSHAAILARELGIPAVVNVADATLLIPNGERLLIDGDRGEVYLLKADEATTVENPHQQPLTPPFHPVVSRQMPMIATQLLVNLSQPSLIEQVQNLPVDGVGLLRSELMLVPLLKGQHPNFWLLDGRKSELLEQWSEHIIQFARAFAPRPVFYRSLDWRSHELSANNSQSAPQSILGDRGTFSYVRNSDVFELELTAIANAQKAGYDNIHLLLPFVRSVGEFTFCRQKAEQFGLTQIPQFQLWMMAEVPSVLFLLPEYVKAGVAGISIGTNDLTQLLLGADREQSDITKVLNERHPAVMAAIAQLIQMSQTAGIPCSICGQAPAIYPEIIDQLVQWGITSISVEPEAVERTYQAIARAEHRLLLQAARRQVGERG

SEQ ID NO: 12197 - protein, 865 aa, Nostoc sp. PCC 7120
MSNVDQVNYELADELTALRQRIAELEQLEKQYQHKQVELERHIEDLQAKLRTLHITNVDIESHLEPVTLQRLQQEISQRQQVDAALTESEERWRLALDAANLGFWDWNVLTAKVVWSENHERLFGLVSGSFDGTYETFLSCVHPEDRESVIQVIGVCLENKTDYYDEFRIVWPDKSIHWIAAKGRFFYNDQGQPVRMIGVCMDITKSKRTEENNRQLATQVQEQANVLNAILATSVDHIYIFNRTGHYQYVSHGGAAVLGLYPQQMIGKTVQELNLPQELIDKVNGQFLAVMKAGKPVKDECEYVAADGKHYYEYILTPLRNIDHNIEGVITVSRDMTEHKRAEQSIRNSEARFRRLFESNLIGVAFWNVDGFITDANDAYLQLVGYTREQFNTLGKINWRELTPPDYKHLDDRAIAEVKTNGISRIYEKQYIQRNGRRVSIVLGIALLDDSDEQGVAFVLDISERKLAEQQRDRLLCAERIARKDAEIANRIKDEFLAVLSHELRTPLNPILGWSKLLRSRQFDAATTDRALETIERNATLQTQLIEDLLDVSRILQGKLSLNICPVSLPIVIGAAIDTVRLAAEAKEIKIQNVFDPNLGQVMGDANRLQQVVWNLLSNAVKFTSPGGTVEIHLKAVNDQAQIQVIDTGKGITPEFLPYVFDYFRQADGTTTRNFGGLGLGLAIVRQVVELHGGTVQAKSPGDGLGATFTVNLPLSPKNEAMNHEDKNPVSANFQPATLSGVRVLIVDDEPDIRDLVTFILEDYDVKVIAVSSAQEALEALSQSLPDIIVSDIGMPDVDGYMLMRQLRQRSPQEGGNLPAIALTAYAGEINQKQALAAGFQLHISKPVDPDALIEAIGNLVNNQ

SEQ ID NO: 12198 - protein, 619 aa, Nostoc sp. PCC 7120
MVSLVMSGLTFWAVNTIQQDAQVNDTRFGRDLGLLLAANVAPLVADHNLTEVAQFSQRFYSSTSSVRYMLYADETGKIFFGIPFWEPEVENSLSIERRIQLPEEYPGDGEKPMVRQHMSPDGIVTDVFIPLIVDKKYLGVLAIGINPNQTAVISTNFTRDVTIAVFITIWVMVILAGVVNALTITKPIKELLVGVKQIAAGNFKQRIDLPLGGELGELILNFNEMAERLERYEEQNIEELTAEKAKLETLVSTIADGAVLIDNNMQVILVNPTARHIFGWEGADDVVGSNVLHHLPPAVQMEITRPLYEMAAGECDSAEFRLTLNQPSNRTIRILLTTVLNLQRESIKGIAITVQDITREVELNEAKSQFISNVSHELRTPLFNIKSFIETLHDYGEDLSLEERQEFLQTVNHETDRLTRLVNDVLDLSKLESGRSYSFDGVDLAQAIEQTLRTYQLNARDKGIELIQDVAPGLPLVLGNYDLLLQVLANLVGNALKFTSSGGKIAIRTYVLNTKSNSPNQPAQVRIEVSDTGIGIAQEDQQAIFDRFFRVENRVHTLEGTGLGLSIVRNIVERHRSRVNLVSEVGVGTTFWFDLILFEDEAPKKMVESGEEKAAMPTS

SEQ ID NO: 12199 - protein, 242 aa, Nostoc sp. PCC 7120
MSLKAILFDFNGVIINDERIHLQLIDEILIQENLQPQKVQERQASLGRSDRACFQELLANRGRVVSDDSLTQLLNSKAQAYVLEVEKLEKLPIYPGVEDLIYQARSRHLHLGIVSGAVRQEIELVLNHAKLAEYFTVIVAGDDITTSKPKPDGYLLAVERLNQEYPQLNLLPQECLAIEDTPAGIAAAKRAQMQVVGVANTYPFHMLQRCCNWTVDYLSDLELERVQKIFSGGEFPAIVSEC

SEQ ID NO: 12200 - protein, 429 aa, Nostoc sp. PCC 7120 [sequence omitted]

SEQ ID NO: 12201 - protein, 356 aa, Nostoc sp. PCC 7120
MQLKLSASKFPIAPLLLIAPFFLWGTAMVAMKGVMPHTTPFFLAGVRLLPAGVLILIAAALSGRPQPNSWQAWLWISLFGLVDGTLFQGFLAEGLVRTSAGLGSVMIDSQPLAVALLSLWLFQERIGLWGWLGLGLGVTGISLIGLPDEWIFSLLGTGAEVTIGNWQNLFASGEWLMLLAALSMAVGTVLIRFVTRYVDPVTATGWHMIIGGLPLWGISSVVESQQWENLVGSEWLALAYATVFGSAIAYGLFFYFASSGSLTSLSSLTFLTPIFALLFGHLLLSEVLSTLQWVGVFLTLISIYLINQRDNLAGQNKQSVMEEISAKSQPILAEATAKKLNPLTVKVRESEPETLP

SEQ ID NO: 12202 - protein, 407 aa, Nostoc sp. PCC 7120
MLANNNIPITLRHDMSSQSSQSGKILVVDDSPDNVFLIKTILEEEGYTVSTAENGISALAELQASPCDLVLLDLMMPGMDGYEVTRRVRGEMKLPQYIPILLITAHDAPNVAHGLDLGADDFIRKPVTVDELLARVRSLLRLKHSMDERDEIARQREDFVSRLTHDLRTPLVAADRMLALFQQGALGNLSPQMQEVIAIMARSNINLLSMVNTLLEVYRFEAGRKTLAFQPVDLSQLLNEVIAELTPLAQEKNLAINSYLGDASTPNILGVGVPPTVGDRLELHRLFTNLIGNAIKFTASGSVTIRLKALILNAKQDFSDLSLPSSNIDYIQVEIADTGAGIPLEEHATLFERFRQGSHKISGSGLGLYLSRRIVEAHHGKIVVNSELGKGSVFVVSLPIQIVGKAD

SEQ ID NO: 12203 - protein, 693 aa, Nostoc sp. PCC 7120
MAVIGCLVLPSDVTGLGSPVSDKNFITSVKMTSINHDPTFSGNSRSTLKKRTLLFRYLAEINLIFGLWYLQWRITNSINFDALWLSIPLLLAEIYSYLGGVMFVIGLWRPLVRQIKSLDQLTPSLPQTDWPIVDVFITCYNEPPEMVEQTAQAALAIDYPPTKLYVYVLDDGNSPAMRAMTEKLCIADLQSPLLQQEANRIDAERSHLVERLQKLESFTSNIQVAEEWLSKSSSVPNQDKTTDEVLAQSLQQFIRWLSPKHHSIAERLKTERQVLAGAIRQKELELVELTRFRYIARPKPAGVPHHAKAGNLNYAIFSGETSGEFILTLDADHIPKPQFLKRVLPYFYTYNLFNGKYEQNRIAFVQTPQDFYNIPPSDPFGHRASLFYGPLQQGKDGMNAAFYTGTNAILRREALINVGLQYFADDFTKDEKRLDEFQLVGGLSSNSITEDMNTAMRLHGAGWKSVYHHELLAEGLAPDDLSSTLKQRLRWAQGTIQVLVKENPLRKSGLTFWQRLQYFKTMYSYFSGFATLIFISCPIIYFFTEIVPVKTYGTDFILHFLPTFIINRLTFVVAIWGIPASEIWRSEQYAIALFPIFIQAVWSVFTGQKMNFQVTPKERQSGIYLSMIWPQLLIFFLTIIGIFWSLYSFAIGRLNHPWVNLLNSSWAVYNLLLLSGIIRASVWQMPKYDSKKV

SEQ ID NO: 12204 - protein, 1550 aa, Nostoc sp. PCC 7120
MKAQLPDNEVQRIAALLEYKILDTPPEAAFDDITRLASYICGTPIALISLIDQNRQWFKATFGLERRETPRDEAFCAHTILESEAFIVPDATADERFATNPLVISDPKIRFYAGVPLTNPEGYSLGTLCVIDYIPRNLSFEQIEALQILGRQVIKQLELRRNLANLVLVNNQHKQAQKIRHPFFKKIAGGFGLASVFLVLLGLASYQAEIELIHNGNQVQTTQESINNLEQLLSQMKDAETGQRGYILTGKDPYLQTYQTALANIDQKFDELRNATVDPVRQQRLVILKPLITAKITELNQTIKLRQNLGFQAALQVIQSDQGQTLMDDIRKVMREMETENKVRLQQQLQAVKASEQKVIFILAIAIVSGFIILAVVYYLIYCEVIARQSMENILNEERNFISAVLDTVSALVIVLDSQGRIVRFNQACEVITGYSFDEVRGRHFWNLFLLPEDVESSKEFFAKFPADPTVPSVQESENYWVTKDGSRRLIAWSRTILQNHEGSVEYIIGTGIDITERKRADKHLTIQYAITRVLAESTTITEATPQILQAICETLGWNVCEIWMVNQQANFLSFFDLWHHTSLEMQEFRTQSQPITFASGIGLPGRIWASGQPIWLTDIVNDGSFLRNQLAAQVGLRGAFGFPIRSGQKILGVITCFSHQVQPHDPDLAKIMDSIGEQVGQFIHRKQAEEELQRQNLRSQLFTEITLKIRQSLQIEEILQITVKEVQKILQTDRVLIYQLLPDGSGSLIIEAVVAGWAAIKGQNITDFYLQTEYQQQYCLQQYRLRHLEAIANLDLGEIQQSHLELLRKFGVKANLVIPILVKDELCGLLIVHQCATSRQWTSFETHLLRQIADQVGIAVAQAQLLEVETRQRQELEVARSQAELASHAKSAFLANMSHEIRTPMNAVLGMTGLMLETLLNQEQRDFMETIRISGDALLTLINEILDLSKLEAGEMALENLNFNLSTCVEEVLDLLAPQAHSKGLEIAALIYRHVPIQLQGDASRLRQILMNLIGNAIKFTSFGEVVMRVELRSETPTTAIIHFAVTDSGLGITLEDQHKLFTPFTQVDASTTRKYGGTGLGLAICKQLVTLMGGEIGVESQLGKGSKFWFEIPFAKQLQPVSFVEDCGLLNNRRLLVVDDHATNRKIIYHQVSRWGMQVDQADRAVAALSMIVEACQQNKPYDVILIDMQMPEMDGMALGKQIKANSAIPPTPLIMLTSTNQRDEVQQAIKIGFAAYLVKPVKSSRLLDTIMSVLKTPSQLEAEKLEVKSQELEKNNLDHSRNHNFTATQAQNSVSTKTRILLAEDNLVNQKVALKQLQSLGYTADVAANGKEVLQLLKQIPYDLILMDCQMPILDGLEATKEIHRWAESSFASCRRPVIIAMTANAMKEDKQMCLDAGMDDYLSKPVMKEQLATALEYWCQLILNSRQAVEFDLNSLPLDWEHLHQLSENDTEFELHLLQIFVEDVRARLELAKEAIANTDFQQMAQQVHQLKGASTNIGATAMYLAAEKLEQLAQNQERRGSMELITEIEEGVNQIQAFLTRSQIV

SEQ ID NO: 12205 - protein, 369 aa, Nostoc sp. PCC 7120
MSVVENHQIDRILAVDDTRDNLILVQTILESEGYEIDLASDGISALQKVEQSPPDLILLDVMMPGMDGYEVTRRIRNNPALSYIPILLITAFHESSVVEGLDVGADDFIRKPFDTDELLARVRSLLRLKHSLDEQKKMARQREDFVSRLTHDLRTPLVAADRMLDLFQQEAFCKISPEMKQAIAVMIRSNQNLMQMVNTLLEVYRFEAGKKTLNYESCNLKEIAQEVVSELTTLTNEKGIALKIDSSQIDNLGEKAGIVMGDTLELRRVLYNLVANAIKFTDTGGIEIRFFEPNNHWLTIEIEDTGYGIAPEDQVTIFERFRQGRNKRSGSGLGLHLSSRIVEAHEGMISLVSEVGKGSKFTVKLPKNI

SEQ ID NO: 12206 - protein, 443 aa, Nostoc sp. PCC 7120
MEETLKILVVDDDEVDRMAVRRALVKAGVRMEMSEVSDGSTALSILRHRSFDCAFIDYRLPDQDGLNLIETIRGLNIKIPLVVLTSQGDEQIAVELMKAGATDYLSKFRVSSETLAQVLRNAIRLYRAEMQTTIAYQQLRESHEQLVRKNQELERQRQQIQIQNLKLLEASRLKSQFLATMSHELRTPMNAIIGFAQILSRPKFGNLTGQQADMVERILNNGKHLLMLLNEVLDFSKLEEGRLELKPELFDLTKVINAVVMEMRSLAEAKKLSLLVQIDLQNSLLVNDPVRIKQILINLLSNAIKFTDSGSIWIDVKDLPGSWVEIKVKDTGIGIAAKDFKYIFEAFRQVDQSITRKYPGTGLGLAIIDSLVQMMSGKIFLESQLGVGSIFTITLPRQLPLSNSSLSSSSVQDAKEMMQPDHKVHHPTAKSNPTARKYHNLKL

SEQ ID NO: 12207 - protein, 498 aa, Nostoc sp. PCC 7120
MKTPLNCQNYINGQWLNAATETTLNSHNPADKSEIVATFPRSQADDVDRAVAAARQAYGSWRKVPAPARAEYIFRVGELLLQHKEELAQLISREMGKPLTEARGDVQEGVDCAFYSAGEGRRLFGQTTPSEMPNKFAMTMRMPIGVCALITPWNFPVAIPCWKAMPALVCGNTVILKPAEDTPACATKLIEIFAAAGLPPGVINLVHGVGEEVGKALVEHPNIDLVSFTGSSATGAYVGETCGRTHKRVCLEMGGKNAQVVMEDADLELALDGALWGAFGTTGQRCTATSRLILHRDIKEKFTTMLRERTSQLRLGAGTEPETDIGPIINNRQLQRVHEYMNIAREEGAKILIGGEIATEGQLQQGYFFQPTILDNVTPQMRVAREEIFGPVVALIEVSTFEEAIAILNDTKYGLSSSVYTRDINRAFVAMRDIEAGITYINGPTIGAEVHLPFGGVKQTGNGHREAGTTALDVFTEWKSVYVDFSGSLQRAQIDNRS

SEQ ID NO: 12208 - protein, 327 aa, Nostoc sp. PCC 7120
MPTVNTHTEDTNTKFTADMVRTYLREIGRVPLLTREQEIVYGKQVQQMMSLIDAKEALAKKLDREPSLPEWADHVQKSETEVKQTVTQGKRAKQKMIEANLRLVVAIAKKYQKRNMEFLDLIQEGTLGLERGVEKFDPMRGYKFSTYAYWWIRQAITRAIAQQGRTIRLPIHITEKLNKIKKVQRELAQTLGRSPSPAEIAKELELEPAQIREYLNMARQPVSLDVKVGDNQDTELQEMLEDDGPSPEYYTTQEFLRQDLNTLLAELTPQQREVVALRFGLLDGNELSLAKVGERLNLSRERVRQLEHQALAHLRRRRANVKEYVAS

SEQ ID NO: 12209 - protein, 332 aa, Nostoc sp. PCC 7120
MTLPTETSSPKSSAMKTAPTATDLVRTYLREIGRVPLLSHEEEIRYGKQVQRSTTLQEMREELATQSGREPSVEEWAKAANLNPADLLEAIADGEIAKRKMVEANLRLVVSVAKKYIKRNVDLLDLIQEGSIGMQRGVEKFDPTKGYRFSTYAYWWIRQAITRAIAEKARTIRLPIHITEKLNKIKKAQRQLSQRLGRAPTAGELANELELTPKQVREYLEKARLPLSLDLRLGDNYDTELGEMLEDPGASPEDFVMQSSLSNDLEVLMEQLTPQQKEVITLRFGLIDGQALTLARIGEILNISRERVRQIEREALTKLRKSKANMGEYLAS

SEQ ID NO: 12210 - protein, 269 aa, Nostoc sp. PCC 7120
MNGLKGKNTLITGASSGIGQAIAIRLAQEGCNIAINYRKSPSGAEETEEMALQKACKNVEICGVKSLLVQGDVSQEEDVVEMVNTVIEEFGSLDILINNAGIQTECPSHEITAEDFDRVIGVNLRGSYLCARETIKHLLTQNRSGVIINISSVHEIIPRPMYVSYSISKGGMENMTKTLALEYAHRGIRVNSVAPGATITPINEAWTDDPEKKAVVESHIPMRRAGTSEEMAAAVAFLASDEAAYITGQTLFVDGGLSLYADFREPWSA

SEQ ID NO: 12211 - protein, 383 aa, Nostoc sp. PCC 7120
MRLNLIPLFCFGLCGVMVLISPPQVNANTPLTRAEIQSIRNFVQLIQRASRNKRPAQKSDAIIPGDGLSTGRASLADLRFNDGSLARVGEQAVFQFMPRTRNFRLSNGTVLLLIPPGRGQTRIQTPSATAAIRGSALFIRYDQKTDTTIIGALTNSGIAVSNKDASQTQPLKAGQLLVLVKGKIQSLYDFDLQNFYETSDLTEGLDLTGKNSSATLDPAMIAVREEIKAALAAQSPVAGQGVMENPAFLELSTTSSEVIDEDNDEDDFITNDFPINSLVDIGEFLFQNGQQLGNDGDINDINNNINNVQPDPPPPSDPPPPPDPPPPPDPPPPDPPPPDPPPPPDPPPPPDPPPPPPPDPPPPPDPPPPDRPPPPPPEPPPPP

SEQ ID NO: 12212 - protein, 614 aa, Nostoc sp. PCC 7120
MERESPRSDSWNPPFSKRGRMSTYRQAFAGISSRFEAPYGHRVYEVHVLPVRNDDGEIFAGMTITQEITERKQSELALQNALQLLNLHIDTTPLAVVQWDCHLCVTRWSSAAEKIFGWLAEEVIGKYIQDLHIVYEEDMTAVAEVSDRLLSGQEAQIIQYNRNYTKDGRVIYCEWYNSSITNEEGSVTSVLSLVLDVTERIQAEKALRQSELMVTEERAQALERERAARIELERASRMKDEFLAIVSHELRSPLNGILGWSRLLRTRKLSPEKIEQALESIERNAQAQTQLIEDLLDISRIIRGNIRLLVRPTKLIPVIQAALDTVRPIANTKSIQIISRLNFDIGLVSADPERLQQVIWNLLSNAVKFTPEGGRVEICLEQVETNVQIQVIDTGTGISPEFLPYVFDRFRQADATTTRNQGGLGLGLAIVRNLVELHNGKVSVASPGEGQGATFTVQLPLLATYSTLTPEEPLIQRQTAWDTKVQIKGLKILAVDDEPDTREFLKTALEQYGAIVTTAASTREALKLLQLVKPDVLLSDIGMPNEDGYALIRQIRALSSEQGGNVPAAALTAYTRQSDRLQALTAGFQIHISKPIEPIQLLKIVATLAGNNSN

SEQ ID NO: 12213 - protein, 349 aa, Nostoc sp. PCC 7120
MAKASESLDLSVNESTDKALDRDCTTLSRHVLQQLQSFSADAQDLSALMNRIALAGKLVARRLSRAGLMEGVLGFTGEVNVQGESVKKMDVYANDVFISVFKQSGLVCRLASEEMDEPYYIPENCPIGRYTLLYDPIDGSSNTDTNLSLGSIFSIRQQEGDDSDGQAKDLLTNGRKQIAAGYILYGPSTMLVYTMGTGVHSFTLDPSLGEFILSEENIRIPDHGAVYSVNEGNFWQWEESMREYIRYVHRTEGYTARYSGAMVSDIHRILVQGGVFLYPGTIQNPEGKLRLLYESAPLAFLIQQAGGRATTGLVDILDVVPKKLHQRTPLIIGSKEDVAKVESFIQNGH

SEQ ID NO: 12214 - protein, 94 aa, Nostoc sp. PCC 7120
MTIYVGNLSYRATEADLKAVFADYGEVKRVVLPTDRETGRMRGFAFVEMNEDAQEDAAITELDGAEWMGRQLRVNKAKPREDDRRGSWGKKQDY

SEQ ID NO: 12215 - protein, 253 aa, Nostoc sp. PCC 7120
MLSILRADFRIIFERDPAARNLLEVLFCYPGLQALLFHRVANWLYRLGLPFIPRLISHIARFLTGIEIHPGATIGQGVFIDHGMGVVIGETAIVGDYALIYQGVTLGGTGKESGKRHPTLGENVVVGAGAKVLGNLQIGNNVRIGAGSVVLRDVPANCTVVGIPGRIVYRSGGRVDPLEHNNLPDSEAQAIRALVDRIESLEQQIQALQNNQSAAKIPALVAASSQEAERSHDSQWCNLRDKAIQEFLDGAGI

SEQ ID NO: 12216 - protein, 633 aa, Nostoc sp. PCC 7120
MTIQEQLHQWHELAQQLRIDSIRATTGATSGHPTSSMSPADLMAVLLTNYLHYDFDNPHHPNNDRFILSKGHAAPLLYAMYKAAGVITDEELMSLRQMGSRLEGHPTPVLPWVDVATGSLGQGLPIGVGLGLAGKYLDQLPYNVWVLLGDSETAEGSVWEAFDHAAHYTLDNLIAIIDVNRLGQRGQTELGWNTQAYANRAKAFGWQAIEIDGHDLTEIDQAFSAAVSINDRPTVIIARTKKGKGVASLEDLGGWHGKALKPDAAKQAIAELGGERQITIQVAKPEPEQPALANPQPFQLPTYEQGAEVATRRAYGDALKALGAAQPDVVALDAEVSNSTYTEDFAEAYPERYFEMYIAEQQMVAAAVGLQVRQYKPFASTFAAFLSRAYDFVRMAAVSRANIKLVGSHAGVSIGQDGPSQMALEDLAAFRAVWNSTVLYPCDANQTAKLVEQMSDLQGIVYLRTTRENTPVIYGTEEDFPIGGSKVIRSSDQDQATIIGAGITLHEAIKAGDHLKNEGIIVRIIDAYSVKPIDVKTLHQAANDTEGNLVVVEDHWHEGGLGAAVLDAFAGVGNLSSYDGPPLQLIKLAVHNMPGSGTPEELLHAAKIDADAIVEAVKLQVRHPIGARISIHP

SEQ ID NO: 12217 - protein, 965 aa, Nostoc sp. PCC 7120
MNHYVPCTVLLIDKCSEERANMTRHLQQDSLYNYQIIEFSIAKEALNWCLEKTPEIILLDFASVNENASIFLEKLRSRLSNSQFTVILLIKPGDEDLAVRAMKSGAQDYLIKNQITPEILQRVIRHGMEKMYLMQQLAQTKAALQQSEHRYATLAEVVPVAIFRLDADGNCIYVNDRWSQITGEPIQAALGRGCLDTIHPEDSDRLFHQWTEVLTQEKMYCYEGKFLRKDGTTIWFYMQILPETDQNVTTIGYVGTLTDISEQQAALDDGLRPTIGDLIEAEAKLRKISERLTLAISSGRFGIWEFDCVQEKVIWDERMYELYGVHPEDFPGNFDAWLSFVHPDDQDYLLVTIQQVLHQNQEYDAEFQIIQPSGEIRVIKAYGVLNCDEQGKPILMVGINIDITERKQAEQELIHNRDLREVIFNESADALFLVDPVTLLTLDCNRRTVELFEATNKGELLGIEGRTLQRRPFTSNEIDTIVTQMQTKGFWSQEIEYVTLKGKLFWGNIAAKPITIAGRTLNLVRVTDINERKQAEEKLLRTNEQLAKANAELARATRLKDEFLANMSHELRTPLNAILGMSEGFIEGVFGAINQKQAKAIATIKRSGKHLLELINDILDLSKIESGKLELQISDVSVRSICDGSLTFIQQMALKKNICLSTHIGSNLDTIQVDDRRLRQVLINLLSNAVKFTPEGGNVKLTVWLEEVGTNETLGAEKLISQSSIPSPHICFRVTDTGIGIASEDISKLFQPFTQLDSSLNRNYTGTGLGLALVKRITTLHGGTILVNSEVGQGSCFTVRIPYLSGDNSLKKLQDPERVDLPATLIPKTLTIPVILLAEDNQANIDTISSYLESRGYEMVLAENGQQALDFAREKCPDLIIMDIQMPGMNGLEAIRQIRNEQKFIDIPIIALTALAMPSDRTTCLAAGANEYLTKPIKLKQLVLTIQQLLKNHQELHTSKYRKSD

SEQ ID NO: 12218 - protein, 323 aa, Homo sapiens [sequence omitted]

SEQ ID NO: 12219 - protein, 550 aa, Nostoc sp. PCC 7120
MELRSIAPPKPGVTGPPNPQEQLQLLLTAPVYDNSGKLQYALNLQSALYKQTRNQPGSLTGSTIVIAEDGTILAHPLPDLVGTNIKEHSDAKQVQSIIKNAIAGRNEPINLIFNNKKELVAGYTVIDSPTSIKPQQKWIVMSVTTVENALFGLEEIKLILIVLTVGLIGASLVASLYLAPYLASPVEELRDYALNIHSHHTSRRVPDNFKIREFNQLAQAIDQMVDRLKVWSEEIETAWKDAKSANQVKSQFLATTSHELRNPLNIIINCVRLVKDGLCDNREEEIEFLQRADETAIHLLGIINELLDISKIEAGKLSVVSQPLDLRQTLLEVINLQSVNVQQKGLQLKTNLGTEPIPVKADAAKLKQVLINIIGNATKFTDEGGISIATTIQTRIEGKSQVMVSITDTGLGIEPAQQHKLFRPFVMVNGSTTRKFEGTGLGLAISRNLIELMGGTITLESAGINQGTTVNITLPLIDISLLGLSATDNNIKNQKNLEEDEEIKGTDSFSSNHPEAIPLECNENYGSKKTKLEEEYIDLERVNLFMMRNS

SEQ ID NO: 12220 - protein, 390 aa, Nostoc sp. PCC 7120
MYQTKHESLKETMNIAELGTMEIIESVVEHEEHSLDTLELIIEEEPPITENLDSEERDSGDEMAAARPSGYNKTEHDDAVGAFFKEMARYPLLKPDEEVELARRVRFLEEVRDLQADLQLQIGQHPTKAQVAGQLEITEKQLENRLYQGRVAKRKMIRSNLRLVVSIAKRYLNRGVPFLDLIQEGAMGLNRATEKFDPDKGYKFSTYAYWWIRQAITRAIANDARTIRLPIHIVEKLNKLKKAQRELKQKFSRNPSEAEMAEALEISVPQLRQLQQLRRQALSLNHRVGKEEDTELMDLLEDEDNLSPEAKMNENMMRQEIWEVLGDVLTPREKDVISLRYGLTTSEPCTLEEVGNMFNLSRERVRQIQSKAMRKLRRPHIAKRLKGWLI

SEQ ID NO: 12221 - protein, 497 aa, Nostoc sp. PCC 7120
MQSYKYQQKKNLEKSYTREDWQGGYKSLRQEFDYWIDDVEGEIPTELQGTLFRNGPGLLDIKGQSIHHPFDGDGMISRISFVNGRAHYRNSFVKTEGYLAEKNAGKILHRGVFGTQKPGGWLANIFDFKLKNIANTNVIYWGEKLLALWEAAEPHRLDPKTLDTLGKEYFHGVLSAGEAFGAHPRFDPSCEQDNGAPCLVNFSIKPGLSTTITIFELNVAGEVVRKHAHHVPGFCFIHDFVITPNHCIFFQNPVSFNPIPFALGLRGAGECIQVQPNQPTRIIVIPRFPQSGQKEIKTLEVGSGFIFHHVNAFVVGEEILVDSLCYDSLPEVEPESDFRQVDFEAIAPGQLWRFYLNLKDGTVQKKLIESRCCEFPAIHPRNVGRSYRYLYMSAAHAATGNAPLQALLKIDLESGEKQIWSVAPRGFTGEPIFVPRPGSEKEDDGWVLALVYDAAHHRSDVVILDASDFTKGAIARLHLQHHVPYGLHGNFTPQVFV

SEQ ID NO: 12222 - protein, 399 aa, Nostoc sp. PCC 7120
MVKSITLVGSTGSIGTQTLDIVSQYPDQFRIVGLAAGSNVEMLAEQIRQFRPQIAAISAAEKLPALQAAIKDLDPQPILLGGEAGVIEVARYGDAETVVTGIVGCAGLLPTIAAIEAGKDIALANKETLIAGGPVVLPLVEKHGVKLLPADSEHSAIFQCLQGVPKGGLKKILLTASGGAFRDWDVERLAEVTVSDALKHPNWSMGRKITVDSATLMNKGLEVIEAHFLFGLDYQDIEIVIHPQSIIHSLIELQDTSVLAQLGWPDMRLPLLYALSWPERIYTDWERLNLVKAGNLTFREPDHQKYPCMQLAYAAGRAGGSMPAVLNAANEQVVALFLDEKIKFLDIPRCIELVCDRHQNDNCANPSLDDILAADQWARQEVLTATKNLASQPQIISVN

SEQ ID NO: 12223 - protein, 443 aa, Nostoc sp. PCC 7120
MQPEFNFFQHWYPVSPIEDLDPKRPTPVTLLGIRLVIWKPQSSEGFRIFIDQCPHRLAPLSEGRVDDKTGNLMCSYHGWQFDPEGVCTHIPQAENPEIVTKNQKDFCVISLPVRQQNDLLWVWPDVKSQELADQTPLPLSPQVDASKGFVWSSFVRDLEYDWQTLVENVADPSHVPFAHHGVQGNREQARATPISIMQSTPGLIEAVADGRFKAKITFEPPCRLEYAISIGNDGKKVGLVTYCLPVSPGKSRIVAQFPRNFAKILYHLTPRWWDHVKTRNLVLDGDMILLKQQEHFLQERQLSASWKTVYKMPTSADRLVIEFRKWFDKYCEGQLPWKEVGIAISEGSTINDSRDTLLDRYKQHTQHCSSCRDALKNIKRLQVILLGYFAIIISGVAVLPDSLRVQLGLPLIITAILGLGLYSWLKFWLVPKFYFVDYVHAEK

SEQ ID NO: 12224 - protein, 422 aa, Nostoc sp. PCC 7120; identical to SEQ ID NO: 875

SEQ ID NO: 12225 - protein, 267 aa, Nostoc sp. PCC 7120
MENFVTPPAFGEKIRERWTLAGRKALITGATKGIGLAIAQEFLALGAEVVIVARNAEAIEQQMKAWHSAGKVHGVAADVSTSEGRQMMLDYVSKTFGELDILVNNVGTNIRKKATDYTEEEFAAIFQINLTSIFELSRLFYPLLKTSKNSSIVNIGSVAGLISVRTGAPYGMTKAALVQLTRSLAVEWADDGIRVNAIAPWFIQTPLTEPLLNNPETLSAVLSRTPMKRVGQPEEVASLTAFLCMPTASYITGQCIAVDGGFLAFGF

SEQ ID NO: 12226 - protein, 575 aa, Nostoc sp. PCC 7120
MQTQQPIPVDSSSDSKEVSLEEPSTSTDELPTIEFPSRGKLKASSWRIHQKIGYGYFVAIGIGFFGSLTGLVIANYYRGKEIREFNQAQEQRQLLTDYKNAVVGAQLHSSNIVAFLEDPQRLPMKKADFLRDVKKAETDEQKIAKFIDGRPKDLAATSANLKALLQDYAFYLDSYVQQIDAVVAEIQQPVPPKQAAEVRAKLLEIMRGETAMQLEQLSQKLSNILQTAESKERQRQRDVEEAKSVERLIVMVSMLVSVAIAAIVAWRTSRAIAEPVIMVTQVAEQVARKPNFDLRAPVTTEDEIGLLAKSLNRLIERVSERTKELEQAKELAEAASKAKSIFLANVSHELRTPLNAVIGLSQLLKDDAADLNLSGEFTSDLETINSAGRHLLELINDILDLSKIEAGKMTLYPEIFDVVTLINNVVVTVKPTIEKNNNLLEIYCDEHLGTMYADQTRMRQVLLNLLSNAAKFTTNGRIKLTVRREKEDFLPEMPFGAISFTVSDTGIGMSPSQQQQLFQPFTQGDTSTTKKYGGTGLGLAISRHFCQMMGGEIIVKSQLGLGSTFTVYLPLQEQS

SEQ ID NO: 12227 - protein, 520 aa, Nostoc sp. PCC 7120
MVLESAISEEVIATNLKQFLLVLSVSLGVATLPQVFSWFRQIPYTLLLVIVGLGLAVVDVRLVVLSPALILSIFLPPLLFEAAWNLKWSDLQRDFVPICLYAVFGVIISIAGVAIGLNQLAGISLTTALLIGASLSATDPVSVTALFRELGVGTRLVTLMEGESLFNDGMAVVAFGFLVALPFGNAELGFQPILLQLIQVVGIGVAVGCLIGFAISYLTQRFDLPMVEQSLTLVSAYGTYLITEDLGGSGVIGVVTTGLILGNFGSRIGMNPRTRIIVSEFWEFLAFFVNSIVFLLIGDQIRFASLGENLQIIAITVGAMILMRAVALFILSKLSVMMTQSQVSLPEQTILWWGGLRGSVSIALALSVPNVLPGREKIIATVFGVVLFTLLVQGLTIKPLLQKLNLLGDAPLREQYLQLVARSVALERVLQYLQTEKRPGIDPEFIRYQEKLVTGEIAELQTKIDKLHNEYPNLQNFTTEQFRDELLAIEADTYAEFVKSGRLNKELAPMLEDVLGHQRD

SEQ ID NO: 12228 - protein, 110 aa, Nostoc sp. PCC 7120
MSIYIGNLSYQVTEEDLKLAFAEYGKVSRVQLPTDRETGRPRGFAFVEMETEAQETAAIEALDGAEWMGRDLKVNKAKPREERSSSPRGGGGSWGNNNRGGGGGGNRRSY

SEQ ID NO: 12229 - protein, 371 aa, Nostoc sp. PCC 7120
MIKKGWRWTKSLPLASRLFVSHLVVMIVGLISLVIISKVSSPRFFVLHLERLESEGVNLINVRADLVQGFEIAWRSSTIWSVLVGSTAAGGLSYWVSKRIMQRLTEMEQITQQFAAGHLQARLPLSDIPELNRLGTSFNRMAASLEGVEARRRELIGDMTHELRTPLTVVRGYLEELADGEIEPSPEVYRRLAKETRRLERLVNDLQELSKAEAGYLPIRIQSVNLYPLLESLVERFSDQLLEDGPVLLAELTPQMPLVLADIDRTEQILVNLLGNAIRYTTTGSITIRTWTENRQLWIAVIDTGIGIASEDIPHVFERFWRADQSRDRHSGGTGIGLTITKHLVELQSGEIHLDSELGIGSTFRFCLPLA

SEQ ID NO: 12230 - protein, 147 aa, Nostoc sp. PCC 7120
MSHALELAKVAGEAGEIPVGAVITDASGHLIAEGENRKERDQDPTAHAEIVALRAATKILQTWRLHECTLYVTLEPCPMCAGAIIHSRLGKLVYGVDDTKTGAIRTVLNIPDSAASNHRLQVIGGILESACRQHLQNWFVNRRLQNK

SEQ ID NO: 12231 - protein, 941 aa, Nostoc sp. PCC 7120
MGKIMPVSNTKPSLQRQIKTMIRSSVQTAQKLPLRLILVVPFVLQIFTAVSLVGYLSFKNGQKAVNELADQLIVKVNGLVDQHLDSYLAAPLQINQINVDATNLGMLNLENFQTTGRYFWQQMQVFNVGYISFANLQGEFIGVERLDKGGLLINEVSQKNGIGKLYVYTTNNQGDRQQLIAVKDYDPHVEAWYADAVKAGKPVWSQIYSWEDKPEVLSISASYPINDNNNKFFGVISVDLILSQINSFLANLKVGQTGQIFILERSGMIVASSTSEAPYKVISGKAQRLSAHQSQNYLLRETTDYLQQKFGQLKNVKSYQQTVLQLQHERHFVQVRPWNDKLGLDWLVIVVVPESDFMGQINTNNRTTILLCLWALIIATAMGVYTSRWIARPIVQLTQASSAIASGNLDQEVRVSGLKELSTLATSFNQMAGQLRDSFAELEKTNQELENRVAERTAEITAAKEVADAANRAKSEFLANMSHELRTPLNGILGYAQILQLDSNTNDEQMQGLNTIYECGSHLLTLINDILDIAKIEAKKLELYPQEFDLGRLLLGVCEMCHIKVEQKGISFKYQFNDYIPSKTFADEKRIRQVLINILSNAIKFTDNGTVTFDVEVVACTGTKLITNTNQILPVHQLRFQIEDTGIGMTDEQLKKIFLPFEQVGDNLHKSEGTGLGLAISSQILELMGSDIKVESVYGKGTKFWFDLDLPIIDTGKISLSVESQKNIIGYEGKTKSILIIDSSWEKRDIFANLLSSLGFKLTEVSNLQESLDKIKAEHPDLIIADIAMPEINNLQATTMMRSQVEFAKLVIIASSASVSEYTRQQSQEAGYDDFLAKPVKVEDLFNMLQTYLSLKWIYSPNDDSSAKISSIEEIIFPPPTELVNLYQAAKAGYVVGIQEEITRIQQLDKKYTRFTVKVSELIAEFEDEAIVSMIQPHLSY

SEQ ID NO: 12232 - protein, 472 aa, Nostoc sp. PCC 7120
MQIVDKRSNKKAWASALTEPAKEFPLTQLTIISGNIPEGLRGTLYRNGPARLERGGMLAGHWFDGDGAILAVNFTDGGVHATYRYVQTVGYQVENTADKFLYGNYGMTAPGPVWNQWRKPIKNAANTSVLALPDKLLALWEGGRPYALDLQTLETWGEDNLGGLTNGLTYSAHYKQDPQTKEIFNFGISLGLNAKLNVYKSDSTGKIIQKSAYSLDGLPLIHDFVLAGKYLIFFISPVRLNMLPVLLGTSNYSDSMQWRPELGTQILVIDRESLSLVSRGETEPWYQWHFANGYVDASGAVIVDIARYKDFQTNQYLKEVATGQTHTPAPSTLSRVNLHPQSGKVAAIEQLLDRHCEFPHVPRQNVGQASRYTYMSGFRQGTDISQELLNTIACFDHKTQTFIEAYPGENCYPSEPILADNWVLTVVYDGNSHSSQVWIYDSDRLHEEPICKLELPKVIPHSFHGTWKSEKR

SEQ ID NO: 12233 - protein, 1155 aa, Nostoc sp. PCC 7120
MKSPVNSKPKILVVDDEPDNLDLLYRTFYRDYKVLRAISGPAALDLLAQEGEIAVIISDQRMPIMSGTEFLSLTATQYPDIIRIILTGYTDVEDLVEAINAGKVFKYVTKPWEAEELKAVVRQALDTHNVLKARTRELTRTLRQESLLNTVTNTIRSALDYRQILQAIVDTVGHMLEVDVCLLRSFQDGQLVDEGFVYQKDSPAAVEKTIHDSAPLTILADTVWETREVQIIHDVAGDERIHGDSPELQHRNDAFAAADIRSSLVVPLICQQELMAVLALHQCSQARVWGEEEVQLVLMVADQAALALSQAYAYEQVRALAKRESLINTITTAIRSSLNPEDIFAAITQKLGQALQVDGCVLSLWTEEDEFVKCVGLYDSSRHSEDSLDNHRLITQELPESQAPILENPILQEILKTHEPVIITDMNHSDWETKRFDLHLKMPARSLMVVPLLADGKCIGSITLREGKRARQWLSADIELAKAVAAQAAIAVQQSHLYQKTREQAERLLQLDKQKTEFFQNISHEFRTPITLIQGPLESAVGTGEGLSYAQSAIALRNSRRLLRLVNQLLDLQRLDAGRMQPSFRPCDLVDFVSQIVESFRPYCEKKALHLTTELDECPTVYIDMEKFDKVVYNLLSNAMKFTPEGGTISVKLQSQGHHCILQVQDTGIGIVKEQIPHLFERFRQAEGSENRSYEGSGLGLALVKELVELHGGRVTVESVYGKGTTFTLWLVIGNAHLPLQQVSDTPVELTTSRASVELADLELVEPTLENIDIETINPLPISETQHTANSTQQSTHSILVVDDNPDLRTYVSDILRRSGYQVYTARNGYEGFSKVQELTPNLIVTDLMMPLVTGLEMIRMVRNDEKVKGTPIILLTAKVDEETRIESTEHGADAYLAKPFNDRELLAEVRNLLALKENEKRVLELNTYLTESVLKRFLPPALVSKAAAGSLSLDLRPEPRLITVLFSDIVGFTQLANTLRSRRVAELLNEYLEFMTKAVFDNGGTVDKFMGDAILALYGAPEELTPNEQVRRAVNTARAMHSSLAQLNQRWRNQGIFDTHDYGGVQFRCGIHQGTAVVGMFGSAERADYTAIGPSVNIAARLQSAAVPGTILVSAAVADYLQDEEITKGSPLKLKGIDETVLTFAVKSELMVNR

SEQ ID NO: 12234 - protein, 806 aa, Nostoc sp. PCC 7120
MSELMQAILDSEEKHDLRGFISELRQQDKNYLLRNDILNVYAEYCSKCQKPETSYKFSNLSKLIYYTQEIIQEDSNFCFIIRPKIAAQEVYRLTADLDVEPMTVQELLDLRDRLVNKFHPYEGDILELDFGPFYDYTPTIRDPKNIGKGVQYLNRYLSSKLFQDSQQWLESLFNFLRLHNYNGIQLLINHQIQSQQQLSQQVKNALNFVSDRPNDEPYEQFRLQLQTMGFEPGWGNTASRVRDTLNILDELIDSPDPQTLEAFISRIPMIFRIVLVSAHGWFGQEGVLGRPDTGGQVVYVLDQAKNLEKQLQEDAILAGLEVLNVQPKVIILTRLIPNSDGTLCNQRLEKVYGTENAWILRVPLREFNPKMTQNWISRFEFWPYLETFAIDSERELLAEFQGRPDLIVGNYTDGNLVAFLLTRRMKVTQCNIAHALEKSKYLFSNLYWQDLEEKYHFSLQFTADLIAMNAANFVISSTYQEIVGTPDSIGQYESYKCFTMPELYHVVNGIELFSPKFNVVPPGVNENSYFPYTQTQNRIESDRDRLEEMLFTLEDSSQIFGKLDDPNKRPIFSMARLDRIKNLTGLAECFGQSQELQERCNLILVAGKLRIEESEDNEEKDEIVKLYRIIDEYNLHGKIRWLGVRLSKNDSGEIYRVICDRQGIFVQPALFEAFGLTILESMISGLPTFATQFGGPLEIIQDKINGFYINPTHLEETATKILDFVTKCEQNPNYWNIISEKAIDRVYSTYTWKIHTTKLLTLARIYGFWNFTSKEKREDLLRYLESLFYLIYKPRAQQLLEQHKYR

SEQ ID NO: 12235 - protein, 450 aa, Nostoc sp. PCC 7120
MTINPPQGEIKQAIFNSSMSENNQEFNWRHCWYPITFLQDFPKELPYSFSLYDEPFVLFRNQDGKLGCLPDICPHRAAKLSDGQIIDGKIECLYHGWQFGTDGQCLHIPQLPKEATIPKNACVQSFAIVERQGIVWMWAGEADAADETLIPAIPELDKPEFVTTDFMCNIPYDQNTLIENAIDPAHVPISHNGTLGNRAEALPLEMEIIAKSVQGICGRYRNVSSSLSPWININFVAPNLVMLYIPINEERGWYRGAAAYSIPLGKNQCRVLFRAFQNFSQWRLKLTPRWLEHWYRQKVLQQDMQQAAGQQKHIERLIKSPRELYLPLKTSDLFPVEYRKWLDKYGSSLPFYQGYTTCKTNYEQKIVSLSTNDRFESHTQICSSCDRAYRVTKLVKHILVSVAITLAAFAILTDDSWISSVAVVTSLLAVILVFIAQKVKTKFERSDTRH

SEQ ID NO: 12236 - protein, 965 aa, Nostoc sp. PCC 7120
MSELLYTFFISVPYWHPHDWLSGVIKTITAIISLYTAFICVKLIAKAGKFPSQVQLEVTNQKLQQAILNSANYTIISTTPDGIILTFNAAAQRWLGYTAEEVIGKKTPEMIHDKNEVVKVAQELSQELGVTIEPGFEAFVAKARLGQVEEREWTYIRKDGSRFPVLLSVTPLYDAEKNITGFLGIGSDITARKAAEAALRESEYRYATLAQTAPVGIFRNDAFGRCIFANERACNLIGSPLKDILGEGWIQSLHPDDRLRIVREWNQAVQQNLPFKAEYRFRHPNNVINWVIYQAIPERGSNGEVTGYIGTMTDINDRKRAEEELLHLSQALESAVEGISQLDTQGHYIKVNPAYAKITGYKPEEMIGMEWALTVHPDDKEKMMAAYHQMLKNGKVEIEARAMRKDGSAFYKQVVMVKAYNQQQECIGHYCFMKDISDRREVERLKDEFVSVVSHELRTPLTSISGALDLLASGVVPAGSEDAQRMLNIAANNTDRLVRLINDILDIERIESGKIQIAPQACNAADLMTQSVEVMEELAEQAGIQLSMSPLSAHLWADSDRIIQVFTNLISNAIKFSPTGATVWVTAKILEKGELEKSQTPIPLYPQTPIPLYPHTPIILFAVKDQGRGIPADKLESIFERFGQVDASDSRKKGGTGLGLAICRSILQHHGGQIWAESTSGEGSTFSFTLPIFPEEQNKEEEFLHLSHAAPQQPTESISPLILHCDDDLSVRAVVQVILEKQGYRVMTVASGKEAVEKAKVNQPDAIILNLMMPEIDGWETLALLKQQQETKDVPVIILSGVIPDHSKELPHDVSDWIIKPPDVKLLCQALEKATTKQQVIKVLVVEDDPDLAQVLIAMFNRHGISTFYAQTGREAIQISQNIIPDFLVLDLGLPECDGFAVVDWLRQYQRLYHVPLVVYTARDLDESDRQRLKLGQTLFLTKGRINPQEFEQRVITLLNRIICN

SEQ ID NO: 12237 - protein, 1558 aa, Nostoc sp. PCC 7120
MPNIPISALLRFGIVIFSVALACALMLLLDPWLGMTRTPFLLFFSAVMLSAWYGGFWSGMLGTFLSVILSNYFFFHPRYTLSIDTYNVVRIGLFAVQGWFFSFICETLRNTKKQDVVNLQKLRQSEERFRLALSNSDIVVFQQDRDLRYRWIHNYRGVASAEEIIGKSDNELFPTSVAEKLTAIKQKVLEKDISVHEEVSVIFHGEVVYYDLLAEPLTINGQIQGITCAAVDITERKRSELEKAKLQRKLQKAIQQQDEYLALLNAWLASSPVALAFLDTKLRYVYTNEALAAINGIPQSQHIGRTLREVLPEWATQLEPILQQVMATKEPLINQEVCGVTYPSGVHRCSLVNYYPVCLPDGKLLGVGVTGLDITERKQAEDALRYIAQTSNILSSSLDYEQTLAKIAKISVPQLADWCSIDIINQDGSIRRLPIAHVDPAKAELARLFQEYAPKSGSASLVAKVLQTGEPLLVADIPDSLLAAATQNEEHLDLVRQIGIKSLMFLPLIAHEQVLGCITFVSAESGRSYNQSDLTLAKDIAYRAALAIENAQLYRDAHQALKHYAESLALLDALLAGAPVAVCFLDKELRYIRINQVLADVNGLSIEEHLGRKFRDVLPKMAEQFEAQLQQVLETGQPLLNLEVSGEALGRPEINSYWLGNYYPVYDSMGKTVGIGIILAEVTATKQVEIALRESEERFRAMFDQAAVGITLVTLDGQFLQNNQALCDITGYSSEELSQMKFSDITHPDDVEADWVYAKQVLAREINGYSLEKRYLRKDGTTVWVNLTASAVWNEQGEPKYALGIIEDINERKQAEAAQNFLVEASTLLAASLDYEVALNNVAHLAVPTIADWCTVDILQADWSIKRVAIACIDSAKLDTIEEIRYSYPPGTKGEHPFRDKLLKGESAFYPELPNSILVEMAKDERHLQLLQNLEMRSLMVVPLYSREQIFGVISFVTSISGRQFKQTDLALAEDIARRAATAIENARLYQETQQAKQAAELAMSRMVRLQSITASLSEALTPQQVADVVVNQGLAALGASAGSVVLLTEGGTTLKIIQAIGYPESVQDAWETFPLTATVPIAETARTGEAIFLANIEEFAAKYPQIANVPSLTGNCAFACIPLIVEQQTIGVMALSFATAQKFNEEQQKFMLTLGQQCAQAIARSQLYEAEKNARAIAESTNRIKDEFLAVLSHELRTPLNPIMGWAKLLRTRTYKEETIKQGLETIERNAKLQTQLIDDLLDVSRILRGKLNLNVCLVDLRNTVQAGLETVRLAAEAKSIEIHTILSDEPVQVMGDGDRLQQVIWNLVSNAVKFTPSEGRVDVRLEQVGRDAQIQVIDTGKGITPEFLPYVFEYFRQADAKTTRVFGGLGLGLAIVHHLVELHGGTVVAESAGEDQGATFTVKLPLHKSADYQVQSAKSAVTELENQDSLLVGVQILLVDDQEDVREFFSFALEQCGASVTAVASAIEALEALARSKPDVLLSDIGMPQIDGYMLLRQIRKWSPEQGGQIPAIALTAYAGEIDQRQAIAAGFQKHIPKPADPVELAEAIAQLLRRK

SEQ ID NO: 12238 - protein, 390 aa, Nostoc sp. PCC 7120
MNQANNVLDSIYQPDLEIMNQPEIELDDLLIEEDEDLLLADDGDIDEFLEPQTDEDDAKSGKAAKSRRRTQSKKKHYTEDSIRLYLQEIGRIRLLRADEEIELARKIADLLELERVRERLSEKLERDPRDSEWAEAVQLPLPAFRYRLHIGRRAKDKMVQSNLRLVVSIAKKYMNRGLSFQDLIQEGSLGLIRAAEKFDHEKGYKFSTYATWWIRQAITRAIADQSRTIRLPVHLYETISRIKKTTKLLSQEMGRKPTEEEIATRMEMTIEKLRFIAKSAQLPISLETPIGKEEDSRLGDFIESDGETPEDQVSKNLLREDLEKVLDSLSPRERDVLRLRYGLDDGRMKTLEEIGQIFNVTRERIRQIEAKALRKLRHPNRNSVLKEYIR

SEQ ID NO: 12239 - protein, 935 aa, Nostoc sp. PCC 7120
MWRKFQAFIQRTRSVLIITPSVALTIIVGQSLGIFNLLEWKLRDEWVRLRSCEANTLLECSHNTMADEIIVITIDEQDIQSVGKWPIPDWSLAELLEKIRAQQPRAIGLDLYRDLPEGKGYEKLAEVFRTTPNLIGVEKITGERVNPPPELKKNDQVGLADLVLDGDRHVRRALLTAVDTKEEGKIKAGLATLVALKYLKAEKISLESVDAKQQKFRLGKQIHLPLQNSSAGYTDADLGGYQILLNWYGSEAAFRTVTMRDVLAGKIPPELMRDRMVFIGSTAASTNDFFSTPFSSSLISAQKPTPGVVIHANIAHQLVRGARTGKANLRGFSGLFMASWIILWSVIGSSGSWLLASARSGRRIPGGKILWTTTSISGAFLGGGYGMFLHGVLIPVTPPLAAFIVSVIATTNAYKQQKLEEANQQLEIANSQLLDYSKTLEIKVQERTHELLEAKQAADAANQAKSEFLANMSHELRTPLNGILGFAQVLEVSPNLREKDLEGVNIIHQCGSHLLLLINDILDLSKIEARKLELVVANVHLPTFLHGVSEICSIRAAQKGIAFKVSMGDRLPTVMEVDEKRLRQVLINLLGNAVKFTDSGGVTFKVELLDTQDQDNQQSSVAKIRFQIEDTGVGMSPEQLEKIFLAFEQVGDCRRQSEGTGLGLAISQRIAELMGSQIQVQSRLGEGSIFWLDVTLPVPISHDWQTYAPMHQKVIGIQGSAPQILIVDDDDNHRSMLNSLLQEIGCQTLEASDGKQGLQMVNEHHPDLILLDLAMPNMDGFELMVQLQENPQTSSIPIIVSSASVFEENRQRSLQAGATAFLPKPLQIDELFNALRSLLQVEWIYAPSASLSLSPQPGPTTPTELVLPSQDVLQQLYHLSMMGDIPAIEGILRELIQHNSQLTPFATELSKLTTNFQTAKIRQFLKSFVITESHP

SEQ ID NO: 12240 - protein, 559 aa, Nostoc sp. PCC 7120
MRKLTRWAFPNLWRRSLTDQRSSQPQSHSIAFFSVLLALILTLLLWQIQRLNSIYPPFLAAVMVSSWYGGFNSGLLATFLSAVVCSYFLLHPFYSLAVSGFSVVGLLQFVLVGLLISSLNSALRQARSQAQMNARVAQQNYERLLQSQYNLRRSEERYRLLVEGVTNYAIFMLDSNANFTTWNIGAERILGYQEAEIIGQPFELIFAPEAIERGQPQQVLKQALTEGFSRENRWHIRKDGTFFWAHCLITPLRDENGNLRGFSKIMQDITERKQAEEEKEQLLLREQAARAEAEAANRSKDDFLAIVSHELRTPMTAIIGWAGMLQTGALDEARASLALETIERNANLQMQLIEDLLDISRIVRGELSLSIDLVDLVEVITDAIEVVQSLADNKGIQIKSRPDTSIDKIWGDSDRLLQVVLNLLTNAIKFTPNGGRIEVCLSKELGTGDWGLGNRGDETNVSCPIPHYAQIQVIDTGQGISADFLPHIFERFRQADSSHTRSNKGLGLGLAIARHLVELHGGTIQAQSQGIGQGATFTVKLPITEESRGVNTIQHNHHC

SEQ ID NO: 12241 - protein, 316 aa, Nostoc sp. PCC 7120
MPSLSSDLVRIYLQEIGQFPLLTSDQEITYARLVQQMIALQEQQHELTQKLEREPTTLELANFLNKTEAQVNQILELGQRAKQKMITANLRLVVSIAKKYQRRNLEFLDLVQEGAIGLQRGIEKFDPNRGYKLSTYAYWWVTQAITRAIAEKSRTVRLPIHVNEKLNQIKKVQREFFQTLGRRATVAEIAQKLELEPSQIREYLKVASGTISLDLKIGDNKETELSELLASEGVSPDENITHEMLRQDLSDLLASLKPMQREVLILRFGLLDNQEQSLAQIGEKLNLSRERVRQIQQKAMTALRRQQPSIGQYLTS

SEQ ID NO: 12242 - protein, 460 aa, Nostoc sp. PCC 7120
MTTNFSWIKQWYPITPTSYLEPSYPTPITLLGKKLVVWQDKDHTWVVMDDVCPHKLAQLSLGNINQDGNLMCRHHGWCFDGAGKCTNIPMLNDPQALMNACSSQRSQVTTYPTQVLQGLLWVWPDNSSTAFADSALKPPALMPDTIGSSMSDWFMSEVPVGYTVCVESSFDPSHAQFLHEGIAGFSPQRAIPIENFEVMGKMSAEDGFILKHSGYNVFNKDMDATRRFTPPCSNTTIYKYSNGKSAIFQLYFVPTKPGYCKQIGKFIADIPSQKRNFWFQSLPTYLQTGLNHSSSYKLSNQDLSMMHSQTINESLENKPWQKLYFLPSVADTGIVTFRKWLDEFAGGKPEWQGVTEVPFQGLSDEQLYDIWHRHTKHCPSCRQSLVLIDKVKDFCRYLTLGLILLSLLLIIIGSDINITLVPVVFGILSLIGSYQLDSFRGRFLNSIPRKGLPIVRLYGD

SEQ ID NO: 12243 - protein, 263 aa, Escherichia coli
MGKLTGKTALITGALQGIGEGIARTFARHGANLILLDISPEIEKLADELCGRGHRCTAVVADVRDPASVAAAIKRAKEKEGRIDILVNNAGVCRLGSFLDMSDDDRDFHIDINIKGVWNVTKAVLPEMIARKDGRIVMMSSVTGDMVADPGEQAYALTKAAIVGLTKSLAVEYAQSGIRVNAICPGYVRTPMAESIARQSNPEDPESVLTEMAKAIPMRRLADPLEVGELAAFLASDESSYLTGTQNVIDGGSTLPETVSVGI

SEQ ID NO: 12244 - protein, 267 aa, Oryza sativa (japonica cultivar-group); identical to SEQ ID NO: 1196

SEQ ID NO: 12245 - protein, 260 aa, Sus scrofa
MASTGVERRKPLENKVALVTASTDGIGLAIARRLAQDGAHVVVSSRKQENVDRTVATLQGEGLSVTGTVCHVGKAEDRERLVAMAVNLHGGVDILVSNAAVNPFFGNIIDATEEVWDKILHVNVKATVLMTKAVVPEMEKRGGGSVLIVSSVGAYHPFPNLGPYNVSKTALLGLTKNLAVELAPRNIRVNCLAPGLIKTNFSQVLWMDKARKEYMKESLRIRRLGNPEDCAGIVSFLCSEDASYITGETVVVGGGTASRL

SEQ ID NO: 12246 - protein, 355 aa, Schizophyllum commune
MGGCASKPVDLEAKARSDDIDKMIEEDGKRLKKECKILLLGSGESGKSTIVKQMKIIHQDGFSQDELIAYRPIIHRNVLDSAKAILVHMKKLSVECEDFKNRPLQDKILDYQLDETTNLTISPDIAEAIDAFWKDPAVTRIIDEQTSHFYLMDSATYFFTEVLRIGEPNYIPTETDVLRARAKTTSITETRFTMGPLSIHMFDVGGQRSERKKWIHCFESVTSIIFCTALSEYDQSLLEEKNQNRMAESLVLFESIINSRWFLRTSIIIFLNKIDVFKLKVHKVPLERYFPEYTGGKDPNKAAKFILWKFMQANRAGLSVYPHLTQATDTSNIRLVFAAVKETILQNALKDSGIL

SEQ ID NO: 12247 - protein, 262 aa, Toxocara canis
MSVVHKACLIALLFVSSGVAQQCMDSASDCAANAGSCFTRPVSQVLQNRCQRTCNTCDCRDEANNCAASINLCQNPTFEPLVRDRCQKTCGLCAGCGFISSGIVPLVVTSAPSRRVSVTFANNVQVNCGNTLTTAQVANQPTVTWEAQPNDRYTLIMVDPDFPSAANGQQGQRLHWWVINIPGNNIAGGTTLAAFQPSTPAANTGVHRYVFLVYRQPAAINSPLLNNLVVQDSERPGFGTTAFATQFNLGSPYAGNFYRSQA

SEQ ID NO: 12248 - protein, 623 aa, Rattus norvegicus
MEGYHKPDQQKLQALKDTANRLRISSIQATTAAGSGHPTSCCSAAEIMAVLFFHTMRYKALDPRNPHNDRFVLSKGHAAPILYAVWAEAGFLPEAELLNLRKISSDLDGHPVPKQAFTDVATGSLGQGLGAACGMAYTGKYFDKASYRVYCMLGDGEVSEGSVWEAMAFAGIYKLDNLVAIFDINRLGQSDPAPLQHQVDVYQKRCEAFGWHAIIVDGHSVEELCKAFGQAKHQPTAIIAKTFKGRGITGIEDKEAWHGKPLPKNMAEQIIQEIYSQVQSKKKILATPPQEDAPSVDIANIRMPTPPNYKVGDKIATRKAYGLALAKLGHASDRIIALDGDTKNSTFSELFKKEHPDRFIECYIAEQNMVSIAVGCATRDRTVPFCSTFAAFFTRAFDQIRMAAISESNINLCGSHCGVSIGEDGPSQMALEDLAMFRSVPMSTVFYPSDGVATEKAVELAANTKGICFIRTSRPENAIIYSNNEDFQVGQAKVVLKSKDDQVTVIGAGVTLHEALAAAEMLKKEKIGVRVLDPFTIKPLDKKLILDCARATKGRILTVEDHYYEGGIGEAVSAVVVGEPGVTVTRLAVSQVPRSGKPAELLKMFGIDKDAIVQAVKGLVTKG

SEQ ID NO: 12249 - protein, 566 aa, Kluyveromyces lactis
MSELETGTAAHGTPVENKSVSSSQASTPTNVGSRDDLKVDDDNHSVDAIELPKKPRSAYITVSILCLMVAFGGFVFGWDTGTISGFVNQTDFIRRFGQEKADGSHYLSNVRTGLIVSIFNIGCAIGGIILSKLGDMYGRRIGLMIVVLIYVVGIIIQIASIDKWYQYFIGRIISGLGVGGISVLSPMLISETAPKHIRGTLVSFYQLMITFGIFLGYCTNYGTKTYSNSVQWRVPLGLCFAWAIFMITGMLFVPESPRFLVEKDRIDEAKRSIAKSNKVSYEDPAVQAEVDLICAGVEAERLAGSASIKELFSTKTKVFQRLIMGMLIQSFQQLTGNNYFFYYGTTIFNSVGMDDSFETSIVLGIVNFASTFVAIYVVDKFGRRKCLLWGAAAMTACMVVFASVGVTRLWPDGANHPETASKGAGNCMIVFACFYIFCFATSWAPIAYVVVAESYPLRVKAKCMAIATASNWIWGFLNGFFTPFITSAIHFYYGYVFMGCLVAMFFYVFFFVPETKGLTLEEVQEMWEEGVLPWKSSSWVPSSRRNAGYDVDALQHDEKPWYKAML

SEQ ID NO: 12250 - protein, 295 aa, Dictyostelium discoideum
MTEVEKIYEFKEELGRGAFSIVYLGENKQTKQRYAIKVINKSELGKDYEKNLKMEVDILKKVNHPNIIALKELFDTPEKLYLVMELVTGGELFDKIVEKGSYSEADAANLVKKIVSAVGYLHGLNIVHRDLKPENLLLKSKENHLEVAIADFGLSKIIGQTLVMQTACGTPSYVAPEVLNATGYDKEVDMWSIGVITYILLCGFPPFYGDTVPEIFEQIMEANYEFPEEYWGGISKEAKDFIGKLLVVDVSKRLNATNALNHPWLKSNNSNNTIDTVKMKEYIVERQKTQTKLVN

SEQ ID NO: 12251 - protein, 520 aa, Trametes hirsuta
MSRFQSLLAFVVASLAAVAHAAIGPTADLTISNAEVSPDGFARQAVVVNNVTPGPLVAGNKGDRFQLNVIDNLTNHTMLKSTSIHWHGFFQKGTNWADGPAFVNQCPISSGHSFLYDFQVPDQAGTFWYHSHLSTQYCDGLRGPFVVYDPNDPHASLYDVDNDDTVITLADWYHTAAKLGPAFPLGADATLINGLGRSPSTTAADLAVINVTKGKRYRFRLVSLSCDPNHTFSIDGHDLTIIEVDSINSQPLVVDSIQIFAAQRYSFVLNADQDVGNYWIRANPNFGNVGFAGGINSAILRYDGADPVEPTTTQTTPTKPLNEVDLHPLATMAVPGSPVAGGVDTAINMAFNFNGTNFFINGASFVPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPIYDALDVNDQ

SEQ ID NO: 12252 - protein, 354 aa, Helisoma trivolvis
MGCTLSAEERAAMERSKAIEKNLKEDGMQAAKDIKLLLLGAGESGKSTIVKQMKIIHEGGFTSEDTKQYKPVVYSNTIQSLVAIIRAMGTLSIPFGDNERESDAKMVLDVIARMEDTEPFSEELLAAMKRLWVDSGVQECLGRANEYQLNDSAKYFLDDLDRLGAKDYMPTEQDILRTRVKTTGIVEVHFSFKNLNFKLFDVGGQRSERKKWIHCFEDVTAIIFCVAMSEYDQVLHEDETTNRMQESLKLFDSICNNKWFTETSIILFLNKKDLFEEKIKKSPLTICFPEYTGKQMYQEASAYIQAQFEAKNKSSAKEIYCHQTCATDTNNIQFVFDAVTDVIIANNLRGCGLY

SEQ ID NO: 12253 - protein, 355 aa, Manduca sexta
MGCASSAEERAAPSAQQADREKLKEDGIQAAKDIKLLLLGAGESGKSTIVKQMKIIHESGFTNEDFKQYRPVVYSNTIQSLVAILRAMPTLGITYANKDRESDGKMVFDVIQRMEDTEPFSEELLAAMKRLWADAGVQECFGRSNEYQLNDSAKYFLDDLDRLGARDYQPTEEDILRTRVKTTGIVEVHFSFKNLNFKLFDVGRGQRSERKKWIHCFEDVTAIIFCVAMSEYDQVLHEDETTNRMQESLKLFDSICNNKWFTDTSIILFLNKKDLFEEKIRKSPLTICFPEYTRAYQEYGEAAAYIRSQFEAKNNSTTKEIYCHMTATDTNNNQFVFDAVTDVIIANNLRGCGLY

SEQ ID NO: 12254 - protein, 198 aa, Canis familiaris
LLGTGESGKSTFIKQMRIIHGAGYSEEDKRGFTKLVYQNIFTAMQAMIRAMETLKILYKYEQNKANALLIREVDVEKVTTFEHRYVHAIKTLWDDPGIQECYDRRREYQLSDSAKYYLADVDRIATSGYLPTQQDVLRVRVPTTGIIEYPFDLENIIFRMVDVGGQRSERRKWIHCFENVTSIMFLVALSEYDHVLVE

SEQ ID NO: 12255 - protein, 433 aa, Filobasidiella neoformans
MGGCMSTPEAPKKTAETKQVPSTSTSSRPPQASTSATATAAGAGTSAANGTANGIKGDTTATNRVGTSGGQGLAAALASTEPPGAQDSKGNKDRSNQIDRQLEDDQKKFRKECKILLLGSGESGKSTIVKQMKIIHQNGYSKDELLSFRGVIYKNVLDSAQALIMAMRKIGVDPEDANNRSYADRILEYRMDAGLDAVIPSEILYNIESLWHDPVIPSVMDRSSEFYLMDSATYFFANIRKIAGPDYVPDEADVLRARTKTTGISETRFNMGQLSIHMFDVGGQRSERKKWIHCFEAVTSIIFCVALSEYDQVLLEESGQNRMQESLVLFESVINSRWFLRTSVILFLNKIDLFKQKLPKVPLVQYFPEYTGMRRNINKAAKYILWRFTQTNRARLSVYPHLTQATDTSNIRLVFAAVKETILQNALRDSGIL

SEQ ID NO: 12256 - protein, 370 aa, Kluyveromyces lactis
MTGISQALALNDSGVNGFDTDLAKRNGTVNASGGQSPGGSETVNALKVLLLGSGESGKSTVLQQLKILHQNGFSREELLEYKPFIFDNIIETGKDLAKARRTFNVQLEEDAEISESDLDELLSQQYQPTKLPCLPADLAKTLKILWNLQSTQDLLVSEHRSSFYLMDSASYFYENLDRISEPKYIPTITDVIRTRKKTSGIFDTMIDLDKNLKLHFFDVGGQRSERKKWIHCFDNVTLIIFCVSLSEYDQTLLEDNSQNRLEESLILFDSVVNSRWFARSSVVLFLNKIDIFAEKLRHVPLEKYFPDYTGGKDINKAAKYILWRFVQLNRANLNIYPHVTQATDTSNIKLVFAAIKETILENSLKDSGVL

SEQ ID NO: 12257 - protein, 347 aa, Dictyostelium discoideum
MGCILTIEAKKSRDIDYQLRKEEGSKNETKLLLLGPGESGKSTIFKQMKIIQDDGGFSIDERLEYRYIIYGNCISQMKVLVTAAISQDLKPNNPDNETRFEKFSKISPGGNSWTLEIAEDIKQLWSDDSIQNIYRMKDKFYQLNDSAAYFFDNIGRFANENYVPTQDDVLRSRVRTTGIQEAHFKFINIEFRMLDVGGQRSERRKWIHCFDSVTAVIFCVALSEYDQTLREEESQNRMKESLMLFDEIVNSHWFRNTAFIIFFNKVDLFREKIAKIDLGDYFPAYTGGLSFDNSTQFIKKMFLDLSTGNQRIFAHFTCAIDTANIQFVFHAVRETLLKNIFNTIINY

SEQ ID NO: 12258 - protein, 354 aa, Cavia porcellus
MGCTLSAEDKAAVERSKMIDRNLREDGEKAAKEVKLLLLGAGESGKSTIVKQMKIIHEDGYSEEECKQYKVVVYSNTIQSIIAIIRAMGRLKIDFGEPARADDARQLFVLAGSAEEGLMTSELAGVIRRLWRDGGVQACFSRSREYQLNDSASYYLNDLDRISQTNYIPTQQDVLRTRVKTTGIVETHFTFKDLYFKMFDVGGQRSERKKWIHCFEGVTAIIFCVALSDYDLVLAEDEEMNRMHESMKLFDSICNNKWFTDTSIILFLNKKDLFEEKIKRSPLTICYPEYTGSNTYEEAAAYIQCQFEDLNRRKDTKEIYTHFTCATDTKNVQFVFDAVTDVIIKNNLKECGLY

SEQ ID NO: 12259 - protein, 341 aa, Lymnaea stagnalis
MSNDLEALRQETEQLKNQIREARKAAGDTTLAQACSGVEAVGRIQMRTRRTLRGHLAKIYAMHWASDSRNLVSASQDGKLIVWDGYTTNKVHAIPLRSSWVMTCAYAPSGNFVACGGLDNICSIYSLKTREGNVRVSRELPGHTGYLSCCRFIDDNSIVTSSGDMSCALWDIETGQQTTSFTGHTGDVMSLSTSPDFRTFVSGACDASAKLWDVRDGMCKQTFSGHESDINAITYFPNGHAFATGSDDATCRLFDIRADQEIGMYSHDNIICGITSVAFSKSGRLLLGRYDDFNCNVWDVLKQETHGVLAGHDNRVSCLGVTEDGSAVATGSWDSFLKIWN

SEQ ID NO: 12260 - protein, 354 aa, Cavia porcellus
MGCTLSAEDKAAVERSKMIDRNLREDGEKAAREVKLLLLGAGESGKSTIVKQMKIIHEAGYSEEECKQYKAVVYSNTIQSIIAIIRAMGRLKIDFGDSARADDARQLFVLAGAAEEGFMTAELAGVIKRLWKDSGVQACFNRSREYQLNDSAAYYLNDLDRIAQSNYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKKSPLTICYPEYTGSNTYEEAAAYIQCQFEDLNKRKDTKEIYTHFTCATDTKNVQFVFDAVTDVIIKNNLKDCGLF

SEQ ID NO: 12261 - protein, 354 aa, Gallus gallus
MGCTLSAEDKAAVERSKMIDRNLREDGEKAAREVKLLLLGAGESGKSTIVKQMKIIHEAGYSEEECKQYKAVVYSNTIQSIIAIIRAMGRLKIDFGDPTRADDARQLFVLAGAAEEGFMTADVAGVIKRLWKDSGVQACFNRSREYQLNDSAAYYLNDLDRIAQTSYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKRSPLTICYPEYAGSNTYEEAAAYIQCQFEDLNKRKDTKEIYTHFTCATDTKNVQFVFDAVTDVIIKNNLKDCGLF

SEQ ID NO: 12262 - protein, 355 aa, Cavia porcellus
MGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPLRADDARQLFALSCTAEEQGMLPEDLSGVIRRLWADHGVQACFSRSREYQLNDSAAYYLNDLDRIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLF

SEQ ID NO: 12263 - protein, 355 aa, Gallus gallus
MGCTVSAEDKAAAERSRMIDRNLREDGEKAAREVKLLLLGAGESGKSTIVKQMKIIHEDGYSEEECRQYKAVVYSNTIQSIMAIIKAMGNLQIDFGDSSRADDARQLFALACTAEEQGIMPEDLANVIRRLWADHGVQACFNRSREYQLNDSAAYYLNDLERIARADYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKIVHSPLTICFPEYTGANKYDEAAGYIQSKFEDLNKRKDTKEIYTHFTCATDTKNVQFVFDAVTDVIIKNNLKDCGLF

SEQ ID NO: 12264 - protein, 355 aa, Mus musculus
MGCTVSAEDKAAAERSKMIDKNLREDGEKAAREVKLLLLGAGESGKSTIVKQMKIIHEDGYSEEECRQYRAVVYSNTIQSILAIVKAMGNLQIDFADPQRADDARQLFALSCAAEEQGMLPEDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITQSSLTICFPEYTGANKYDEAASYIQSKFEDLNKRKDTKEIYTHFTCATDTKNVQFVFDAVTDVIIKNNLKDCGLF

SEQ ID NO: 12265 - protein, 354 aa, Helisoma trivolvis
MGCVTSQEDKAAVERSKQIDKSLRMDGEKAAREVKLLLLGAGESGKSTIVKQMKIIHEKGYSQEECLQYNPVVYSNAIQSMIAIIKAMGQLKIQFGHPDRAEEARQFFALAGHADEGEMSQELSGIMKRLWKDVGVQECFSRSREYQLNDSAEYYLNALDRISAPGYIPTEQDVLRTRVKTTGIVETHFTFKDLHFKMFDVGGQRSERKKWIHCFEGVTAIIFIVAMSEYDLTLAEDQEMNRMMESMKLFDSICNNKWFTETSIILFLNKKDLFEEKIKKSPLTICFPEYTGANTYEEAAAYIQLQFENLNKKKDTKEIYSHFTCATDTNNVQFVFDAVTDVIIKNNLKDCGLF

SEQ ID NO: 12266 - protein, 323 aa, Bos taurus
MDPKSQRVKFNDGHFIPVLGFGTYAPEEVPKSEALEATKFAIEVGFRHVDSAHLYQNEEQVGQAIRSKIADGTVKREDIFYTSKLWCNSLQPELVRPALEKSLQNLQLDYVDLYIIHSPVSLKPGNKFVPKDESGKLIFDSVDLCHTWEALEKCKDAGLTKSIGVSNFNHKQLEKILNKPGLKYKPVCNQVECHPYLNQSKLLEFCKSHDIVLVAYAALGAQLLSEWVNSNNPVLLEDPVLCAIAKKHKQTPALVALRYQVQRGVVVLAKSFNKKRIKENMQVFDFELTPEDMKAIDGLNRNTRYYDFQQGIGHPEYPFSEEY

SEQ ID NO: 12267 - protein, 248 aa, Acinetobacter sp. RA3849
MSEQKVALVTGALGGIGSEICRQLVTAGYKIIATVVPREEDREKQWLQSEGFQDSDVRFVLTDLNNHEAATAAIQEAIAAEGRVDVLVNNAGITRDATFKKMSYEQWSQVIDTNLKTLFTVTQPVFNKMLEQKSGRIVNISSVNGLKGQFGQANYSASKAGIIGFTKALAQEGARSNICVNVVAPGYTATPMVTAMREDVIKSIEAQIPLQRLAAPAEIAAAVMYLVSEHGAYVTGETLSINGGLYMH

SEQ ID NO: 12268 - protein, 1115 aa, Ipomoea nil
MENYGKAVTFSSSATSNLNTGKAIAQYNADAKLMAEFEQSRESGKSFDYSRSVIHAPQNVTEEEMTAYLSRIQRGGLIQPFGCMLAIEEPSFKIVGFSENCFDLLGLKSGVEPPERMSLIGIDARTLFTLSSRASLAKAVASREISLLNPIWVHSKINQKPFYAVLHRIDVGIVIDLEPANSADPALLLAGAVQSQKLAVRAISRLQSLPGGDIGTLCDTVVEDVQKLTGYDRVMVYKFHDDSHGEVVSEIRRSDLEPYLGLHYPATDIPQAARFLFKQNRVRMICDCNAQPVKVLQCEELKQPLCLVNSTLRSPHGCHTKYMANMGSIASLVMAVVINSSESMKLWGLVVCHHTSPRYVPFPLRYACEFLMQAFSLQLYMELQLASQLAEKKILQTQTLLCDMLLRDAPFGIVTQTPSIMDLVRCDGAALYYNGKCWLLGVTPTETQVKDIAEWLLHNHGDSTGLSTDCLSDAGYPGAPLLGDAVSGMATARITSKDFLFWFRSHTAKEVKWGGAKHHPEDKDDGGRMHPRSSFIAFLEVVKSRSLPWEDSEINAIHSLQLIMRDSLQGIGENYMKSVSSPQQNDSDGVRFYELSSMALELVRLVETATVPIFGVDSSGLINGWNAKIAELTGLQANVAIGKYLIDDVTHEDSHETFKALMCRALQGEEDRNVEVKLLKFGNHPTKEVVYLVVNACTSRDYKNDIIGVCFVGQDITPEKAVMDKFVRLQGDYEAIIQSLNPLIPPIFASDENACCSEWNAAMERLTGLVKCEVIGKRLPGEIFGGLCRLKGQDALTKFMILLYQGISGHDTEKLSFGFFDRKGNFIDVFITANKRTDERGNIIGCFCFLQTMAVDHPQISARDIEDDRECLSTLKEFAYIQQQMKNPLNGIRFTHKLLEGTVTSDHQKQFLETSEACEKQILSIIENMDSGGIVDGNRVELKTEEFVIGNVIDAVVSQVMIPLKEKNLQLLHDIPDQIKSLPIYGDQIKLQLVLSDFLLSIVRHAPSPDGWVEIRVSPGLKLIQDGNVFIHIQFRMTHPGQGLPSALIEDMVRGGTRWTTQEGVVLHLSQKLVRMMNGHVHYVREQQKCYFLIDLDFKTQKPRSRESSMDTKAD

SEQ ID NO: 12269 - protein, 1234 aa, Mus musculus
MAGARPGVHALQLEPSTVVKTLRRGSKFIKWDEEASSRNLVTLRVDPNGFFLYWTGPNMEVDTLDISSIRDTRTGRYARLPKDPKIREVLGFGGPDTRLEEKLMTVVAGPDPVNTTFLNFMAVQDDTVKVWSEELFKLAMNILAQNASRNTFLRKAYTKLKLQVNQDGRIPVKNILKMFSADKKRVETALESCGLNFNRSESIRPDEFPLEIFERFLNKLCLRPDIDKILLEIGAKGKPYLTLEQLMDFINQKQRDPRLNEVLYPPLRSSQARLLIEKYETNKQFLERDQMSMEGFSRYLGGEENGILPLEALDLSMDMTQPLSAYFINSSHNTYLTAGQLAGPSSVEMYRQALLWGCRCVELDVWKGRPPEEEPFITHGFTMTTEVPLRDVLEAIAEAAFKTSPYPVILSFENHVDSAKQQAKMAEYCRSIFGDALLIDPLDKYPLSAGIPLPSPQDLMGRILVKNKKRHRPSTGVPDSSVRKRPLEQSNSALSESSAATEPSSPQLGSPSSDSCPGLSNGEEVGLEKTSLEPQKSLGEESLSREPNVPMPDRDREDEEEDEEEEETTDPKKPTTDEGTASSEVNATEEMSTLVNYVEPVKFKSFEASRKRNKCFEMSSFVETKAMEQLTKSPMEFVEYNKQQLSRIYPKGTRVDSSNYMPQLFWNVGCQLVALNFQTLDLPMQLNAGVFEYNGRSGYLLKPEFMRRPDKSFDPFTEVIVDGIVANALRVKVISGQFLSDKKVGIYVEVDMFGLPVDTRRKYRTRTSQGNSFNPVWDEEPFDFPKVVLPTLASLRIAAFEEGGKFVGHRILPVSAIRSGYHYVCLRNEANQPLCLPALLIYTEASDYIPDDHQDYAEALINPIKHVSLMDQRAKQLAALIGESEAQASTETYQETPCQQPGSQLPSNPTPNPLDASPRWPPGPTTSSTSSSLSSPGQRDDLIASILSEVTPTPLEELRSHKAMVKLRSRQDRDLRELHKKHQRKAVALTRRLLDGLAQARAEGKCRPSPSALGKATNSEDVKEEEEAKQYREFQNRQVQSLLELREAQADVETKRKLEHLRQAHQRLKEVVLDTHTTQFKRLKELNEREKKELQKILDRKRNNSISEAKTREKHKKEVELTEINRRHITESVNSIRRLEEAQKQRHERLVAGQQQVLQQLEEEEPKLLAQLTQECQEQRERLPQEIRRCLLGETAEGLGDGPLVACASNGHAPGSGGHLSSADSESQEENTQL

SEQ ID NO: 12270 - protein, 443 aa, Mycobacterium leprae
MTVFSALLLAGVLSGLAFVVGIVAGIRLSPRLIERRQRLANEWAGITVLQMLQRIIALMPLGAAVVDTYRDVVYLNEQAKELGLVRDRQLDDQAWRAAQQALGGDDVEFDLLPGKRPAAGRSGLSVHGHARLLSEKDRRFAVVFVHDQSDYVRMEAARRDFVANVSHELKTPVGAMALLAEALLASADDAETVSRFAEKVLIEANRLGYMVAELIELSRLQGAERLPNVTDIDVDIIVSEAIARHKVAADTAAIEVRTDPPSGLRVLGDQTLLVTALANLVSNAIAYSPGGSLVSISRRRRGDNIEIAVTDRGIGIALEDQERVFERFFRGDKARSRATGGSGLGLAIVKHVAANHNGSIGVWSKPGTGSTFTLSIPAAMPLYQDNDEQSGQPRGCDMWLNRPQREEEEFKSMTPAQAMMQSEVTRGNVNDKCPDCGGRGIAG

SEQ ID NO: 12271 - protein, 404 aa, Homo sapiens
MSRRSSRLQAKQQPQPSQTESPQEAQIIQAKKRKTTQDVKKRREEVTKKHQYEIRNCWPPVLSGGISPCIIIETPHKEIGTSDFSRFTNYRFKNLFINPSPLPDLSWGCSKEVWLNMLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLEEVNYINTFRKGGQLSPVCNGGIMTPPKSTEKPPGKH

SEQ ID NO: 12272 - protein, 296 aa, Homo sapiens
MSKEVWLNMLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLEEVNYINTFRKGGQLSPVCNGGIMTPPKSTEKPPGKH

SEQ ID NO: 12273 - protein, 107 aa, Anopheles gambiae
SRSNRAGLQFPVGRIHRLLRKGNYAERVGPGAPVYLAAVMEYLAAEVLELAGNRARDNKKERRIIPRLQLAIRNDEEENKLLRRVTIAQGGVLPNIQAVLLPKRTTE

SEQ ID NO: 12274 - protein, 91 aa, Anopheles gambiae
MSGRGKGGKGLGKGGARRHRKVLRDNIQGTTKPAIRRLARRGGVKRISGLIYEERRGVLKVFLENVIRDAVAYTEHAKRKTVTAMDVVYAL

SEQ ID NO: 12275 - protein, 102 aa, Ricinus communis
MAMTKTKELVCSNAVVVFSKTYCPYCTSVKKLLDQLGAKYKVVELDTESDGSEIQTALAEWTGQRTVPNVFIGGKHIGGCDSTTAKHSQGQLVPLLTEAGAV

SEQ ID NO: 12276 - protein, 415 aa, Schizosaccharomyces pombe
MDVSTQTRHATYFQDENQLQKDHIYVKKKSHIKLNTGVPAPFKAVDNINQQDEPTLIEGNNESSISSSTGDTFEEDFAYQDKVEIEERSIRSTPKSIGDDDLENREGSFDAPEGILTHGKHRLPTIPEWTKEDLAALSEAAARLQANPSPEDIETDPSMVPDYDPEIFHYMQSLERKLAPPPNYMSVQQEIDWVTRHMLVDWIVQVQIHFRLLPETLFLAVNLIDRFLSIKVVSLQKVQLVGLSALLIACKYEEIHPPSIYNFAHVVQGIFTVDEIIRAERYMLMLLDFDISWPGPMSFLRRISRAHSYDHDIRMLAKYLQEVTLMDEIFIGAHISFIAATAYYLSMQMLGHLDWTPCHVYYSGYTARQLKPCANIIWECLVDAPNHHNAIYRKYSENRMKRVSAFAHNWVLSVI

SEQ ID NO: 12277 - protein, 132 aa, Schizosaccharomyces pombe
MSGGKSGGKAAVAKSAQSRSAKAGLAFPVGRVHRLLRKGNYAQRVGAGAPVYLAAVLEYLAAEILELAGNAARDNKKTRIIPRHLQLAIRNDEELNKLLGHVTIAQGGVVPNINAHLLPKTSGGTGKPSQEL

SEQ ID NO: 12278 - protein, 370 aa, Schizosaccharomyces pombe
MVKRHKNTIGVWRLGKTLGTGSTSCVRLAKHAKTGDLAAIKIIPIRYASIGMEILMMRLLRHPNILRLYDVWTDHQHMYLALEYVPDGELFHYIRKHGPLSEREAAHYLSQILDAVAHCHRFRFRHRDLKLENILIKVNEQQIKIADFGMATVEPNDSCLENYCGSLHYLAPEIVSHKPYRGAPADVWSCGVILYSLLSNKLPFGGQNTDVIYNKIRHGAYDLPSSISSAAQDLLHRMLDVNPSTRITIPEFFSHPFLMGCTSLSSMDSTTPPTPSLSIDEIDPLVVDCMCVLWKKSSSKKVVRRLQQRDDNDEKYVYKVLSEILRDDMLKKQRFDENKYLSLYDLIHDNNLFTKALNKFRTKASENAAY

SEQ ID NO: 12279 - protein, 250 aa, Brassica napus
MNSVSTFSELLGSENESPVGGDYCPMLAASCPKKPAGRKKFRETRHPIYRGVRLRKSGKWVCEVREPNKKSRIWLGTFKTAEIAARAHDVAALALRGRGACLNFADSAWRLRIPETTCAKDIQKAAAEAALAFEAEKSDTTTNDHGMNMASQAEVNDTTDHGLDMEETMVEAVFTEEQRDGFYMAEETTVEGVVPEEQMSKGFYMDEEWMFGMPTLLADMAAGMLLPPPSVQWGHNDDFEGDVDMNLWNY

SEQ ID NO: 12280 - protein, 251 aa, Brassica napus
MNSVSTFSELLRSENESPVNTEGGDYILAASCPKKPAGRKKFQETRHPIYRGVRLRKSGKWVCEVREPNKKSRIWLGTFKTAEIAARAHDVAALALRGRGACLNFADSAWRLRIPETTCAKDIQKAAAEAALAFEAEKSDTTTNDHGMNMASQVEVNDTTDHDLDMEETIVEAVFREEQREGFYMAEETTVVGVVPEEQMSKGFYMDEEWMFGMPTLLADMAAGMLLPLPSVQWGHNDDFEGDADMNLWNY

SEQ ID NO: 12281 - protein, 248 aa, Arabidopsis thaliana
MATTLSRDQYVYMAKLAEQAERYEEMVQFMEQLVSGATPAGELTVEERNLLSGAYKNVIGSLRAAWRIVSSLEQKEESRKNEEHVSLVKDYRSKVETELSSICSGILRLLDSHLIPSATARESKVFYLKMKGDYHRYLAEFKSGDERKTAAEDAMIAYKAAQDVAVADLAPTHPIRLGLALNFSVFYYEILNSSEKACSMAKQAFEEAIAELDTLGEESYKDSTLIMQLLRDNLTLWTSDMQEQMDEA

SEQ ID NO: 12282 - protein, 124 aa, Drosophila melanogaster
MSGRGKGGKVKGKAKSRSNRAGLQFPVGRIHRLLRKGNYAERVGAGAPVYLAAVMEYLAAEVLELAGNAARDNKKTRIIPRHLQLAIRNDEELNKLLSGVTIAQGGVLPNIQAVLLPKKTEKKA

SEQ ID NO: 12283 - protein, 103 aa, Drosophila melanogaster
MTGRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 12284 - protein, 472 aa, Saccharomyces cerevisiae
MGCTVSTQTIGDESDPFLQNKRANDVIEQSLQLEKQRDKNEIKLLLLGAGESGKSTVLKQLKLLHQGGFSHQERLQYAQVIRADAIQSMKILIIQARKLGIQLDCDDPINNKDLFACKRILLKAKALDYINASVAGGSDFLNDYVLKYSERYETRRRVQSTGRAKAAFDEDGNISNVKSDTDRDAETVTQNEDVDRNNSSRINLQDICKDLNQEGDDQMFVRKTSKEIQGQNRRNLIHEDIAKAIRQLWNNDKGIKQCFARSNEFQLEGSAAYYFDNIEKFASPNYVCTDEDILKGRIKTTGITETEFNIGSSKFKVLDAGGQRSERKKWIHCFEGITAVLFVLAMSEYDQMLFEDERVNRMHESIMLFDTLLNSKWFKDTPFILFLNKIDLFEEKVKSMPIRKYFPDYQGRVGDAEAGLKYFEKIFLSLNKTNKPIYVKRTCATDTQTMKFVLSAVTDLIIQQNLKKSGII

SEQ ID NO: 12285 - protein, 479 aa, Escherichia coli
MLAMGLVIYLATSKYGNIRLGEGKPEYSTLSWLFMFICAGLGSSTLYWGVAEWAYYYQTPGLNIAPRSQQALEFSVPYSFFHWGISAWATYTLASLIMAYHFHVRKNKGLSLSGIIAAITGVRPQGPWGKLVDLMFLIATVGALTISLVVTAATFTRGLSALTGLPDNFTVQAFVILLSGGIFCLSSWIGINNGLQRLSKMVGWGAFLLPLLVLIVGPTEFITNSIINAIGLTTQNFLQMSLFTDPLGDGSFTRNWTVFYWLWWISYTPGVAMFVTRVSRGRKIKEVIWGLILGSTVGCWFFFGVMESYAIHQFINGVINVPQVLETLGGETAVQQVLMSLPAGKLFLAAYLGVMIIFLASHMDAVAYTMAATSTRNLQEGDDPDRGLRLFWCVVITLIPLSILFTGASLETMKTTVVLTALPFLVILLVKVGGFIRWLKQDYADIPAHQVEHYLPQTPVEALEKTPVLPAGTVFKGDN

SEQ ID NO: 12286 - protein, 478 aa, Rattus norvegicus
MSPEDPQETQPLLRSPGARAPGGRRVFLATFAAALGPLSFGFALGYSSPAIPSLRRTAPPALRLGDTAASWFGAVVTLGAAAGGVLGGWLLDRAGRKLSLLLCTVPFVTGFAVITAARDVWMLLGGRLLTGLACGVASLVAPVYISEIAYPAVRGLLGSCVQLMVVTGILLAYVAGWVLEWRWLAVLGCVPPTLMLLLMCYMPETPRFLLTQHQYQEAMAALRFLWGSEEGWEEPPVGAEHQGFQLAMLRRPGVHKPLIIGICLMVFQQLSGVNAIMFYANTIFEEAKFKDSSLASVTVGIIQVLFTAVAALIMDRAGRKLLLALSGVIMVFSMSAFGTYFKLTQSGPSNSSHVGLLVPISAEPADVHLGLAWLAVGSMCLFIAGFAVGWGPIPWLLMSEIFPLHIKGVATGVCVLTNWFMAFLVTKEFNSIMEILRPYGAFWLTAAFCILSVLFTLTFVPETKGRTLEQITAHFEGR

SEQ ID NO: 12287 - protein, 343 aa, Physcomitrella patens
MASEGVLLGMGNPLLDISCVVDDAFLEKYGLTLNNAILAEDKHLPMYKELAANPDVEYIAGGATQNTIRIAQWMLGESNATSYFGCVGKDEYGDRMFKLASEGGVNIRYDVDEDLPTGTCGVLVVKGERSLVANLSAANKYKIDHLKKPENWAFVEKAKYIYSAGFFLTVSPESMMTVAKHAAETGKYYMINLAAPFICQFFKDPLMELFPYVDFIFGNESEARAFAQVQGWETEDTKVIAVKLAALPKAGGTHKRVAVITQGTDPTIVAEDGKVTEFPVTPIPKEKLVDTNAAGDSFVGGFLSQLVLGKDIAQCVRAGNYAASVIIQRSGCTFPSKPSFESQ

SEQ ID NO: 12288 - protein, 334 aa, Bos taurus
ISEIAYPEVRGLLGSCVQLMVVTGILLAYLAGWVLEWRWLAVLGCVAPSFMLLLMCFMPETPRFLLSQHKHQEAMAAMQFLWGYAQGWEEPPLGAQHQDFHVAQLRRPGVYKPFIIGISLMAFQQLSGVNAVMFYAETIFEEAKFKDSSLASVVVGVIQVLFTATAALIMDRAGRRLLLTLSGVVMVFSTSAFGTYFKLTEGGPSNSSHVDLPALVSMEAADTNVGLAWLAVGNMCLFIAGFAVGWGPIPWLLMSEIFPLHVKGVATGVCVLTNWFMAFLVTKEFSSLMEVLRPYGAFWLASAFCIFGVLFTLACVPETKGKTLEQITAHFEGR

SEQ ID NO: 12289 - protein, 332 aa, Streptomyces griseus
MATRAVARRQPAASGETGAAGSVRATGEIADRDLVGMYLDEIARTPLLDAAKEVELSQTIEAGVYAGKILDGEVDSDSAGASREELEALVAEGERAKDVFIRSNLRLVVAVARRYPRSGLPLLDLIQEGNAGLVRAVEKFDYAKGFKFSTYATWWIRQAITRSIADQSRTIRLPVHLVEELGRIRRVQREFNRENGRDPEPAEIAAELSSTPERVTDVLDWARDPVSLNMSVDDEGETQFGDLLEDTSAVSPEQSVLTLLRSEELDDLIGQLDDRTASIIKMRYGIEDGRERTLTEVGKQHGLTRERIRQIEKHALLELKRMAHDTGFDAAA

SEQ ID NO: 12290 - protein, 477 aa, Mus musculus
MSPEDPQETQPLLRPPEARTPRGRRVFLASFAAALGPLSFGFALGYSSPAIPSLRRTAPPALRLGDNAASWFGAVVTLGAAAGGILGGWLLDRSGRKLSLLLCTVPFVTGFAVITAARDVWMLLGGRLLTGLACGVASLVAPVYISEIAYPAVRGLLGSCVQLMVVTGILLAYVAGWVLEWRWLAVLGCVPPTLMLLLMCYMPETPRFLLTQHQYQEAMAALRFLWGSEEGWEEPPVGAEHQGFQLALLRRPGIYKPLIIGISLMVFQQLSGVNAIMFYANSIFEEAKFKDSSLASVTVGIIQVLFTAVAALIMDRAGRRLLLALSGVIMVFSMSAFGTYFKLTQSLPSNSSHVGLVPIAAEPVDVQVGLAWLAVGSMCLFIAGFAVGWGPIPWLLMSEIFPLHVKGVATGICVLTNWFMAFLVTKEFSSVMEMLRPYGAFWLTAAFCALSVLFTLTVVPETKGRTLEQVTAHFEGR

SEQ ID NO: 12291 - protein, 180 aa, Physcomitrella patens
MASAVVNQSEAAAVRAPSKPVKTYSKENEQLVKQSWEILKKDAQRNGINFFRKVFEIAPGAKAMYSFLRDSTIPFEENPKVKNHARYVFMMTGDAAVQLGEKGAYQVLESKLQKLAATHVNAGVTDDQFEIVKEAILYAIEMGVPDLWSPELKSAWGDAYDMLAEQVKAEMHAQRSAATS

SEQ ID NO: 12292 - protein, 477 aa, Homo sapiens [sequence omitted]

SEQ ID NO: 12293 - protein, 501 aa, Mus musculus
MEEKHQEETGELTLVLALATLIAAFGSSFQYGYNVAAVNSPSEFMQQFYNDTYYDRNEENIESFTLTLLWSLTVSMFPFGGFISSLVVGNLVNKLGKKRALLFNNIFSILPAIFMGCSQIAQSFELIIISRLLVGICAGISSNVVPMYLGELAPKNLRGALGVVPQLFITVGILVAQLFGLRSLLANEDGWPVLLGLTGVPAGLQLLLLPFFPESPRYLLIQKKDEAAAERALQTIRGWKDVHLEMEEIRKEDEAEKAAGFISVWKLFTMQSLRWQLISMIVLMAGQQLSGVNAIYYYADQIYLSAGVKSDDVQYVTAGTGAVNVFMTILTIFVVELWGRRFLLLVGFSTCLIACLVLTAALALQNTISWMPYISIVCVIVYVIGHALGPSPIPALLITEIFLQSSRPAAYMIGGSVHWLSNFTVGLIFPFIQMGLGPYSFIIFATICFLTTIYIFMVVPETKGRTFIEIIQIFTMKNKVSDVYPKKEEELGALPHAILEQ

SEQ ID NO: 12294 - protein, 175 aa, Nicotiana tabacum
MGSKMSDPLVIGRVIGEVVDYFTPSVKMSVTYNSSKHVYNGHELFPSSVTSKPRVEVHGGDLRSFFTLIMIDPDVPGPSDPYLREHLHWIVTDIPGTTDCSFGREIVGYEMPRPNIGIHRFVFLLFKQKKRQTLLSAPLSRDRFNTRKFSEENELGSPVAAAFFNCQRETAARRR

SEQ ID NO: 12295 - protein, 175 aa, Nicotiana tabacum
MGSKMSDPLVIGRVIGEVVDYFTPSVKMSVTYNSSKHVYNGHELFPSSVTSKPRVEVHGGDLRSFFTMIMIDPDVPGPSDPYLREHLHWIVTDIPGTTDCSFGKEIVGYEMPRPNIGIHRFVFLLFKQKKRQTVLTAPLSRDRFNTRKFAEENELGSPVAAVFFNCQRETAARRR

SEQ ID NO: 12296 - protein, 400 aa, Oryctolagus cuniculus
  unsure (1)..(400): unsure at all Xaa locations
NLLAIIAGCLMGFAKIAESVEMLILGRLLIGIFCGLCTGFVPMYIGEVSPTALRGAFGTLNQLGIVIGILVAQIFGLEIILGSEVLWPVLLGFTIIPAILQSAALPFCPESPRFLLINKEEDEAKQILQILQRLWGTQDVAQDIQEMKEESARMRQEKQVTVLELFRAPSYRQPIIISIVLQLSQQLSGINAVFYYSTGIFKDAGVREPIYATIGAGVVNTIFTIVSVFLVERAGRRTLHLIGLGGMALCSVLMTVSLLLKXKYDTMSLVCIAAILIYAAFFEIGPGPIPWLIVTGLFSQDPRPAAMAVAGCSNWTSNFLVGLLFPSAAYYLGAYVFVIFAVFLVAFFIFTFFKVPETRGRTFEDITRAFEGQAAEANKLGKGPTMEMNSIQPIETTTHV

SEQ ID NO: 12297 - protein, 914 aa, Escherichia coli O157:H7
MNLTLTRRLWMGFALMALLTLTSTLVGWYNLRFISQVEKDNTQALIPTMNMARQLSEASAWELFAAQNLTSADNEKMWQAQGRMLTAQSLKINALLQALREQGFDTTAIEQQEQEISRSLRQQGELVGRRLQLRQQQQRLSQQIVAAADEIARLAQGQANNAATSAGATQAGIYDLIEQDQRQAAESALDRLIDIDLEYVNQMNELRLSALRVQQMVMNLGLEQIQKNAPTLEKQLNNAVKILQRRQIRIEDPGVRAQVATTLTTVSQYSDLLALFQQDSEISNHLQTLAQNNIAQFAQFSSEVSQLVDTIELRNQHGLAHLEKASARGQYSLLLLGMVSLCALILILWRVVYRSVTRPLAEQTQALQRLLDGDIDSPFPETAGVRELDTIGRLMDAFRSSVHALNRHREQLAAQVKARTAELQELVIEHRQARAEAEKASQAKSAFLAAMSHEIRTPLYGILGTAQLLADNPALNAQRDDLRAITDSGESLLTILNDILDYSAIEAGGKNVSVSDEPFEPRPLLESTLQLMSGRVKGRPIRLATAIADDVPTALMGDPRRIRQVITNLLSNALRFTDEGQIVLRSRTDGEQWLVEVEDSGCGIDPAKLAEIFQPFIQVSGKRGGTGLGLTISSRLAQAMGGELSATSTPEVGSCFCLRLPLRVATAPVPKTVNQAVRLDGLRLLLIEDNPLTQRITVEMLNTSGAQVVAIGNAAQALETLQNSEPFAAALVDFDLPDVNGITLARQLARQYPSLVLIGFSAHVIDETLRQRTSSLFRGIIPKPVPREVLGQLLAHYLQLQANNDLPLDVSQLNEDAQLMGTEKIHEWLALFTQHALPLLDEIDIARATQDSEKIKRAAHQLKSSCSSLGMRSASQLCAQLEQQPLSAPLPHEEITRSVAALEAWLNKKDLNAI

SEQ ID NO: 12298 - protein, 356 aa, Drosophila melanogaster
MPEFVRVAINESLWEFPDIYEFVRFLGGGSFGQVAKVRLRGTENYFAMKRLMRPFEREEDAKGTYREIRLLKHMNHRNVISLLNVFHPPAHNMMEFQQVYLVTHLMDADLHRYSRSKRMSDQEIRIILYQILRGLKYIHSAGVVHRDLKPCNIAVNGNSEVRILDFGLSRMCADKMTDHVGTMWYLAPEIIFLRGQYTKAIDVWSVGCILAELITDRVLFRGENYVSQIRCLINIMGTPTREFITGISMERSRNYLEGYPLRQRCDFHHLFMGYDVQAIDLMEKMLEMVPEKRITAAEAMLHPYLRDLIEPHHHAEDTAPVYDQNFENMVLPVKCWKELVSHEIRNFRPDQLDLHF

SEQ ID NO: 12299 - protein, 508 aa, Escherichia coli
ILNAILLNVLAGAALFTLARMYERRIFIPAESDALRLEEHEQFNRKIVASAPVGICILRTADGVNILSNELAHTYLNMLTHEDRQRLTQIICGQQVNFVDVLTSNNTNLQISFVHSRYRNENVAICVLVDVSSRVKMEESLQEMAQAAEQASQSKSMFLATVSHELRTPLYGIIGNLDLLQTKELPKGVDRLVTAMNNSSSLLLKIISDILDFSKIESEQLKIEPREFSPREVMNHITANYLPLVVRKQLGLYCFIEPDVPVALNGDPMRLQQVISNLLSNAIKFTDTGCIVLHVRADGDYLSIRVRDTGVGIPAKEVVRLFDPFFQVGTGVQRNFQGTGLGLAICEKLISMMDGDISVDSEPGMGSQFTVRIPLYGAQYPQKKGVEGLSGKRCWLAVRNASLCQFLETSLQRSGIVVTTYEGQEPTPEDVLITDEVVSKKWQGRAVVTFCRRHIGIPLEKAPGEWVHSVAAPHELPALLARIYLIEMESDDLDWPPESPDNQYHLNK

SEQ ID NO: 12300 - protein, 807 aa, Escherichia coli
MFRALALVLWLLIAFSSVFYIVNALHQRESEIRQEFNLSSDQAQRFIQRTSDVMKELKYIAENRLSAENGVLSPRGRETQADVPAFEPLFADSDCSAMSNTWRGSLESLAWFMRYWRDNFSAAYDLNRVFLIGSDNLCMANFGLRDMPVERDTALKALHERINKYRNAPQDDSGSNLYWISEGPRPGVGYFYALTPVYLANRLQALLGVEQTIRMENFFLPGTLPMGVTILDENGHTLISLTGPESKIKGDPRWMQERSWFGYTEGFRELVLKKNLPPSSLSIVYSVPVDKVLERIRMLILNAILLNVLAGAALFTLARMYERRIFIPAESDALRLEEHEQFNRKIVASAPVGICILRTADGVNILSNELAHTYLNMLTHEDRQRLTQIICGQQVNFVDVLTSNNTNLQISFVHSRYRNENVAICVLVDVSSRVKMEESLQEMAQAAEQASQSKSMFLATVSHELRTPLYGIIGNLDLLQTKELPKGVDRLVTAMNNSSSLLLKIISDILDFSKIESEQLKIEPREFSPREVMNHITANYLPLVVRKQLGLYCFIEPDVPVALNGDPMRLQQVISNLLSNAIKFTDTGCIVLHVRADGDYLSIRVRDTGVGIPAKEVVRLFDPFFQVGTGVQRNFQGTGLGLAICEKLISMMDGDISVDSEPGMGSQFTVRIPLYGAQYPQKKGVEGLSGKRCWLAVRNASLCQFLETSLQRSGIVVTTYEGQEPTPEDVLITDEVVSKKWQGRAVVTFCRRHIGIPLEKAPGEWVHSVAAPHELPALLARIYLIEMESDDLDWPPESPDNQYHLNK

SEQ ID NO: 12301 - protein, 530 aa, Homo sapiens
MGSNSGQAGRHIYKSLADDGPFDSVEPPKRPTSRLIMHSMAMFGREFCYAVEAAYVTPVLLSVGLPSSLYSIVWFLSPILGFLLQPVVGSASDHCRSRWGRRRPYILTLGVMMLVGMALYLNGATVVAALIANPRRKLVWAISVTMIGVVLFDFAADFIDGPIKAYLFDVCSHQDKEKGLHYHALFTGFGGALGYLLGAIDWAHLELGRLLGTEFQVMFFFSALVLTLCFTVHLCSISEAPLTEVAKGIPPQQTPQDPPLSSDGMYEYGSIEKVKNGYVNPELAMQGAKNKNHAEQTRRAMTLKSLLRALVNMPPHYRYLCISHLIGWTAFLSNMLFFTDFMGQIVYRGDPYSAHNSTEFLIYERGVEVGCWGFCINSVFSSLYSYFQKVLVSYIGLKGLYFTGYLLFGLGTGFIGLFPNVYSTLVLCSLFGVMSSTLYTVPFNLITEYHREEEKERQQAPGGDPDNSVRGKGMDCATLTCMVQLAQILVGGGLGFLVNTAGTVVVVVITASAVALIGCCFVALFVRYVD

SEQ ID NO: 12302 - protein, 129 aa, Arabidopsis thaliana
MVEDDCVDNGVLLPNVTSKILAKVIEYCKRHVEAAASKAEAVEGAATSDDDLKAWDADFMKIDQATLFELILAANYLNIKNLLDLTCQTVADMIKGKTPEEIRTTFNIKNDFTPEEEEEVRRENQWAFE

SEQ ID NO: 12303 - protein, 181 aa, Antirrhinum majus
MAAKVSSDPLVIGRVIGDVVDHFTSTVKMSVIYNSNNSIKHVYNGHELFPSAVTSTPRVEVHGGDMRSFFTLIMTDPDVPGPSDPYLREHLHWIVTDIPGTTDSSFGKEVVSYEMPRPNIGIHRFVFLLFKQKKRGQAMLSPPVVCRDGFNTRKFTQENELGLPVAAVFFNCQRETAARRR

SEQ ID NO: 12304 - protein, 302 aa, Rana dybowskii
MDEYAKIEKIGEGTYGVVYKGVHKATGQIVAMKKIRLENEEEGVPSTAIREISLLKELQHPNIVCLLDVLMQDSRLYLIFEFLSMDLKKYLDSIPSGQYLEAMLVKSYLYQILQGIIFCHARRVLHRDLKPQNLLIDSKGVIKLADFGLARAFGIPVRVYTHEVVTLWYRAPEVLLGSVRYSTPVDVWSIGTIFAEIASKKPLFHGDSEIDQLFRISELWGTPNNEVWPEVESLQDYKNTFPKWKGGSLAANVKNIDKEGLDLLAKMLVYDPAKRISARKALLHPYFDDLDKSSLPANQIRN

SEQ ID NO: 12305 - protein, 492 aa, Mus musculus
MDPSSKKVTGRLMLAVGGAVLGSLQFGYNTGVINAPQKVIEEFYNQTWNHRIGEPIPSTTLTTLWSLSVAIFSVGGMIGSFSVGLFVNRFGRRNSMLMMNLLAFVAAVLMGFSKLGKSFEMLILGRFIIGVYCGLTTGFVPMYVGEVSPTALRGALGTLHQLGIVVGILIAQVFGLDSIMGNADLWPLLLSVIFIPALLQCILLPFCPESPRFLLINRNEENRAKSVLKKLRGTADVTRDLQEMKEEGRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAVLMTIALALLERLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 12306 - protein, 914 aa, Escherichia coli
MNLTLTRRLWMGFALMALLTLTSTLVGWYNLRFISQVEKDNTQALIPTMNMARQLSEASAWELFAAQNLTSADNEKMWQAQGRMLTAQSLKINALLQALREQGFDTTAIEQQEQEISRSLRQQGELVGQRLQLRQQQQQLSQQIVAAADEIARLAQGQANNATTSAGATQAGIYDLIEQDQRQAAESALDRLIDIDLEYVNQMNELRLSALRVQQMVMNLGLEQIQKNAPTLEKQLNNAVKILQRRQIRIEDPGVRAQVATTLTTVSQYSDLLALYQQDSEISNHLQTLAQNNIAQFAQFSSEVSQLVDTIELRNQHGLAHLEKASARGQYSLLLLGMVSLCALILILWRVVYRSVTRPLAEQTQALQRLLDGDIDSPFPETAGVRELDTIGRLMDAFRSNVHALNRHREQLAAQVKARTAELQELVIEHRQARAEAEKASQAKSAFLAAMSHEIRTPLYGILGTAQLLADNPALNAQRDDLRAITDSGESLLTILNDILDYSAIEAGGKNVSVSDEPFEPRPLLESTLQLMSGRVKGRPIRLATAIADDMPCALMGDPRRIRQVITNLLSNALRFTDEGYIILRSRTDGEQWLVEVEDSGCGIDPAKLAEIFQPFVQVSGKRGGTGLGLTISSRLAQAMGGELSATSTPEVGSCFCLRLPLRVATAPVPKTVNQAVRLDGLRLLLIEDNPLTQRITIEMLKTSGAQIVAVGNAAQALETLQNSEPFAAALVDFDLPDIDGITLARQLAQQYPSLVLIGFSAHVIDETLRQRTSSLFRGIIPKPVPREVLGQLLAHYLQLQVNNDQSLDVSQLNEDAQLMGTEKIHEWLVLFTQHALPLLDEIDIARASQDSEKIKRAAHQLKSSCSSLGMHIASQLCAQLEQQPLSAPLPHEEITRSVAALEAWLHKKDLNAI

SEQ ID NO: 12307 - protein, 509 aa, Mus musculus
MPSGFQQIGSDDGEPPRQRVTGTLVLAVFSAVLGSLQFGYNIGVINAPQKVIEQSYNATWLGRQGPGGPDSIPQGTLTTLWALSVAIFSVGGMISSFLIGIISQWLGRKRAMLANNVLAVLGGALMGLANAVASYEILILGRFLIGAYSGLTSGLVPMYVGEIAPTHLRGALGTLNQLAIVIGILVAQVLGLESMLGTATLWPLLLALTVLPALLQLILLPFCPESPRYLYIIRNLEGPARKSLKRLTGWADVSDALAELKDEKRKLERERPMSLLQLLGSRTHRQPLIIAVVLQLSQQLSGINAVFYYSTSIFESAGVGQPAYATIGAGVVNTVFTLVSVLLVERAGRRTLHLLGLAGMCGCAILMTVALLLLERVPAMSYVSIVAIFGFVAFFEIGPGPIPWFIVAELFSQGPRPAAMAVAGFSNWTCNFIVGMGFQYVADAMGPYVFLLFAVLLLGFFIFTFLKVPETRGRTFDQISAAFRRTPSLLEQEVKPSTELEYLGPDEND

SEQ ID NO: 12308 - protein, 523 aa, Mus musculus
MSEDKITGTLAFTVFTAVLSSFQFGYDIGVINAPQEVIISHYRHVLGVPLDDRKAAINYDVNGTDTPLTVTPAYTTPAPWDEEETEGSAHIVTMLWSLSVSSFAVGGMVASFFGGWLGDKLGRIKAMLAANSLSLTGALLMGCSKFGPAHALIIAGRSVSGLYCGLISGLVPMYIGEIAPTTLRGALGTLHQLALVTGILISQIAGLSFILGNQDHWHILLGLSAVPALLQCLLLLFCPESPRYLYIKLEEEVRAKKSLKRLRGTEDVTKDINEMKKEKEEASTEQKVSVIQLFTDANYRQPILVALMLHMAQQFSGINGIFYYSTSIFQTAGISQPVYATIGVGAINMIFTAVSVLLVEKAGRRTLFLTGMIGMFFCTIFMSVGLVLLDKFAWMSYVSMTAIFLFVSFFEIGPGPIPWFMVAEFFSQGPRPTALALAAFSNWVCNFVIALCFQYIADFLGPYVFFLFAGVVLVFTLFTFFKVPETKGKSFEEIAAEFRKKSGSAPPRKAAVQMEFLASSESV

SEQ ID NO: 12309 - protein, 583 aa, Arabidopsis thaliana
MEAAKVYTQDGTVDLQGRPVLASKTGRWRACSFLLGYEAFERMAFYGIASNLVNYLTKRLHEDTISSVRNVNNWSGAVWITPIAGAYIADSYIGRFWTFTASSLIYVLGMILLTMAVTVKSLRPTCENGVCNKASSLQVTFFYISLYTIAIGAGGTKPNISTFGADQFDSYSIEEKKQKVSFFNWWMFSSFLGALFATLGLVYIQENLGWGLGYGIPTVGLLVSLVVFYIGTPFYRHKVIKTDNLAKDLVQVPIAAFKNRKLQCPDDHLELYELDSHYYKSNGKHQVHHTPVFRFLDKAAIKTSSRVPCTVTKVEVAKRVLGLIFIWLVTLIPSTLWAQVNTLFVKQGTTLDRKIGSNFQIPAASLGSFVTLSMLLSVPMYDQSFVPFMRKKTGNPRGITLLQRLGVGFAIQIVAIAIASAVEVKRMRVIKEFHITSPTQVVPMSIFWLLPQYSLLGIGDVFNAIGLLEFFYDQSPGEMQSLGTTFFTSGIGLGNFLNSFLVTMIDKITSKGGGKSWIGNNLNDSRLDYYYGFLVVISIVNMGLFVWAASKYVYKSDDDTKEFSGGGCVQMEAKALDTSPLSI

SEQ ID NO: 12310 - protein, 390 aa, Arabidopsis thaliana
MTKNSNHDENEFISFEPNQNTKIRFEDADEDEVAEGSGVAGEETPQDESMFDAGESADTAEVTDDTTSADYYFDSYSHFGIHEEMLKDVVRTKTYQNVIYQNKFLIKDKIVLDVGAGTGILSLFCAKAGAAHVYAVECSQMADMAKEIVKANGFSDVITVLKGKIEEIELPTPKVDVIISEWMGYFLLFENMLDSVLYARDKWLVEGGVVLPDKASLHLTAIEDSEYKEDKIEFWNSVYGFDMSCIKKKAMMEPLVDTVGQNQIVTDSRLLKTMDISKMSSGDASFTAPFKLVAQRNDYIHALVAYFDVSFTMCHKLLGFSTGPKSRATHWKQTVLYLEDVLTICEGETITGTMSVSPNKKNPRDIDIKLSYSLNGQHCKISRTQHYKMR

SEQ ID NO: 12311 - protein, 761 aa, Arabidopsis thaliana
MATINDIGVAAAINIVTAFAFLLAFAIFRIQPVNDRVYFPKWYLKGLRSSSIQTGGFGSKFINLDFRSYIRFLNWMPEALKMPEPELVDHAGLDSVVYLRIYLLGLKIFFPIACVAFTTMVPVNWTNKGLDRLRHSNISFSDIDKLSLSNIPNGSPRFWVHLCMAYAITFWTCFILKREYQNIALMRLQFLANDQRRPNQFTVLVRNIPADPHESICELVEHFFKVNHPDHYLTFQAVHDATKLSELVLTRKQMQNLLDYNINKHMRNLSNRPVIKMGFLGCCGEEADGIKYYTSVVEGLTREISEEKQRLRTGTKSIVPAAFVSFKSRWGAAVCAQTQQTRNPTEWLTEWAAEPRDIYYDNLALPYVDLKIRRLIVGVAYFFLTFFFMIPIAFVQSLANIEGIEKAFPFLKPLIEVKLLKSIIQGFLPGIALKIFLLFLPRILMQMSKFEGFVSTSSLERRAATRFYMFQFINVFLGSIVTGTAFQQLNSFLNQSANDIPKTIGVSIPMKATFFITYIMVDGWAGVAGEILRLKPLIIYHLKNSFLVRTEKDREEATDPGTIGFNTGEPQIQLYFLLGLVYAAVSPILLPFILVFFGLAFVVYRHQVINVYNQKYESAGKFWPDVHRRVVTALVVSQLLLMGLLSTKHASKSTPLLLVLPLLTIGFHKHCKNRYQPAFVTYPLQQEAMIKDTLDRIREPNLNLKAFLRDAYAHPEFRVGEDPEPEEKLESDMSPPDLVATKRWSWRNTPLPSKDSCREIP

SEQ ID NO: 12312 - protein, 582 aa, Arabidopsis thaliana
MTVEEVGDDYTKDGTVDLQGNPVRRSIRGRWKACSFVVVYEVFERMAYYGISSNLFIYMTTKLHQGTVKSSNNVTNWVGTSWLTPILGAYVGDALLGRYITFVISCAIYFSGMMVLTLSVTIPGIKPPECSTTNVENCEKASVLQLAVFFGALYTLAIGTGGTKPNISTIGADQFDVFDPKEKTQKLSFFNWWMFSIFFGTLFANTVLVYVQDNVGWTLGYGLPTLGLAISITIFLLGTPFYRHKLPTGSPFTKMARVIVASFRKANAPMTHDITSFHELPSLEYERKGAFPIHPTPSLRFLDRASLKTGTNHKWNLCTTTEVEETKQMLRMLPVLFITFVPSMMLAQINTLFVKQGTTLDRKVTGSFSIPPASLSGFVTLSMLISIVLYDRVFVKITRKFTGNPRGITLLQRMGIGLIFHILIMIVASVTERYRLKVAADHGLIHQTGVKLPLTIFALLPQFVLMGMADSFLEVAKLEFFYDQAPESMKSLGTSYSTTSLAIGNFMSSFLLSTVSEITKKRGRGWILNNLNESRLDYYYLFFAVLNLVNFILFLVVVKFYVYRAEVTDSVDVKEVEMKETE

SEQ ID NO: 12313 - protein, 116 aa, Avena sterilis subsp. ludoviciana
VDAQTYNPAISPIVYECLINPMMRGIPTNDKVVAESLEKLTKVLEVYEARLSKSKFLAGDFFSFADLNHFPYTFYFMGTPHAVLFDSFPHVKAWWETIMARPAVQRMAAKMVPNKA

SEQ ID NO: 12314 - protein, 184 aa, Histriculus cavicola
AGGIADMSGLHKSVRESTDKLDAAGNTTAAIGKGFAIGSACLVALALFGAFVTRSGLTTVNILQPLEFSGLLVGAMLPYAFSALTMAAVGQAAKEMIVEITRQFRSGLIQADDREPDYDRCIAISTNASLKKMVLPGLLVIGTPLLFGILFGPRGVSGLLAGAIVSGVQIAISFQNTGGAWDNA

SEQ ID NO: 12315 - protein, 197 aa, Heliobacterium chlorum
AGGIAEMAELGPEVRKKTDKLDAVGNTTAAVAKGFAIGSAALTALALFTAFAEEVVKSPGVSSALHGSHFVLNLLEPKIIIGLFIGGTVPFLFCAFAMEAVGKAAFEMIGEVRRQFREIPGLMEGKAKPDYARCVDISTRAAIRQMIAPGLLAVITPLIVGFGFGAQALGGMLAGVTVAGVLLAIFMANAGGAWDHA

SEQ ID NO: 12316 - protein, 197 aa, Allochromatium vinosum
AGGIAEMSGLPEDVRKTTDALDAVGNTTKAVTKGYAIGSAGLAALVLFADYTHNLEVAGKMQVFSLSDPAVIIGLFIGGLVPYLFGAMAMEAVGRAAGSVVIEVRRQFREIKGIMEGTAKPDYSRAVDLLTKAAIKEMVVPSLLPILVPVAVAIGMNILMGDGAGIRALGGMLIGTIVTGLFVAISMCTGGGAWDNA

SEQ ID NO: 12317 - protein, 184 aa, Leptomonas ctenocephali
AGGIAEMSHMGHEIREITDALDAAGNTTAAIGKGFAIASAAFVALALYGAYVSRVSIPVVNILDARVMPGLLFGAMLPYWFSAMTMKSVGVAAMDMVNEIRRQFQDPEVADGRREPDYESCVAIATQAALHQMIAPAALVMLTPIIVGVLFGKYTLAGVLPGAIVSGVQMAISASNTGGAWDNA

SEQ ID NO: 12318 - protein, 204 aa, Paramecium tetraurelia
AGGIAEMSELGENVRESTDALDAAGNTTAAIGKGFAIGSAALVSLSLYGGYLTRIQTYKVGDEFPYSEGAKIDDPVIFAMLLIGAMLPYAFSAFTMKSVGKAALQMVEEVRRQLHERPGIYAGTEEPDFKACIAISTKASLKEMIPPGLLVKYGMYQLQVIVTPTAVGLFFGPQAVAGLLPGALVSGVQMAISAINTGGAWDNA

SEQ ID NO: 12319 - protein, 193 aa, Ochromonas danica
AGGISEMAELHKDVRTKTDALDSAGNTTAAIGKGFAIGSAALVSLALYGAFVVRIRVSSHNSDSHVEILQPMTFAFLLIGSMLPYWFSALTMKSVGDAAIEMVKEVQWQFEQNPELLNPNGTARPDYSRCVAISTKSALREMIAPGALVMLAPLVAGTFFGVHAVYGLLTGALLSGVQLAVSMSNTGGAWDNA

SEQ ID NO: 12320 - protein, 187 aa, Tetrahymena pyriformis
AGGIAEMAEMGEHVRKRTDALDAAGNTTAAIGKGFAIGSAALVSLALFGGFLTNATTSKVGTQLSPANTMVVNPMVVAFLLVGAMLPYAFSAFTMKSVGKAALEMVEEIRRQIRNEPGILTGEKEPDYQSCIQISTKSSLKEMIVPGALVILSPIVTGIFFGPVAIAGLLPGALVSGVQMAISYSNT

SEQ ID NO: 12321 - protein, 235 aa, Matricaria chamomilla
MIRNNAFDSDFALLESVRRHLLDDNAPPMSCRSNNFLFPHLSDSWGELPLQQNDSEDMLIAKFLNEALPLQQNDSEGIITPEMTSSSENIFFVKSEPETSSFQPKSLGSQKGKHYRGVRRRPWGKYAAEIRDPAKNGARVWLGTYETAEDAAVAYDMAAYRMRGSRALLNFPLRINSGEPEPVRITSKRKTTSPSEGLVVKKVKVELEMSTQAEFPLVYGCYYCVILGPFLVKCF

SEQ ID NO: 12322 - protein, 248 aa, Mus musculus
MNPFQKNESKETLFSPVSTEEMLPGPPSPPKKSTPKLFGSSYPLSIAFIVVNEFCERFSYYGMKAVLTLYFLYFLHWNEDTSTSVYHAFSSLCYFTPILGAAIADSWLGKFKTIIYLSLVYVLGHVFKSLGAIPILGGKMLHTILSLVGLSLIALGTGGIKPCVAAFGGDQFEEEHAEARTRYFSVFYLSINAGSLISTFITPMLRGDVKCFGEDCYALAFGIPGLLMVLALGEWSGKGCEQPLIPAT

SEQ ID NO: 12323 - protein, 517 aa, Mus musculus
MKQSSNVPAFLSKLWTLVEETHTNEFITWSQNGQSFLVLDEQRFAKEILPKYFKHNNMASFVRQLNMYGFRKVVHIESGIIKQERDGPVEFQHPYFKQGQDDLLENIKRKVSSSKPEENKIRQEDLTKIISSAQKVQIKQETIESRLSELKSENESLWKEVSELRAKHAQQQQVIRKIVQFIVTLVQNNQLVSLKRKRPLLLNTNGAPKKNLYQHIVKEPTDNHHHKVPHSRTEGLKSRERISDDIIIYDVTDDNVDEENIPVIPETNEDVVVDSSNQYPDIVIVEDDNEDEYAPVIQSGEQSEPAREPLRVGSAGSSSPLMSSAVQLNGSSNLTSDDPVTMMDSILNDNINLLGKVELLDYLDSIDCSLEDFQAMLSGRQFSIDPDLLVDSENKGLEATKSSVVQHVSEEGRKSKSKPDKQLIQYTAFPLLAFLDGNSASAIEQGSTTASSEVVPSVDKPIEVDELLDSSLDPEPTQSKLVRLEPLTEAEASEATLFYLCELAPAPLDSDMPLLDS

SEQ ID NO: 12324 - protein, 474 aa, Mus musculus
MPGTALSPLLLLLLLSWASRNEAAPDQDEIDCLPGLAKQPSFRQYSGYLRASDSKHFHYWFVESQNDPKNSPVVLWLNGGPGCSSLDGLLTEHGPFLIQPDGVTLEYNPYAWNLIANVLYIESPAGVGFSYSDDKMYVTNDTEVAENNYEALKDFFRLFPEYKDNKLFLTGESYAGIYIPTLAVLVMQDPSMNLQGLAVGNGLASYEQNDNSLVYFAYYHGLLGNRLWTSLQTHCCAQNKCNFYDNKDPECVNNLLEVSRIVGKSGLNIYNLYAPCAGGVPGRHRYEDTLVVQDFGNIFTRLPLKRRFPEALMRSGDKVRLDPPCTNTTAPSNYLNNPYVRKALHIPESLPRWDMCNFLVNLQYRRLYQSMNSQYLKLLSSQKYQILLYNGDVDMACNFMGDEWFVDSLNQKMEVQRRPWLVDYWESGEQVAGFVKECSHITFLTIKGAGHMVPTDKPRAAFTMFSRFLNKEPY

SEQ ID NO: 12325 - protein, 422 aa, Nicotiana tabacum
HLTDISPRKMSCGYPDTGGQVVYILDQVPALEREMLKRIKEQGLDIKPRILIATRLLPDAVGTTCGQRLEKVFGTEHSHILRVPFRTEKGIVRKWISRFEVWPYMETFTEDVAKEIAAELQAKPDLIIGNYSEGNLAASLLAHKLGVTQCTIAHALEKTKYPDSDIYLKKFDEKYHFSAQFTADLTAMNHTDFIITSTFQEIAGSKDTVGQYESHMAFTMPGLYRVVHGIDVFDPKFNIVSPGADMNLYFPYFEKEKRLTAYHPEIEELLFSDVENDEHMCVLKDRNKPIIFTMARLDRVKNLTGLVELYAKNPRLRELVNLVVVGGDRRKESKDLEEQAEMKKMYELIKTHNLNGQFRWISSQMNRVRNGELYRYIADTRGAFVQPAFYEAFGLTVVEAMTCGLPTFATNHGGPAEIIVHG

SEQ ID NO: 12326 - protein, 300 aa, Nicotiana tabacum
LCGPISGMIVQPVVGYYSDNCSSRFGRRRPFIAAGAALVTIAVFLIGFAADLGHASGDPLGKGSKPRAIAVFVVGFWILDVANNMLQGPCRALLADLSGGKAGRMRTSNAFFSFFMAVGNVLGYAAGSYSRLYKIFPFSKTPACDIYCANLKSCFFIAVFLLLSLTILALTVVRENELPEKDEHEIDEKAGGGGKSKVPFFGEIFGALKDLPRPMWILLLVTCLNWIAWFPFFLYVTDWMAKEVYGGKVGDGRLYDLGVHAGALGLLLNSVVLGFMSLSVEFLGKKIGGVKRLWGILNFV

SEQ ID NO: 12327 - protein, 376 aa, Nicotiana tabacum
GLGTTMGCTGPKSVIEVRNGLTFLDLIVKQIEALNAKYGCTVPLLLMNSFNTHDDTLKIVEKYANSNIEIHTFNQSQYPRLVTEDFSPLPCKGNSGKDGWYPPGHGDVFPALANSGKLDALLAKGKEYVFVANSDNLGAIVDLKILNHLIQNKNEYCMEVTPKTLADVKGGTLISYQGKVQLLEIAQVPDEHVNEFKSIEKFKIFNTNNLWVNLNAIKRLVEADALKMEIIPNPKEVDGVKVLQLETAAGAAIKFFDRAIGVNVPRSRFLPVKATSDLLLVQSDLYTLTDEGYVIRNPARSNPSNPAIELGPEFKKVANFLGRFKSIPSIIDLDSLKVTGDVWFGSGVTLKGKVTVAAKSGVKLEIPDGAVIANKD

SEQ ID NO: 12328 - protein, 361 aa, Escherichia coli
DLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 12329 - protein, 261 aa, Escherichia coli
MGEDASQRKTEVAALRAGIELGLTLIDTAEMYADGGAEKVVGEALTGLREKVFLVSKVYPWNAGGQKAINACEASLRRLNTDYLDLYLLHWSGSFAFEETVAAMEKLIAQGKIRRWGVSNLDYADMQELWQLPGGNQCATNQVLYHLGSRGIEYDLLPWCQQQQMPVMAYSPLAQAGRLRNGLLKNAVVNEIAHAHNISAAQVLLAWVISHQGVMAIPKAATIAHVQQNAAVLEVELSSAELAMLDKAYPAPKGKTALDMV

SEQ ID NO: 12330 - protein, 449 aa, Yarrowia lipolytica
MAPHILGPEPVQADSSFLGTRPCPTLSYPASFVDEVSASIDQGLSESEKLIANAMKTRIEAIDLETCSPGSEDSFFVADLGIVYSQFMRWSNCLPRVTPFYAMKCNGDPKVLQLLAALGTGFDCASRNEIQTILDLGVSQDRIIYAHPCKVASYIRYASSVGVEKMVFDNAEELYKCAKYHPTAKLFLRIVTDDSQSLCQFSVKYGAALENTQSLLQLAKDLGLNVAGVSFHVGSGAGDPNAFLDAVRNAKRVFDQGAAIGMHLNTLDVGGGFSDDSFESSAAVLGDALDKYFPEESGVNLMAEPGRFFVSEAFTIASHVIARRIIENQNKAMLYLNDGVYGNMNCILFDHQEPVPKVLTYQGKFMYGERYQKQKSSQDVSVWGPTCDGIDCISKSCQLPVLLDVGDWMYFTSFGAYTVAASTTFNGFNSDCETLYVCSKKEVEQYIKL

SEQ ID NO: 12331 - protein, 187 aa, Scenedesmus vacuolatus
AGGIAEMAGMGEDIRERTDALDAAGNTTAAIGKGFAIGSAALVSLALFGAYITRAKIDLIQSSILDPKVFAGLLVGAMLPYWFSAMTMKSVGKAALAMVEEVRRQFNTINGLMEGTARPDYSRCVKISTDSSLREMIAPGALVMLSPIIVGMLFGTRTLAGMLAGGLVSGVQMAVSMSNTGGAWDNA

SEQ ID NO: 12332 - protein, 189 aa, Tetrahymena pyriformis
AGGIAEMCEFGKAIRERTDQLDAAGNTTAAIGKGFAIGSAALVSLSLYGAFITRSSDPNNVHAINAETGVNINNPLIFSGLLIGAMLPYAFSALTMKSVATAAESMVNEVVQQLDNNPGILTGAVQPDYKRCIVIATDASIYEMFLPAIIVIGTPFAIGILFGPTAVAGVLPGILVSGVSMAISSASAG

SEQ ID NO: 12333 - protein, 246 aa, Lycopersicon esculentum
MGRGRVELKRIENKINRQVTFAKRRNGLLKKAYELSVLCDAEVALLVFSNRGKLYEFCSTNNMLKTLDRYQKCSYGTLEVNRSIKDNEQSSYREYLKLKAKYESLQRYQRHLLGDELGPLTIDDLEHLEVQLDTSLKHIRSTRTQMMLDQLSDLQTKEKLWNEANKVLERKMEEIYAENNMQQAWGGGEQSLNYGQQQHPQSQGFFQPLECNSSLQIGYDPITTSSQITAVTNAQNVNGMIPGWML

SEQ ID NO: 12334 - protein, 361 aa, Arabidopsis thaliana
MGTSTTESVVACEFCGERTAVLFCRADTAKLCLPCDQHVHSANLLSRKHVRSQICDNCSKEPVSVRCFTDNLVLCQECDWDVHGSCSSSATHERSAVEGFSGCPSVLELAAVWGIDLKGKKKEDDEDELTKNFGMGLDSWGSGSNIVQELIVPYDVSCKKQSFSFGRSKQVVFEQLELLKRGFVEGEGEIMVPEGINGGGSISQPSPTTSFTSLLMSQSLCGNGMQWNATNHSTGQNTQIWDFNLGQSRNPDEPSPVETKGSTFTFNNVTHLKNDTRTTNMNAFKESYQGQETSKSNNIPAAIHSHKSSNDSCGLHCTEHIAITSNRATRLVAVTNADLEQMAQNRDNAMQRYKEKKKTRR

SEQ ID NO: 12335 - protein, 152 aa, Casuarina glauca
MALTERQEALLKQSWEVLKQNIPGHSLRLFALIIEAAPESKYVFSFLKDSNEIPENNPKLKAHAAVIFKTICESATELRQKGQAVWDNNTLKRLGSIHLKNKITDPHFEVMKGALLGTIKEAVKENWSDEMGCAWTEAYNQLVATIKAEMKE

SEQ ID NO: 12336 - protein, 351 aa, Arabidopsis thaliana
MGFGLESIKSISGGWGAAARSCDACKSVTAAVFCRVDSAFLCIACDTRIHSFTRHERVWVCEVCEQAPAAVTCKADAAALCVSCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 12337 - protein, 337 aa, Arabidopsis thaliana
MEPKCDHCATSQALIYCKSDLAKLCLNCDVHVHSANPLSHRHIRSLICEKCFSQPAAIRCLDEKVSYCQGCHWHESNCSELGHRVQSLNPFSGCPSPTDFNRMWSSILEPPVSGLLSPFVGSFPLNDLNNTMFDTAYSMVPHNISYTQNFSDNLSFFSTESKGYPDMVLKLEEGEEDLCEGLNLDDAPLNFDVGDDIIGCSSEVHIEPDHTASPPGQQMNINTGLQLPLSPVLFGQIHPSLNITGENNAADYQDCGMSPGFIMSEAPWETNFEVSCPQARNEAKLRYKEKKLKRSFGKQIRYASRKARADTRKRVKGRFVKAGDSYDYDPSSPTTNN

SEQ ID NO: 12338 - protein, 406 aa, Mus musculus
MTLDVGPEDELPDWAAAKEFYQKYDPKDIIGRGVSSVVRRCVHRATGDEFAVKIMEVSAERLSLEQLEEVRDATRREMHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEAGEKLRELCGTPGYLAPEILKCSMDETHPGYGKEVDLWACGVILFTLLAGSPPFWHRRQILMLRMIMEGQYQFTSPEWDDCSNTVKDLISKLLQVDPEARLTAEQALQHPFFERCEGSQPWNLTPRQRFRVAVWTILAAGRVALSSHRLRPLTKNALLRDPYALRPVRRLIDNCAFRLYGHWVKKGEQQNRAALFQHQPPRLFPIAATELEGDSGAITEDEATLVRS

SEQ ID NO: 12339 - protein, 152 aa, Casuarina glauca
MALTEKQEALLKQSWEVLKQNIPAHSLRLFALIIEAAPESKYVFSFLKDSNEIPENNPKLKAHAAVIFKTICESATELRQKGHAVWDNNTLKRLGSIHLKNKITDPHFEVMKGALLGTIKEAIKENWSDEMGQAWTEAYNQLVATIKAEMKE

SEQ ID NO: 12340 - protein, 949 aa, Escherichia coli
MKYLASFRTTLKASRYMFRALALVLWLLIAFSSVFYIVNALHQRESEIRQEFNLSSDQAQRFIQRTSDVMKELKYIAENRLSAENGVLSPRGRETQADVPAFEPLFADSDCSAMSNTWRGSLESLAWFMRYWRDNFSAAYDLNRVFLIGSDNLCMANFGLRDMPVERDTALKALHERINKYRNAPQDDSGSNLYWISEGPRPGVGYFYALTPVYLANRLQALLGVEQTIRMENFFLPGTLPMGVTILDENGHTLISLTGPESKIKGDPRWMQERSWFGYTEGFRELVLKKNLPPSSLSIVYSVPVDKVLERIRMLILNAILLNVLAGAALFTLARMYERRIFIPAESDALRLEEHEQFNRKIVASAPVGICILRTADGVNILSNELAHTYLNMLTHEDRQRLTQIICGQQVNFVDVLTSNNTNLQISFVHSRYRNENVAICVLVDVSSRVKMEESLQEMAQAAEQASQSKSMFLATVSHELRTPLYGIIGNLDLLQTKELPKGVDRLVTAMNNSSSLLLKIISDILDFSKIESEQLKIEPREFSPREVMNHITANYLPLVVRKQLGLYCFIEPDVPVALNGDPMRLQQVISNLLSNAIKFTDTGCIVLHVRADGDYLSIRVRDTGVGIPAKEVVRLFDPFFQVGTGVQRNFQGTGLGLAICEKLISMMDGDISVDSEPGMGSQFTVRIPLYGAQYPQKKGVEGLSGKRCWLAVRNASLCQFLETSLQRSGIVVTTYEGQEPTPEDVLITDEVVSKKWQGRAVVTFCRRHIGIPLEKAPGEWVHSVAAPHELPALLARIYLIEMESDDPANALPSTDKAVSDNDDMMILVVDDHPINRRLLADQLGSLGYQCKTANDGVDALNVLSKNHIDIVLSDVNMPNMDGYRLTQRIRQLGLTLPVIGVTANALAEEKQRCLESGMDSCLSKPVTLDVIKQTLTLYAERVRKSRDS

SEQ ID NO: 12341 - protein, 1175 aa, Homo sapiens
MAKPYEFNWQKEVPSFLQEGAVFDRYEEESFVFEPNCLFKVDEFGFFLTWRSEGKEGQVLECSLINSIRSGAIPKDPKILAALEAVGKSENDLEGRIVCVCSGTDLVNISFTYMVAENPEVTKQWVEGLRSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQAKEMQQMVKLEAEMDRRPATVV

SEQ ID NO: 12342 - protein, 446 aa, Oryza sativa (indica cultivar-group); identical to SEQ ID NO: 3316

SEQ ID NO: 12343 - protein, 413 aa, Homo sapiens
MSDKLPYKVAAWGRKALDIAENKMPGLMRIWERYSASKPLNGARIPGCLHRTVETAVLMSLITLGTEVQWSSCNIFSTQDHAAAAIAKAGISASTGIPVLPLPRLACLEGRNRRGVPVTGDLTNLIHSEYSQLLLSFRGISKETTIGVHNLYKMMVNGILKVPAIDVNDSATKSKFDNLYGCGIKQATDVMIAGKVAVVAGYGDKGKSCAQALRGFRASVIITKTDPIKALQAAMEGYEVTTMDEACQEGDVFVTTTGCVDIILGQHFEQTKDDTIVCNTGYFDVEMDVKWLNKNTVEKVNVKLQVDPYRLKNGRGIILLAEGRLVNLACAMGHPSFVRSNSFTSQVMAQIKLWTHPDKYPVGVHFLPKKLDESVAEAHLGKLNMKLTKLTEKQAQYLGMSCYCPFKPDHYRY

SEQ ID NO: 12344 - protein, 502 aa, Alonsoa meridionalis
MEVGNEAKSTALPPAQAAPVKNIIVVAAIAAGVQFGWALQLSLLTPYVQLLGVPHVWAAFIWLCGPISGLLVQPIVGYYSDNCTSRFGRRRPFIAAGAGLVAVAVFLIGFAADLGHMGGDSLGKGTKPRAVAVFVVGFWILDVANNMLQGPCRALLADMSAGNAKKMSSANSMFSFFMAVGNVLGYAAGSYTRLYKVFPFSKTEACAVYCANLKSCFFISVALLLTVTIIALCIVRETPYTAPPEEAGTVKKHTVPVFGELFGALKDLPRPMWMLLLVTALNWVAWFPFLLFDTDWMGKEVYGGKVGEGSLYDKGVRVGALGLMLNSVVLGVASLGVQVTARGLGGVKRLWGSVNLLLAICLAMTVLITKMAQHHREYASVGGAAPTLQPPVHGVKIGALALFSVLGIPLAATFSIPFALASIYSSNSGAGQGLSLGVLNLAIVIPQMFVSVASGPWDALFGGGNLPAFVVGAVAATVSGIIALTALPSPPSDVKILATGGH

SEQ ID NO: 12345 - protein, 222 aa, Homo sapiens [sequence omitted]

SEQ ID NO: 12346 - protein, 717 aa, Homo sapiens
MASSSDSEDDSFMAVDQEETVLEGTMDQDEEPHPVLEAEETRHNRSMSELPEEVLEYILSFLSPYQEHKTAALVCKQWYRLIKGVAHQCYHGFMKAVQEGNIQWESRTYPYPGTPITQRFSHSACYYDANQSMYVFGGCTQSSCNAAFNDLWRLDLNSKEWIRPLASGSYPSPKAGATLVVYKDLLVLFGGWTRPSPYPLHQPERFFDEIHTYSPSKNWWNCIVTTHGPPPMAGHSSCVIDDKMIVFGGSLGSRQMSNDVWVLDLEQWAWSKPNISGPSPHPRGGQSQIVIDDATILILGGCGGPNALFKDAWLLHMHSGPWAWQPLKVENEEHGAPELWCHPACRVGQCVVVFSQAPSGRAPLSPSLNSRPSPISATPPALVPETREYRSQSPVRSMDEAPCVNGRWGTLRPRAQRQTPSGSREGSLSPARGDGSPILNGGSLSPGTAAVGGSSLDSPVQAISPSTPSAPEGYDLKIGLSLAPRRGSLPDQKDLRLGSIDLNWDLKPASSSNPMDGMDNRTVGGSMRHPPEQTNGVHTPPHVASALAGAVSPGALRRSLEAIKAMSSKGPSASAALSPPLGSSPGSPGSQSLSSGETVPIPRPGPAQGDGHSLPPIARRLGHHPPQSLNVGKPLYQSMNCKPMQMYVLDIKDTKEKGRVKWKVFNSSSVVGPPETSLHTVVQGRGELIIFGGLMDKKQNVKYYPKTNALYFVRAKR

SEQ ID NO: 12347 - protein, 366 aa, Homo sapiens
MAGPRRVLGPHLLPTTSLSQENMIGGEREASKLTGEYHLGKRKSQQDDSKMAGNYVLWARVTVLASNILSREDEQKKLEKIGEGTYGTVFKAKNWETHEIVALKWVRLDDNDDGVPSSALREICLLKELKHKNIVRLHDLLHSDKKLTLVFKFCHQHLKKYFDSCNGDLDPEIVKSFLFQLLKGLGFCHSRNVLRRDLKPQNLLINRNGELKLADFGLSRAFGIPICYVFFGAKLYSTSIDLWSAGCIFAELANAGWPLFPGNDVDDQLKRIFWLLGMLTKEQWPSMTKLPDYKLYPLYPATTSLVNIVPKLSATGRDLLQNLLKCNPCQCISAEEALQYPYFSDFCPPWAQGPPATRLGPGLFKP

SEQ ID NO: 12348 - protein, 1079 aa, Homo sapiens
MDLGIGLSKRIQNETEAEFSKALAFSARAAMVLAKTILCEHCTQDLNYFAHFETIDLSQATVAESSCRNLCHSFCVITPQRKITLAAPNRKDMEEWINIIKTIQQGEIYKIPAAENNPFLVGMHCWYSSYSHRTQHCNVCRESIPALSRDAIICEVCKVKSHRLCALRASKDCKWNTLSITDDLLLPADEVNMPHQWVEGNMPVSSQCAVCHESCGSYQRLQDFRCLWCNSTVHDDCRRRFSKECCFRSHRSSVIPPTALSDPKGDGQLVVSSDFWNLDWSSACSCPLLIFINSKSGDHQGIVFLRKFKQYLNPSQVFDLLKGGPEAGLSMFKNFARFRILVCGGDGSVSWVLSLIDAFGLHEKCQLAVIPLGTGNDLARVLGWGAFWNKSKSPLDILNRVEQASVRILDRWSVMIRETPRQTPLLKGQVEMDVPRFEAAAIQHLESAATELNKILKAKYPTEMIIATRFLCSAVEDFVVDIVKAWGQIKQNNTAIVSVILKSDLMYDRLSVLIDVLAEEAAATSAEKSATEYADSSKADRKPFIPQIDHIAKCKLELATKAQSLQKSLKLIIFQVEQALDEESRQTISVKNFSSTFFLEDDPEDINQTSPRRRSRRGTLSSISSLKSEDLDNLNLDHLHFTPESIRFKEKCVMNNYFGIGLDAKISLDFNTRRDEHPGQYNSRLKNKMWYGLLGTKELLQRSYRKLEERVHLECDGETISLPNLQGIVVLNITSYAGGINFWGSNTATTEYEAPAIDDGKLEVVAIFGSVQMAMSRIINLHHHRIAQCHEVMITIDGEEGIPVQDFENSMKMWEYKHTEIQAAPQPQLDFQDSQESLSDEEYAQMQHLARLAENLISKLNDLSKIHQHVSVLMGSVNASANILNDIFYGQDSGNEMGAASCIPIETLSRNDAVDVTFSLKGLYDDTTAFLDEKLLRSAEDETALQSALDAMNKEFKKLSEIDWMNPIFVPEEKSSDTDSRSLRLKIKFPKLGKKKVEEERKPKSGQSVQSFIAWLPPRDLKPPLEMFVGMVMMKREAIWESAVSDTKPYLGQGNLWHRRHREDEAEGDDPLTPSRSQL

SEQ ID NO: 12349 - protein, 133 aa, Homo sapiens
MKSLTEKEGELSNEERNRLSVPYKNVVGVWILDQSQQAYQEACEITKKEMQPTDPIRLGMALNFSVFYYELLNSPEKSHSLVKAAFDEALAELDTLSEESYKDRLLMQLLRDNLTLWTLDTQGDETEARGRKS

SEQ ID NO: 12350 - protein, 118 aa, Homo sapiens
MPVTRPLQKLVLLQTQEKLEELMQFLIPSASQAESKVFYLKMKGDYYGYLSEVAAGDHKKGIVDQSQQAYQEAFGISKKEMQRAHPIRLGLALNYSVFYYEILNSPRESLLSCKDSCQ

SEQ ID NO: 12351 - protein, 848 aa, Arabidopsis thaliana
MSNWKTLLLRIGEKGPEYGTSSDYKDHIETCFGVIRREIERSGDQVLPFLLQCAEQLPHKIPLYGTLIGLLNLENEDFVQKLVESVHANFQVALDSGNCNSIRILLRFMTSLLCSKVIQPASLIVVFETLLSSAATTVDEEKGNPSWQPQADFYVICILSSLPWGGSELAEQVPDEIERVLVGIQAYLSIRKNSSTSGLNFFHNGEFESSLAEKDFVEDLLDRIQSLASNGWKLESVPRPHLSFEAQLVAGKFHELRPIKCMEQPSPPSDHSRAYSGKQKHDALTRYPQRIRRLNIFPANKMEDVQPIDRFVVEEYLLDVLFYLNGCRKECASYMANLPVTFRYEYLMAETLFSQILLLPQPPFKTLYYTLVIMDLCKALPGAFPAVVAGAVRALFEKISDLDMESRTRLILWFSHHLSNFQFIWPWEEWAFVLDLPKWAPKRVFVQEILQREVRLSYWDKIKQSIENATALEELLPPKAGPNFMYSLEEGKEKTEEQQLSAELSRKVKEKQTARDMIVWIEETIYPVHGFEVTLTIVVQTLLDIGSKSFTHLVTVLERYGQVFSKLCPDNDKQVMLLSQVSTYWKNNVQMTAVAIDRMMGYRLVSNQAIVRWVFSPENVDQFHMSDQPWEILGNALNKTYNRISDLRKDISNITKNVLVAEKASANARVELEAAESKLSLVEGEPVLGENPAKMKRLKSTVEKTGEAELSLRESLEAKEALLNRALSETEVLLLLLFQSFLGVLKERLPDPTKVRSVQDLKSIGAEDDKPSAMDVDSENGNPKKSCEVGEREQWCLSTLGYLTAFTRQYASEIWPHMEKLESEVFSGEDVHPLFLQAISSALQFPLH

SEQ ID NO: 12352 - protein, 354 aa, Halocynthia roretzi
MGCAVSSEDKAAQERSKAIDRNLKMDGEKASREVKLLLLGAGESGKSTIVKQMKIIHEDGYSEDECIQYKAVVYSNTLQSLITIVRAMGNLKIDFGHPDRADDARQLFSLASSLEDGEMTSELGDCMKRLWNDKGVQVCFSRSREYQLNDSAQYYLDALDRLVQQDYIPSEQDVLRSRVKTTGIVETHFEFKDLHFKMFDVGGQRSERKKWIHCFEGVTAIIFCVALSAYDLVLAEDEEMNRMHESMKLFDSICNNKWFTDTSIILFLNKKDLFEQKISKSSLTICFPEYTGANTYEEAAAYIQLKFEDLNKRKDTKEIYTHFTCATDTNNIQFVFDAVTDVIIKNNLKDCGLF

SEQ ID NO: 12353 - protein, 360 aa, Halocynthia roretzi
MLEIMEFCCKSEEQREAKRINAEIERELRRHKRDARRELKLLLLGTGESGKSTFIKQMRIIHGKGYSDNDRREFCKLVHQNILTSMQNMIRAMETLHIQYSDPQNEQNSYDFLELDVERVAEQNGFPEYCTAIEALWTDKGIHDCYDRRREYQLSDSTSYYLNSLDRIRMPDYLPTEQDVLRVRVPTTGISEYPFDLDSIIFRMVDVGGQRSERRKWIHCFENVTSIMFLVALSEYDQVLVESNNENRMEESKALFRTIIMYPWFQNSSVILFLNKKDLLEEKIMYSHLADYFSDYDGPTQDANAAREFILSRFVELNPDADKIVYSHFTCATDTENIRFVFAAVKDTILQCNLREYNLV

SEQ ID NO: 12354 - protein, 469 aa, Halocynthia roretzi
MSSLVSCFLGNDRTAAKEISKRIEQQIKDDKKIARTQVKLLVLGTSESGKSTFLKQMRIIHGTGYTADEKRSFIGLICQNVHTSMKILLQSMKNLNIEYDLEENSNIAMALDDGERDESRLPKSLALDFMKLWNDGGIQQCYARRNEFQLSDSTLYFMSNLDQISEEDYIPSLQDILRSRMPTTGIREYQFTIGNFVFGIVDVGGQKSERRKWIHCFENVTSIIFLARLSEYDLTIPLEEVSQDLRASLRHRQQRALQSRGKTVKGGLNYSGSGSAMNNGLAELDLSNGNNPHSTQRKLRTRPSNKKNFVATEFPRTPVIPRMSSKNSPDQNGNTRKHDSSSRQDEAYARSHINRMKESRALFKTIISCEYFINTSVILFLNKKDILAEKIHTSHLVDHFPEFDGPRADAESARAFILTKYADCFERSERQREICTPIHVSTDTRNIRYVFAAVKDIILKNYLVTYNLV

SEQ ID NO: 12355 - protein, 382 aa, Halocynthia roretzi
MLMACFCSQPGGSNAEDLNNQKRINREINDILQKDKQEYRSTHRLLLLGAGESGKSTIVKQMRILHVNGFNDEEKKHKILDIKKNIRDAMVSVIGAMKNLTPPVKLQLPDNEPSVDYILSVSVNFKEEEDFNEGFFDKVLNLWIDEGVQQCFQRSNEYQLIDCAKYFLDKVHDIRNSNYSPSNQDLLRCRVLTRGIFETKFNVDRVKFHMFDVGGQRDERRKWIHCFNEVTAIIFVVASSSYDMVLREDPSQNRLKEALDLFKNIWNNRWLRTISVILFLNKQDLLTEKVLAGRSVLEHYFPDFGPYRIPHDATPDENEEPRVTRAKYFIRDEFLRLSQTGDGRHYCYPHFTCAVDTENIRRVFNDCRDIIQRMHLRQYELL

SEQ ID NO: 12356 - protein, 285 aa, Halocynthia roretzi
AKIYAMHWGTDSRNLVSASQDGKLIVWDSYTTNKVHAIPLRSSWVMTCAYAPSGSFVACGGLDNICSIYSLKTREGNVKVSRELPGHTGYLSCCRFLDDSRIVTSSGDMSCALWIIETGQQTTAYIGHTGDVMSLSVSEDKNTFISGACDASAKLWDIRDGMCCQTFIGHESDINAVSFFPNNMAFGTGSDDATCRLFDIRADQELIVYQHDNIICGITSVSFSKSGRLLLAGYDDFNCNVWDSMKGDRAGVLAGHDNRVSCLGITSDGMAVATGSWDSFLKVWN

SEQ ID NO: 12357 - protein, 356 aa, Takifugu rubripes
MIWNLASKARAFRFVGHQDIITGVHFSPSGNLVATSSKDRTVRLWKPSIKGESKVIKAHTAAVRSVAFSHDGQRLATASDDKSVKVWSVPRHCFLYSLNQHTNWVCCARFSPDARLIASCGDDRTVRLWDTSSKHCINCFTDYGGSATSVDFNPSGTCIASSGSDSSLRIWDLRTNKLIQHYQGSNFMITGSSDSTVKILDLLEGRLMYTLHGHKGPVFTVAFSRGGDLFASGGADAQVLMWRTNFDTKPYLSVLQQHSHRATVDPPPHTGAGFRGSPEEQQQEDLSSYPPCLDTTLQHIVRQLDILTQTVSVLEERLTLTEDKLKECLQHQSQIIKEIGQPGPRRRTANEGHLSG

SEQ ID NO: 12358 - protein, 232 aa, Schizosaccharomyces pombe
ISRNIVLKTPFMSSPMDTVTEDQMAIYMALLGGIGVIHHNCTPEEQAAMVRKVKKYENGFILDPVVFSPQHTVGDVLKIKETKGFSGIPITENGKLRGKLVGIVTSRDVQFHKDTNTPVTEVMTPREELITTAEGISLERANEMLRKSKKGKLPVVDKDDNLVALLSLTDLMKNLHFPLASKTSDTKQLMVGAAIGTRDDDPTRLALLAEAGLDAVVIDSSQGNSCFQIEMI

SEQ ID NO: 12359 - protein, 363 aa, Schizosaccharomyces pombe
FVADLNGVYRQLLRWHAKLPRVQPFYAVKCNPDPKVLALLNKFGTGLDCASKGELEQILGLGVSPDRIVYANPCKAITYVRYAASKGINLMTFDNADELYKVKQHHPNSRLLLRISTDDSNSLCRLSLKFGASLDDTGKLLDIAKSLELNVVGVSFHVGSGSYDPSAFLDAIQRSRQVFDQGLERGFNFDLLDIGGGFMNDSFDGVADLIRSALDTYFDPSIRVISEPGRFFVSSSFTLAVNVIAKRKLDDEEKVMYYVNDGVYGSLNCILFDHQHPVARVLKCGSRFVYNDLVGTGQHRCFIWGPTCDSLDVIANDAHLPYEPNVGDWIYFEDAGAYTVAAASCFNGFKTSRIVYLDTDILD

SEQ ID NO: 12360 - protein, 378 aa, Schizosaccharomyces pombe
MSFEGKTITCKAAVAWGAKEPLSIEDIQVAPPKAHEVRVKVDWSAVCHTDAYTLSGVDPEGAFPIVLGHEGAGIVESIGEGVINVRPGDHVILLYTPECKECKFCRSGKTNLCSKIRETQGRGLMPVGTSRFSCRDKTLLHYMGCSSFSQYTVVADISLVAISHSAPLRSICLLGCGVTTGFGAVTHSAKVESGSTVAVVGCGCVSLAAMQGAVAAGASRIIAIDINADKEVYAKKFGATDFIDSSKVKDLVQYVIDVTDGGVDYAFDCTGNVTVMQQELQFCHKGWGKLCVIGVAAAGKTLDFRPFLVVTGRQVLGSAFGGVKGRSELPNFVDEYMQGHFKVDEYITNEEPLKNINKAFDHMHEGKCIRCVVDMNKP

SEQ ID NO: 12361 - protein, 360 aa, Caenorhabditis elegans
MPPIPSRARVYAEVNPSRPREYWDYEAHMIEWGQIDDYQLVRKLGRGKYSEVFEGFKMSTDEKVVVKILKPVKKKKIKREIKILENLRGGTNIITLLDVVKDPISRTPALIFEHVNNSDFKQLYQTLSDYDIRYYLYELLKALDFCHSQGIMHRDVKPHNVMIDAEKRELRLIDWGLAEFYHPRQDYNVRVASRYFKGPELLVDYQCYDYSLDMWSLGCMLASMIFRKEPFFHGHDNYDQLVRIAKVLGTDELYEYIARYHIDLDPRFNDILGRHSRKRWERFIHAENQHLVTPEALDFLDKLLRYDHAERLTAQEAMGHEYFRPVVEAHARANGTEQADGQGASNSASSQSSDAKIDGA

SEQ ID NO: 12362 - protein, 524 aa, Caenorhabditis elegans
MAGRKSSRTAERVPTTQKPERKSAILSPHDELRERLLETAIDMKENIPQRNTRNSSVGSQKSDCSETRKRRSTKEGPAAKRHSGEKHRNGSREDSLEYISEYSDDREVGSSSSQSSRTRGQPLPAMPEEEEVFDKSSSSDNLAESEESHEMVRLEERQDIEEEIEDDFDDEEEDVVNDKEEYEEIESEDEDDYPVQNEGFAVTKRLMNDEHMVTAPTFLSTAKCDGIGSPTKVWSLMVKRDEIPRATRFLLGNHPDMDDEKRRILIDWMMEVCESEKLHRETFHLAVDYVDRYLESSNVECSTDNFQLVGTAALFIAAKYEEIYPPKCIDFAHLTDSAFTCDNIRTMEVLIVKYIGWSLGPITSIQWLSTYLQLLGTGKKNKSDHYEEQNMYVPELLRSEYLEMCKILDFLLFEIDSFTFSYRTIAAAVLFVNYEPTCAVEKATGFMQAQLEKVIEYVEPVCRAFAKQRQLLDDVIPKHESIKSDDSHNIQVYVKRSSMEPIVKSERERIQHLKARRLHPQRLF

SEQ ID NO: 12363 - protein, 113 aa, Caenorhabditis elegans
MAAQVVPVLSKLFDDYQKTTSSKLKIIDAYMTYILFTGIFQFIYCLLVGTFPFNSFLSGFISTVTSFVLASCLRMQVNQENRSEFTAVSTERAFADFIFANLILHLVVVNFLG

SEQ ID NO: 12364 - protein, 437 aa, Caenorhabditis elegans
MAQSKPAYKVADIKLADFGRKEIILAENEMPGLMAMRSKYGPSQPLKGARIAGCLHMTIQTAVLIETLTALGAEVQWSSCNIFSTQDHAAAAIAQTGVPVYAWKGETDEEYEWCIEQTIVFKDGQPLNMILDDGGDLTNLVHAKYPQYLAGIRGLSEETTTGVHNLAKMLAKGDLKVPAINVNDSVTKSKFDNLYGIRESLPDGIKRATDVMLAGKVAVVAGYGDVGKGSAASLKAFGSRVIVTEIDPINALQAAMEGYEVTTLEEAAPKANIIVTTTGCKDIVTGKHFELLPNDAIVCNVGHFDCEIDVKWLNTNATKKDTIKPQVDRYTLKNGRHVILLAEGRLVNLGCATGHPSFVMSNSFTNQVLAQVELWTKFGTPQEYKLGLYVLPKTLDEEVAYLHLAQLGVKLTKLSDEQASYLGVPVAGPYKPDHYRY

SEQ ID NO: 12365 - protein, 312 aa, Caenorhabditis elegans
MVREDRSTWKANYFTKLVELFEEYPKCLLVGVDNVGSKQMQEIRQAMRGHAEILMGKNTMIRKALRGHLGKNPSLEKLLPHIVENVGFVFTKEDLGEIRSKLLENRKGAPAKAGAIAPCDVKLPPQNTGMGPEKTSFFQALQIPTKIARGTIEILNDVHLIKEGDKVGASESALLNMLGVTPFSYGLVVRQVYDDGTLYTPEVLDMTTEELRKRFLSGVRNVASVSLAVNYPTLASVAHSLANGLQNMLGVAAVTDVSFKEAETIKAFIADPSKFAAAAPAAAAAPAAAAPAAKKEEPKEESDDDMGFGLFD

SEQ ID NO: 12366 - protein, 154 aa, Caenorhabditis elegans
MVFDPRTLDNPKEISAYRDQRYQGTVRDQETALRTSCTLYVGNLSYYTKEDQVYELFGRAGDVRRVIMGLDRFKKTPCGFCFVEYYTREDAELALQNISNTRMDDRVIRADWDAGFIEGRQYGRGKHGGQVRDEYRKDYDPERGGYNRAIAQKG

SEQ ID NO: 12367 - protein, 163 aa, Caenorhabditis elegans
MESVESEKTRFEVECEFVQALANPNYLNFLAQRGYFKEEYFVNYLKYLLYWKDPQYARCLKFPQCLHMLEALQSQQFRDSMAYGPSAKFVEDQVVLQWQFYLRKRHRLCMMPDEGQELEESEDEADIRQKDTEDEDDEETMKKPDADTAEKNSTTSTVSKKEK

SEQ ID NO: 12368 - protein, 133 aa, Caenorhabditis elegans
MGPHRLLYQALCKAGDKFVYPVLPAFAKPAWNHAAGPKTVFFWAPTIKWTLIGAGLADLARPADKLSLYQNSALFATGAIWTRYCLVITPINYYLSSVNFFVMCTGLAQLCRIAHYRYQNPDWETKEIMETHN

SEQ ID NO: 12369 - protein, 354 aa, Caenorhabditis elegans
MGCTMSQEERAALERSRMIEKNLKEDGMQAAKDIKLLLLGAGESGKSTIVKQMKIIHESGFTAEDYKQYKPVVYSNTVQSLVAILRAMSNLGVSFGSADREVDAKLVMDVVARMEDTEPFSEELLSSMKRLWGDAGVQDCFSRSNEYQLNDSAKYFLDDLERLGEAIYQPTEQDILRTRVKTTGIVEVHFTFKNLNFKLFDVGGQRSERKKWIHCFEDVTAIIFCVAMSEYDQVLHEDETTNRMHESLKLFDSICNNKWFTDTSIILFLNKKDLFEEKIKKSPLTICFPEYSGRQDYHEASAYIQAQFEAKNKSANKEIYCHMTCATDTTNIQFVFDAVTDVIIANNLRGCGLY

SEQ ID NO: 12370 - protein, 356 aa, Caenorhabditis elegans
MGSTCSTPESKEQKRINSVIDKQIRKDEDDEIGNQKLLLLGTGECGKSTILKQINILHSSGFSKADLKNVAGTVYSNIIQGVATLLKAKDHFYYELSTPELDADAQHILSLADSSKDAMPFIPLTFNAIKRLWHDPVVQKTFERRAEFQMMDTLVYFMNELDRINNADYIPTVDDMLRIRIPTMGVVQQTIEIKGTKFRIYDVGGQRSERRKWIHLFDNVNATIFISAINEFNQKLNEDGQTNRMKESIKLFETICNSRWFVQAAMILFLNKRDLFEQKLKTTSINVLFSTYQGSNDYAECVAYIQMRFERLNKYSDIKKIYTHVTCATDTNQIQLVIDSVVDMVIGRNLRGTGME

SEQ ID NO: 12371 - protein, 339 aa, Caenorhabditis elegans
MLRATTSIRKITKNLEKRSSVKNQHENGSSTPVNTEGLAVGPRTKLEEEFNCMAEDIYNYLVHHEKKYVLDDSFINGGNVNSKMRRILVDWLVQVHLRFHLTPETLHLTIFVLDRIIVKNIVSKAEFQLLGVAALFVASKFEDIYLPDILEYELITENTFSKKQILAMEQTILNALNFDLSCPSSLVFLRYISKTLTENDVNPIDKETFYYVHNISKCLGELALLDSVMSTVPRSHVASASMIITLNIISVDGINPKTAASMIRKQFGASKQDIYDAISLLAQVAYKNFRHQKLCAIREKYQSSKFGRVSYLMTDEILEKIHRMGRNLEASEAETSEME

SEQ ID NO: 12372 - protein, 384 aa, Caenorhabditis elegans
MSREIRSLESIISDARENTHEKMLIRKQRDMTTDIAPERDLQGRFCSLRRIGEGTYGVVFKAIHVRDNVKCALKMIRTDRDEEGIPSTCLREISCIKDLQHDNIVTLFDIIYASHFLNYNNIFFEKFSSNSKLYMVFEFIDRDLKNLLEMLEPTNSVLPPNYVKSFMWQLLSALSYCHLRRIVHRDLKPQNILVSDSGVIKIADFGLARNFSFPSRNYTHEVVTLWYRPPEILLGSQRYSTSLDMWSLGCIFSEIASNKPLFPGECEISQLFKIFEIVGTPNIKSWPGVDSFPHYKAVFPQWPVNLKKLEETSCLTGNGLDVLREILRYPPERRLTAKGALSHRYFLQNGFTQNRPSVTDLMKDIRAQNRTPPLLNNHQEKSIF

SEQ ID NO: 12373 - protein, 417 aa, Caenorhabditis elegans
MATLEDGTSEDRVANDEYKIWKKNTPFLYDLVMTHALEWPSLSVQWLPDVAKDNSDHTIHRLILGTHTSDEQNHLLISKICMPTDDAQFDASRYDTERSEYGGFGAVNGKVEPDIRINHEGEVNRARYMPQKSNIIATKSPHADVYIFDYLKHSAVPRDNTFNPLIRLKGHTKEGYGLSWNPNKEGLILSASDDQTVCHWDINANQNVAGELQAKDVFKGHESVVEDVAWHVLHDGVFGSVGDDKKLLIWDVRTSTPGHCIDAHSAEVNCLAFNPYSEFILATGSADKTVALWDLRNLRMKLHSFESHRDEIFQVQWSPHNETILASSGTDKRLHVWDLSKIGEDQSAEDAEDGPPELLFIHGGHTAKISDFSWNPNEPWVVCSVSEDNILQVWQMADNIYNEVDEETPADVVERQQ

SEQ ID NO: 12374 - protein, 341 aa, Caenorhabditis elegans
MASETSQFGIETDSITLQRYVLQEQRKHADASGELTALLTNMLVAIKAIASATQKAGLAKLYGIAGATNVQGEEVKKLDVLSNELMINMLKSSYTTCLLVSEENDELIEVEEQRRGKYIVTFDPLDGSSNIDCLVSIGTIFGIYKKRGDGPATVDDVLKPGKEMVAAGYALYGSATMVVLSTGDGVNGFTLDPSIGEFILTHPNMKCKEKGSIYSLNEGYAQTWSKGFAEYIRTRKYPEAGKKAMGQRYVGSMVADVHRTILNGGIFLYPPTVSAPNGKLRLLYECNPMAYIIEQAGGLATTGKERILDIQPTQIHQRAPIILGSKLDVEEALEYLAKYDN

SEQ ID NO: 12375 - protein, 1435 aa, Caenorhabditis elegans
MTSIALQLLLLLQPYTLTIRRSKMSTKLKQNLEGSFFVVSFSACSPGSKCEISCNITTFRFILYNIAPLFIARKQRQRIGQFAVVRRVRDRKTGEKYAAKFIKKRRYATSRRGVTRQNIEREVRVLQKIRGNSNVVELHAVYETASDVIIVLELVSGGELFDHVCAKECLDEVEAAAFIKQILLAVRHLHSLHIVHLDIKPENVMLKQRGDSQIKIIDFGLSREIEPGAVVKDMVGTPEFVAPEVVNYEALSPATDMWAVGVVTYILLSGGSPFLGDNRDETFSNITRVRYHFSDRYFKNTSKHAKDFIYRLFVRDVDQRATVEECLQHPWIRGPEGNAIDIRKASCITISHIQSFKTRQRWKRCVELVMVLLKASKSSRRIGDGRFDEEDMVASCTLICAEEGNLRALHKLSALHKLLPNATRKSLKSSFSEPNGATAMHCAAKYGHAEVFNYFHMKGGNICARDDNGDTPLHVACRFAQHTVAGYVANEKIDVDSINKTGETALHCAVESADTRVVRLLLQLRPRLDLPNAREETPLHVAAARGHVDCVQALLDANSPIDAVEQDGKTALIIALENGNVDIASILITNGCDINHADHHGDTALHIASKHGLLQAVQTLCHCAVTVDSVNANKKTALHLAAHYGHVDIIRVLLLARADVTLRGDDGLTAELVAVAAERLEAHSLLKMVKSQEIREEYISQLYPLDTSLRRIKLKLLGHSQSGKTRLVQTLHSSRGISSFLESVTRRISDHYSPSSSMKDDGIHSTNGSFVSESNNNSSFDLAAAAGSKYAPPHSQYTRGIDVQTVNINGCGEFSVWEFGGYEPMHTCYDHFVGNADCIHLILYRTSDPTEVQYKQILYWMNFLKGRVTPFEPIGHCGFSSRRSKVIIVGTHATSSLFPQMNQEGEYVSSDIEAMLNTVRLRFETHFDMDHRLILLDATNPSCIGMKTLKMELAKCRTNILAKLLKPLAILDTVVNHLNLVRKKHANFPVITWPDFIQLVRNEINPLTGDAHCRQIVQQLQLIGELVYLRNDLCDADYVVLNAEWFGTHILGQLLSAEFLSKASPNGSYHTSSLAKIFPEIPEQSDLMTILEVLQLCAPDARTGAHEFPVFIQTEAPDSIWRPYSLKEKERDTVYGGVRILPMRGMERSLHSTFPRIQVALRRSINDYQPAKDTQLHQWSECSKLVSQDREAVIRMVGDAVEIRARGPSESATSMFYFMEDLINLVEHAAAEVGPGISLERHFISPKHLKEHREHPALFPPESMMEMQQRESLSVKGTQDEEELFTDVVCFGSRDVARHLTLGIDVGVADLQMASRCELACLLDPPHAMGRDWSILAVKLQLTDQVPDVDSTGQSLSRTDQLLNEWAIHHPEQASVGNLCRILVELGRCDARDALYRTVPLYVFAPLEDQFLLETNDSGVVSSCHSSSEHNPINI

SEQ ID NO: 12376 - protein, 235 aa, Caenorhabditis elegans
MSSSEEVSWITWFCGLRGNEFFCEVDEEYIQDRFNLTGLNEQVPKYRQALDMILDLEPEDDIEDNATNTDLVEQAAEMLYGLIHARYILTNRGISQMVEKWRDHDFGVCPRVYCENQPMLPIGLSDVPGEAMVKLYCPRCNDVFVPRSSRHQHTDGSYFGTGFPHMLFFVHPDLRPRRPVTQFVPKLYGFKIHPVAYGGQEGNSGGNTANNVAAAQNNTTPAGQQSGGQFNNYGL

SEQ ID NO: 12377 - protein, 234 aa, Caenorhabditis elegans
MSSSEEVSWITWFCGLRGNEFFCEVDEEYIQDRFNLTGLNEQVPKYRQALDMILDLEPDDIEDNATNTDLVEQAAEMLYGLIHARYILTNRGISQMVEKWRDHDFGVCPRVYCENQPMLPIGLSDVPGEAMVKLYCPRCNDVFVPRSSRHQHTDGSYFGTGFPHMLFFVHPDLRPRRPVTQFVPKLYGFKIHPVAYGGQEGNSGGNTANNVAAAQNNTTPAGQQSGGQFNNYGL

SEQ ID NO: 12378 - protein, 112 aa, Caenorhabditis elegans
MNNSSNADSQEGSTSAQKQKTANPSESRPFVLKKWNALAVWAWDVECDTCAICRVHLMEECLRCQSEPSAECYVVWGDCNHSFHHCCMTQWIRQNNRCPLCQKDWVVSRTSK

SEQ ID NO: 12379 - protein, 176 aa, Caenorhabditis elegans
MADQKKVSEAAKEREIKISSSDNEIFLVPRNVIRLSNTINTLLMDLGLDDEEGTNAEPIPVQNVTASILKKVISWCNHHHSDPISTEDSDNREKRTDDIGSWDVEFLKVDQGTLFELILAANYLDIKGLLDVTCKTVANMIKGKSPEEIRRTFNIKNDFTPEEEEQIRKENAWCED

SEQ ID NO: 12380 - protein, 174 aa, Caenorhabditis elegans
MADQKEASEAAKNREIKISSSDDEIFLVPRNVIRLSNTLNTLLVDLGLDDDEGTNAEPIPVQNVTASILKKVINWCTKHQSDPIPTEDSEKKTDGSIQDWDKKFLDIDQGTLFELILAANYLDIKGLLDVACQSVANMIKGKSPDEIRRAFNIKDDFTAEEREQIRKENAWCDD

SEQ ID NO: 12381 - protein, 908 aa, Caenorhabditis elegans
MRPAAPGTTPNGASSDIRHQRGVAPIPFGSTNSAIDAHHNSEIRVGRHRAKLDEIRESLKAYEHEAGLLSSHVALGSLATPSSSSVSHSDITNDNAEVMNFSSSSSNAAATTTTVSSAAVSNSNSFRTEGGGHKMRITPMPQRHLMMDTGANETVFRSGKEMIRNGNPSTTISSTPSTTTEESIRIHPAGYRYDMPTPAYHMNNNAPQYSPGYSRPPPPAYDSSPVNTRMTPVATDNYRTHLHMKVHPVVKAPPPNPTMLNHNKNMAPPPPPPAKSTISIETMSEERKADNIQRLYHTSMDKKTASSVVSINVASPHTTKVNVGDSPLPSKSFIIGPRYTADVDRKNFVNYKDELRPDPRLIPSTSDANHEDFRPILFKPRNLEITMKSRAQPPPPQYNQPSEPPPKRVSSPIDRTLLEPYIKNTRRVQPCKPNMLRFYMEQHVERLLQQYKEREKRMKQLEKEMVSAQLPDIMRNKMLGLLQQKESKYTRLRRQKMSKSHFTVISHIGVGAFGKVSLVRKNDTRKVYAMKSLEKADVIMKQQAAHVKAERDILAEADSPWIVRLFFSFQDDACLYFIMEYVPGGDMMTLLIQKGIFEEDLARFYIAELACAIEYVHNVGFIHRDLKPDNILIDQHGHIKLTDFGLCTGLRWTHDRRYYGPENDHHRVDSFSLPPEVAAIDKSVKVLNVRQQTRRITAHSLVGTGNYMAPEVIAKTGHNQSCDWWSTGVILYEMVFGRVPFHDDTPGGTQHRIKNWRNFLDFTYCGNLSKECLMMIQQLICDASSRLGSHGKDVAERTAQVKNHPWFRGIDWVNLRKLRADYIYIPRVTHDEDTSNFETFQDNDRADKPNVRGLHNPAFYEFTYRHFFDTDSVGCPSLRPSRRRSLRPLLENGTFNESVSEEDSSSHI

SEQ ID NO: 12382 - protein, 103 aa, Caenorhabditis elegans
MSGRGKGGKGLGKGGAKRHRKVLRDNIQGITKPAIRRLARRGGVKRISGLIYEETRGVLKVFLENVIRDAVTYCEHAKRKTVTAMDVVYALKRQGRTLYGFGG

SEQ ID NO: 12383 - protein, 127 aa, Caenorhabditis elegans
MSGRGKGGKAKTGGKAKSRSSRAGLQFPVGRLHRILRKGNYAQRVGAGAPVYLAAVLEYLAAEVLELAGNAARDNKKTRIAPRHLQLAVRNDEELNKLLAGVTIAQGGVLPNIQAVLLPKKTGGDKE

SEQ ID NO: 12384 - protein, 300 aa, Caenorhabditis elegans
MTTKEGFDYRKFLVDLASGGTAAAISKTAVAPIERVKLLLQVSDVSETVTADKKYKGIMDVLARVPKEQGYAAFWRGNLANVLRYFPTQALNFAFKDTYKKMFQEGIDKNKEFWKFFAGNLASGGAAGATSLCFVYPLDFVRTRLGADVGKGVDREFQGLTDCFVKIVKSDGPIGLYRGFFVSVQGIIIYRAAYFGMFDTAKTLYSTDGQKLNFFTTWAIAQVGTVGSGYLSYPWDTVRRRMMMQSGRKDILYKNTLDCVRKIVKNEGITALYKGGLSNVFRATGGALVLTIYDEIQHLI

SEQ ID NO: 12385 - protein, 105 aa, Caenorhabditis elegans
MSKAFVDGLLQSSKVVVFSKSYCPYCHKARAALESVNVKPDALQWIEIDERKDCNEIQDYLGSLTGARSVPRVFINGKFFGGGDDTAAGAKNGKLAALLKETGAL

SEQ ID NO: 12386 - protein, 410 aa, Caenorhabditis elegans
MRFPSTFSSSTHHLLESSPIDDDPGPSESIALQTRVPTATTAEKLVAEISDESDEEDEDLHFRSVNETTNQTYSEMVLRIALIAMIYYPLSIGLTFYQKWFIKNYKLPLLVVSGHYVLKYLFAITIRFIYECLRTRRTRVSFRDQLRWLAPIGICASMDIGLSNWALEYVTVSLYTMAKSSSILFIVAFSLLLRLERWRNSLGFETGLIAAGLFLFTWKSSQLDLTGLMLVELAAACTGIRWTVSQMVMQRDDSAVRHPLDMVAHVQPWMMIPIIPMIWLFEGAEINWNSVFSFKGHYDPWLVMGLIAGGGLLAFCMEMSEYLLLVNTSGITLNIFGIVKEVATLLLAHIVNKDTLTELNICGLVLCLSGMLLHGMNKRHQRAHRPLPTSSTSTRSDDSRKLLATEDPDA

SEQ ID NO: 12387 - protein, 671 aa, Caenorhabditis elegans
MQPTGNQIQQNQQQQQQLIMRVPKQEVSVSGAARRYVQQAPPNRPPRQNHQNGAIGGKKSSVTIQEVPNNAYLETLNKSGNNKVDDDKLPVFLIKLWNIVEDPNLQSIVHWDDSGASFHISDPYLFGRNVLPHFFKHNNMNSMVRQLNMYGFRKMTPLSQGGLTRTESDQDHLEFSHPCFVQGRPELLSQIKRKQSARTVEDKQVNEQTQQNLEVVMAEMRAMREKAKNMEDKMNKLTKENRDMWTQMGSMRQQHARQQQYFKKLLHFLVSVMQPGLSKRVAKRGVLEIDFCAANGTAGPNSKRARMNSEEGPYKDVCDLLESLQRETQEPFSRRFTNNEGPLISEVTDEFGNSPVGRGSAQDLFGDTFGAQSSRYSDGGATSSREQSPHPIISQPQSNSAGAHGANEQKPDDMYMGSGPLTHENIHRGISALKRDYQGASPASGGPSTSSSAPSGAGAGARMAQKRAAPYKNATRQMAQPQQDYSGGFVNNYSGFMPSDPSMIPYQPSHQYLQPHQKLMAIEDQHHPTTSTSSTNADPHQNLYSPTLGLSPSFDRQLSQELQEYFTGTDTSLESFRDLVSNHNWDDFGNNVPLDDDEEGSEDPLRQLALENAPETSNYDGAEDLLFDNEQQYPENGFDVPDPNYLPLADEEIFPHSPALRTPSPSDPNLV

SEQ ID NO: 12388 - protein, 251 aa, Caenorhabditis elegans
MLPGFGAQTVSPFPNPPEYASAYTSDRINNGSAPPPPHPLTEFKVYGEEYRLEDDVIAPLKNAGVAELYKNKNNWKTEMKKLNRSAIVAFFDLVEILIRAPDHPMREEKMVDLHTIFINMHHLINEFRPVQARDSVRILQERQIEELSDICKDFKKYLRDGREVVDDQFQMIRGKLPAPPQPSELTRVKLQDGVLHMLQETEASDDVEMKEEEGSEYSKKKARLELLSREDGPPSVVHLLARQFHDISLKK

SEQ ID NO: 12389 - protein, 253 aa, Caenorhabditis elegans
MLPGFGAQTVSPFPNPPEYASAYTSDRINNDSGSAPPPPHPLTEFKVYGEEYRLEDDVIAPLKNAGVAELYKNKNNWKTEMKKLNRSAIVAFFDLVEILIRAPDHPMREEKMVDLHTIFINMHHLINEFRPVQARDSVRILQERQIEELSDICKDFKKYLRDGREVVDDQFQMIRGKLPAPPQPSELTRVKLQDGVLHMLQETEASDDVEMKEEEGSEYSKKKARLELLSREDGPPSVVHLLARQFHDISLKK

SEQ ID NO: 12390 - protein, 304 aa, Caenorhabditis elegans
MPQYYCHNCRASFDIDESAQIACTRCHGEFVEIVNRPAMMAAAMPQGFGQMAFGHIADLLRTGIAAEIRGAQQQHAAPQQQQPQGAPQEPETPQAEQPQPRAAAGGREQQHTLEEFIRNMFRPDPRGAAEEAASAQQQQQQPHPNVTFSFQMPGGIGVQIHAHTAGGGGGNNPDGMPFGMEIGERADLESAMQEILAQFQAAGGEGGQRQGGFTEAEVKEYLPMKKVTQEHIDNGAQCTTCFDTFKLDEDVGALDCNHIFHRPCIEPWLKTKNSCPVCRQKVNMKEWKKNHLKKLQEADLDSLD

SEQ ID NO: 12391 - protein, 357 aa, Caenorhabditis elegans
MGCIMSQEDEAAKRRSKKIDRLLKEDGENSMRTIKLLLLGAGESGKSTILKQMRIIHDVGYTTEERKVFRGVVYGNIILSLNAIIHAMEQLKISFTTLDHESDARKLLMFSTTGEEDELPEELVVLMKSVWSDSGIQKALERSREYQLNDSAGYYLSQLDRICAPNYIPTQDDILRTRIKTTGIVETQFVYKDRLFLVFDVGGQRSERKKWIHCFEDVTALIFCVALSEYDMVLVEDCQTNRMRESLKLFDSICNNKWFVETSIILFLNKKDLFEEKIVRSPLTHCFPEYTGANNYEEASAYIQQQFEDMNKRTTGEKNQEIYTQFTCATDTNNIRFVFDAVTDIIIRDNLRTCGLY

SEQ ID NO: 12392 - protein, 851 aa, Caenorhabditis elegans
MSEGSGDQSQQRPWASPRQQPIKGIVQPRVLPPFGKPTRHTNKLDYIMTTVLKEAGKHKHVWPFQKPVDAVALCIPLYHERVARPMDLKTIENRLKSTYYTCAQECIDDIETVFQNCYTFNGKEDDVTIMAQNVHEVIKKSLEQAPREEHDMDVYWGKNKKKPAKSDGGSKSSSSKKNDARGPSEAPSEAGSEVSSVTTASAAAPTVSESASVAAKPERKVAGKKTGKRKAESEDDEKPEPLRAKREVAVVKKEVHQPLLPSMKPCLKLLNDFSTKKYQEFAWPFNEPVDAEQLGLHDYHKIIKEPMDLKSMKAKMESGAYKEPSDFEHDVRLMLRNCFLYNPVGDPVHSFGLRFQEVFDRRWAELGDSSSRASSVAPQSAPIAPTPKVAKSSAPKEPKESRKEHKKETTFEASGAKSEDLMQINNALSMIREREEKLKAELAAAQAIKDKLTSVKNRREDNPNEPFPEKLINETRALCTTQVGQNASSSSASSAALRNGRSKKAASARLYGYEFDSDDEDNKMALTYEEKRNLSNLINNLPNNQLNTIISIIQRRERSALMQQQLDDSEVELDFESLGDMCLREMGAFIKTIPTLNGNGDDEKPKTSSNPTSSGATGSKGSSSLESKNGKKKKNFNMSESSDDETSNSRKRRKRESSESQSSSSSDDDSDDEDRPSIPRKSGQPPSTSREWNQSSAPPPRMGGMGGQPPMSRVPASSSTSVSAIGKNNAAASSNSYRYRCFFVRKLNLKISNKKKWKSKKNSTNLVFRSSKTCTSTSTNIIKTSGSTETTVKTKENGRNQQRRLRLDHQRKANPGMVKTSRPGFRGCGWRQSEPAKKKTKAVSRCQTKWK

SEQ ID NO: 12393 - protein, 339 aa, uncultured cyanobacterium
MAQSTTSETHTRDLDRDCTTLSRHVLEQFQSFSPEAQDLAALMQRIGLAAKLIARRLSHAGLVDDALGFTGEINVQGEASKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFCSGPKVSPVHPGNASPRRLQRRYSGALVADFHRILMQGGVFLYPETVKNPTGKLRLLYEAPPMAFLAEQAGGKASDGQKPILLRQPQALHRRCPLIIGSAADVDFVDSLLG

SEQ ID NO: 12394 - protein, 356 aa, uncultured cyanobacterium
MEKTIGLEIIEVVEQAAIASARLMGKGEKNEADRVAVEAMRVRMNQVEMLGRIVIGEGERDEAPMLYIGEEVGIYRDADKRAGVPAGKLVEIDIAVDPCEGTNLCAYGQPGSMAVLAISEKGGLFAAPDFYMKKLAAPPAAKGKETSIKSATENLKILSECLDRAIDELVVVVMDRPRHKELIQEIRQAGARVRLISDGDVSAAISCGFAGTNTHALMGIGAAPEGVISAAAMRCLGGHFQGQLIYDPEVVKTGLIGESRESNIARLQEMGITDPDRVYDANELASGQEVLFAACGITPGLLMEGVRFFKGGARTQSLVISSQSRTARFVDTVHMFDDVKTVSLPLIPDPKWRPER

SEQ ID NO: 12395 - protein, 445 aa, Asterina pectinifera
MSFAFSENPLTYDVENSQNAGPQTRKTKREDAGRGNGPQACKRAALGTLSTNVTRKQPSRAAKQSGFADGFYNYQDENAFARPAAGKSTGSCGFALPPTASQPSFSIHIDPVEPAPSRARFLKEQKPTELPLDPIGYFVTRSRKTALRTVFTLDESASPMVLDTSLSEENTAQATIEDIDNSDGVFGVPEYAEDIYEYLREAELRNRPKPGYMRKQPDITSGMRSILVDWLIEVGEEYRLHNETLYLAVSYIDRFLSQMSVLRSKLQLVGAASMFLAAKFEEIYPPEVNEFVYITDDTYTVKQVLRMEHLILKVLSFDVAVPTANAFLSRYLKAAKADSRNGTSSQYLAELTLPDCEYIKYIPSTIAAAAVCLANYTLSGTAWTPMLEKHSGYNLEDIAPCVRDLLKTFTNAPSQSQQAAQEKYKSQRYNSVSMIAAPTTLPSWL

SEQ ID NO: 12396 - protein, 389 aa, Arabidopsis thaliana
MGRGLMNSLKPYLAMISMQFGYAGMYIITMVSLKHGMNHYVLAVYRHAIATAVIAPFALFHERKIRPKMTFRIFLQIALLGFIEPVLDQNLYYVGMTYTSATFASATANVLPAITFVLAINFRLESVNFKKVRSIAKVVGTVITVSGALLMTLYKGPIVDFIRFGGGGGGGSDGAGGSHGGAGAAAMDKHWIPGTLMLLGRTFGWAGFFILQSFTLKQYPAELSLTTLICLMGTLEGTAVSLVTVRDLSAWKIGFDSNLFAAAYSGVICSGVAYYVQGVVMRERGPVFVATFNPLCVVITAALGVVVLSESIHLGSVIGTLFIIVGLYTVVWGKGKDKRMTDDDEDCKGLPIKSPVKPVDTGKGLAAELEMKSKEGQEAKATTTTQVEI

SEQ ID NO: 12397 - protein, 464 aa, Yarrowia lipolytica
MDSDTESVKRRKSSGSESESSVRDPKRTKIEDEDFQENGIDDEDEEEEEEEAKDEGDEDDEEKGEDDEEDDEEKEGEDGEGEEEDEEEDEEKKREEEEKYVTSFNFDGVEYKYKERPAVIEEREGKIEFRVVNNDNSKENLMILTGLKNIFQKQLPKMPREYIARLVYDRSHVSMAVVRKPLTVVGGITFRPFDTRKFAEIVFCAISSTEQVRGYGAHLMNHLKDYVKATSPVMYFLTYADNYAIGYFKKQGFSKEISLDRSVWMGYIKDYEGGTLMQCSMLPRIRYLDVNKILLLQKALIHKKIRAISKSHVVRKGLDHFRDSTTPVDPMTIPGLKEAGWTPEMDELARRPKRGPHFAVMQHVLSELQNHASAWPFAQAVNRDEVPDYYEVIKEPMDLSTMEQRLEADSYKTMEEFVYDARLVFNNCRAYNNETTTYYKNANKLEKFMVAKIKEIPEYSHLVE

SEQ ID NO: 12398 - protein, 188 aa, Vorticella microstoma
RGGIAEMAEIGHKSRERTDVLDAAGNTTSAIGKGFAIGSAALAALSLYGGFLHNANLQGSAQINLTNPHVFTGLLVGAMLPYLFSAFTIRSVGKAALGMVEEVRRQIRAVPGILNGTSQPDYAACITISTRASLIEMIAPGCLVILTPLFLGFAFGPKILAGFLPGAIVSGVQLAIIAANTGGAWNNA

SEQ ID NO: 12399 - protein, 199 aa, Euglena longa
AGGIAEMAHLNASVRTSTDQLDAVGNTTKAVTKGYAIGAAGLAALVIYSTYIEDLHHYFPNLNIDFNLQDPFVIVGLFAGGILPYLFCSFGMMAVSRAGGKIVEEVRRQFKEIKGIMTGENKPQYSLAVDILAKAAIYEMIIPSLLPVVAPIILYFVMKHIVGQAAAFTALGAMILGCLLTGMFLAISMTSGGGAWDNA

SEQ ID NO: 12400 - protein, 204 aa, Agrobacterium tumefaciens
AGGIAEMAGLDPDVRKATDALDAVGNTTKAVTKGYAIGSAGLGALVLFAAYANDLSYFAANGDTYPYFKDIGEISFSLANPYVVAGLLFGGLIPYLFGGIAMTAVGKAASAIVEEVRRQFREKPGIMAGTEKPDYGRAVDLLTKAAIREMVIPSLLPVLAPLVVYFGVLLISGSKASAFAALGASLLGVIINGLFVAIPCTSGG

SEQ ID NO: 12401 - protein, 189 aa, Agrobacterium tumefaciens
AGGIAEMAELGPEVRKTTDKLDSVGNTTAAIAKGFAIGSAALTALALFTAFAEEIAKNPKLTGLLVDGHLVVNLTEPGVIIGIFLGATLPFLVCAFTMEAVGKAAFEMIEEVRRQFREIPGIMEGTGRPDYAKCVDISTKAAIREMMLPGVFAVGAPLIVGFLLGAKALAGFLAGVTASGVLLAIFSPS

SEQ ID NO: 12402 - protein, 261 aa, Meloidogyne incognita
MTETMLDCSDKVTESKEELVQLAKLAEQAERYDDMAESMKKVTEFGDELSNEERNLLSVAYKNVVGARRSSWRVLSSIEQKTEGGKKTMTKEYREKIECELRDIRKGVMNLLDKFLIPKAGTPDSKVFYLKMKGDYYRYLAEVSSGDELTDVIDKSQQSYQEAFDIAKDKMPPTHPIRLGLALNFSVFYFEILDNKSKACQLAKQSFDEAVAELDTLDENLYKDSTLIMQLLRDNLTLWTSDGGVEEPETAPIVADAEGTN

SEQ ID NO: 12403 - protein, 279 aa, Caenorhabditis elegans
MPRFSGKVALVTGSSNGIGRATAILLAREGAKVTITGRNAQRLEETKQEILRSGVPEDHVLSIIADLATESGQIELMNSTVDIFGRLDILVNNAGAAITDLEGHIGVGTNVSVFDKTMRINLRSVVTLTQKAKEHLIKTKGEIVNVSSIAGGQHAQPELIYYAMSKSALDQYTRSAAIDLIQHGVRVNSVSPGDIRTGIYETMGMNKESVENIYKFMESRKECCPIGTIAQPVDVANIIVFLADRKLSSYIIGQSIVADGGSSLVMEVQAHDWMELLKH

SEQ ID NO: 12404 - protein, 505 aa, Caenorhabditis elegans
MWWTSLVFSVLLFDLIFISNCDYIHLPGNSDIPDLKLQSGYLNANENGTQKMFYFLLEARDIPVGEASLIIWFNGGPGCSSLSAFFEEFGPLYVNFGGKSLFENVHSWYHKANILFLESPIGVGFSYDTEQSNFTKVNDDSIAEQNFNSVIDFFQRKHSSYVNHDFFIAAESYGGVYGPMLSALVVDSISKREFPNENFKGLIIGNGFMNVKLSTNTMILWSAYHDRTSPDEWDEIKEKCATSGAHDVDYYDFMQFMKTTNKMDYLADNSTECGRLIEPLLGQFSETFDGYDFFNYYHDCYTNFSIPNATDPIKETLAQIPRRRISALFNKHSTDGQASYRCWADDALHKYLNLKEVQNALGIDRAWKDRKKKWEVCNMPIYDQYVMTHQDMTPFFSKIFDKFTGPAFRVLIYSGDIDTACNYLADGYFTLKHGPWYHSEHKVIAGNFMRYEGANHLGSKLSIDVVTVKGSGHFVPLDRPGPALQMVHNFLTGKPGKMTNYTSPV

SEQ ID NO: 12405 - protein, 448 aa, Caenorhabditis elegans
MAAYDQSQPDYSTPEGQQAYWAYYQQQQQQQPGGQPDQDPYAAAAYGGHDQAQQPQNPYAPPPPGADPYGQGSGGQSGGSDPYGQSRGGGRGGFGGSRGGGGYDGGRGGSRGGYDGGRGGYGGDRGGRGGGRGGYDGERRGGSRWDDGNSDRQGGPPGGRGGYQDRGPRRDGPPSGGGYGGGGAASGNREFGSDGRVELKETVFVQGISTTANEAYIADVFSTCGDIAKNDRGPRIKIYTDRNTGEPKGECMITFVDASAAQQAITMYNGQPFPGGSSPMSISLAKFRADAGGERGGRGGRGGFGGGRGGPMGGRGGFGGDRGGYGGGGGRGGFDGGRGGGGGFRGGDRGGFRGGDRGGFRGGDRGGFRGGDRGGDRGGFRGGRGVGGGNANMEQRKNDWPCEQCGNSNFAFRRECNQCQAPRPDGGSGGGGGERRGGPPGGDRYRPY

SEQ ID NO: 12406 - protein, 388 aa, Synechocystis sp.
MDSTLGLEIIEVVEQAAIASAKWMGKGEKNTADQVAVEAMRERMNKIHMRGRIVIGEGERDDAPMLYIGEEVGICTREDAKSFCNPDELVEIDIAVDPCEGTNLVAYGQNGSMAVLAISEKGGLFAAPDFYMKKLAAPPAAKGHVDIDKSATENLKILSDCLNRSIEELVVVVMDRPRHKELIQEIRNAGARVRLISDGDVSAAISCAFSGTNIHALMGIGAAPEGVISAAAMRCLGGHFQGQLIYDPEVVKTGLIGESREGNLERLASMGIKNPDQVYNCEELACGETVLFAACGITPGTLMEGVRFFHGGVRTQSLVISSQSSTARFVDTVHMKGKPQSNPTALISLSATIPKKVKTWGNTSPFPLSPEVQTLGDLCFGWVIVTGV

SEQ ID NO: 12407 - protein, 590 aa, Caenorhabditis elegans
MSSLYVPLVLRLEVRDRTKIVQSFIDDSKAGSESPLAGERTRQRLVKKGNTPPKKELKGREEDPPIGVMSSEPSHNYHKGRRTYSEVVIESLDGEKLVDSSSSVAGTSEKSGGRSVSEGPPDQVAYYSGNPLTEKTEGIMHFYKYNDEKLTKVAQCRMLCMYAVPAQVEVREIISFMCISLPMIVSIKVVRDPAPNQYMLIIKFKEHNDAVTFYEEFNNCPFNDLESYCCTLFFVDRIECTTSNDLFSSDDTSLTELPTCAVCLERMDDSVLAILCNHSFHARCLEQWADNTCPVCRYVQSPEVVAEQRCNDCGMSNDLWICLICGNIGCGRYAEQHAQRHWELTSHTYSLKVGGERVWDYAGDNYVHRLIENGADGKLVEYQRESNASFDDKNQKGGDKLEGIKLEYTLLLTSQLEDQRKYFEGLRHDMEQTMSKMEKTAYAQVENLEHQLTERSTELKSLKGDLDDTVTARKVAEKRATQTNEKVNKLANELKDEREINQMLRKDQQVWKGQVEKLIESQKTARTEYEKKIEDLQSQVNDLLMHFETQNKLKEQLDAGKITQEEITESQVELDSSSSSSRKLNRKKKK

SEQ ID NO: 12408 - protein, 343 aa, Caenorhabditis elegans
MRQAGIFSHLKNFWKIILQFSKLKKKHIVMSSENQKIVVFGSIVQDLVSYTDSFPRPGESVRGHNFKLGSGGKGANQAVAAARLGINVSMIGMVGEDMFGDSNIKDLSSNGVDTSCVGRTKKTHTATATITVNKEGENNIVVTLGANLEMSPEIADANSSKIAGSKMVICQGEIDEKGNRRAFEIARSHGVTTFLNPAPGDPNMDKTILELVDIICTNENEAEFITGIAQNNVKDAEKAARAMLKMGPQHAIITLGGKGVLLASKGVDDVEHTAVIKVDAVDTTGAGDCFCGSLAAHLVAGHPISASIRSAANLAALSVTRHGTQSSYWKLDEIRQQYPEFLP

SEQ ID NO: 12409 - protein, 454 aa, Caenorhabditis elegans
MVMSRTLVLVALLGFAYVCESALITNLPGAPISNFKQYSGYYNVGTKKNHMLHYWFVESQSNPSTDPVLLWLTGGPGCSGLSALLTEWGPWNVNTDGATLRTNPYSWNKNASILTLEAPAGVGYSYATDNNIATGDDQTASENWEALVAFFNEFPQYKGNDFYVTGESYGGIYVPTLVQTILDRQSQSHINIKGLAIGNGCVSANEGVDSLVNFLYHHGVVDQAKWEHMKTSCCHNDTDACPWHSFSEFSACGEFVEATQQTAWNGGLNPYNMYADCISTSASFRFGMEYERRFNKKYTPEVLGTVPCLDESPVTNYLNRQDVRKALGIPSSLPAWSICSNAISYGYKRQYGDMTSRVLNAVNNNNLKMMLYNGDVDLACNALMGQRFTDKLGLTLSKKKTHFTVKGQIGGYVTQYKGSQVTFATVRGAGHMVPTDKPAVAEHIIQSFLFNKAF

SEQ ID NO: 12410 - protein, 451 aa, Caenorhabditis elegans
MHLRKFRMNQRELLITDHMERLKKEINKRRTRMENEAEQQCGLLTPWRKARARPHRAAKPKAEVKKEVINPADITLGGDTYDYVKEQKPTESIATNVSRRRRTSANLSKSEDDRDKPESQSTAPKSKERRTSEPPASHVAFHTPGSATPHDINLSIEHCTCQKIFDASKLYIQCELCARWYHGDCVGVAEQTILGLEHWSCEECIEEQERVKDQPALYCVCQKPYDDTKFYVGCDSCQGWFHPECVGTTRAEAEQAADYNCPACTREAEGYESEASDVSGSSRVSVQLTRADYTHVFELLELLLEHRMSTPFRNPVDLNEFPDYEKFIKKPMDLSTITKKVERTEYLYLSQFVNDVNQMFENAKTYNPKGNAVFKCAETMQEVFDKKLIDVREQMTARQQMLLLATAQQQDPMSSIRKRVQSESQRTVDSLDIDSDQLLPLDANLMRLYDF

SEQ ID NO: 12411 - protein, 405 aa, Caenorhabditis elegans
MKALHVFFLPAAKPKAEVKKEVINPADITLGGDTYDYVKEQKPTESIATNVSRRRRTSANLSKSEDDRDKPESQSTAPKSKERRTSEPPASHVAFHTPGSATPHDINLSIEHCTCQKIFDASKLYIQCELCARWYHGDCVGVAEQTILGLEHWSCEECIEEQERVKDQPALYCVCQKPYDDTKFYVGCDSCQGWFHPECVGTTRAEAEQAADYNCPACTREAEGYESEASDVSGSSRVSVQLTRADYTHVFELLELLLEHRMSTPFRNPVDLNEFPDYEKFIKKPMDLSTITKKVERTEYLYLSQFVNDVNQMFENAKTYNPKGNAVFKCAETMQEVFDKKLIDVREQMTARQQMLLLATAQQQDPMSSIRKRVQSESQRTVDSLDIDSDQLLPLDANLMRLYDF

SEQ ID NO: 12412 - protein, 510 aa, Caenorhabditis elegans
MVLRTVILPTATYTAPSQYCPSTVLSNLTLSCPYQDQEADASLEISDFAEVLPKFESAEQDWNSFGYLLNEQPGTSSDKTTTPIKKITVFQKPVEPIGKGPRRRRRCADREISELAAKPKAEVKKEVINPADITLGGDTYDYVKEQKPTESIATNVSRRRRTSANLSKSEDDRDKPESQSTAPKSKERRTSEPPASHVAFHTPGSATPHDINLSIEHCTCQKIFDASKLYIQCELCARWYHGDCVGVAEQTILGLEHWSCEECIEEQERVKDQPALYCVCQKPYDDTKFYVGCDSCQGWFHPECVGTTRAEAEQAADYNCPACTREAEGYESEASDVSGSSRVSVQLTRADYTHVFELLELLLEHRMSTPFRNPVDLNEFPDYEKFIKKPMDLSTITKKVERTEYLYLSQFVNDVNQMFENAKTYNPKGNAVFKCAETMQEVFDKKLIDVREQMTARQQMLLLATAQQQDPMSSIRKRVQSESQRTVDSLDIDSDQLLPLDANLMRLYDF

SEQ ID NO: 12413 - protein, 1107 aa, Caenorhabditis elegans
MVFDARLGYDPDEWEECPEPEHFLVFSGFTRYMLTFAAIAFVYYFFKLLDDKNKKESGEKEEPQTSVESVLAKAGDKLHDVKEQVQQHIPESAEELMREADQYLKEQAHSVQNNVHQFAEQAANKFPSLEVDLNLGHPIDATREKFDTVLSSVNNHLHETKNMDLSPTSRDSTQFEQIPSIAPEESAFGHDFEHVPPHLKTAAEQYYAQQHQPPPVPQHKIVQPVPISPTDQQLLHEFDIYDAPAHQRMNQISEQLGQLGQKTPAQLQQLQHAQLAHQQLQQQGVFQPIQQPSPLQIQTHPQQPYFDFSQLSPASQARYNQQQFVDISQLSPGAGALIAEQQASGAFQPVTKKLGREKRLSEQDERALQDWEKEKALLEADRLKKLLDHEVGGDSTDLDSSQKAYDHFAPASHISYESHSGAAQIQPMTPTAPKRADVPAPQVTSITNVRDSQLTDYDISDFHAHDEPHYHTVLTPQQLQQNQQQHQQPSAIDRRRTTADSDDYVKVSEPIYDYPPKGHEAPVAEPKRISPTEAAQLQELYQEYDLGLDLPGVAPIQGVAKPPVQQRTPLQIQQQVVQNVQNQPNMMARQNSVPESPRTVINVPISRKTDVPIQVQQQQNQFSYNVPIQVKDDPRNLATADLFVQDAQEYVAHQQNQQDKGSFVMEEEMLSLHEPETGSNKKKLTPKNPSFEATSRQVRTNDVFERIEHDEHDDMTYAPEIQSVEIPPDQMSETSENMIDYFDKVAAESEQQIQHLQEQQNTLKKQQIETSIPDSSLLKPVGRAPQILPAFGNRISSNSSLGSAGRSGSGVSSSDVYPYRHLRKQSSLLSVLGVTSMQEMLLAITSLDSLSEAMRKAGLETTNLIFGIDYTASNKYQGEESFGGRSLHTIHPHVTNPYQQVISILGRTLAPFAGQGRLGVYGFGDAKTGDWSVFNLKGEGGDCRSLDEVLNVYNTVTPTVALSGPTNFAPLIYQAMEICQKSRDYHILVIIADGQVTNERATRRAIVQACQHPLSIIVVGVGDGPWDMMRIFDESLPKRPWDNFHFVEFHEIVKKSTNMEDGDVKLAVQSLLEIPDQYRCICELGLLDRSIPPRGSEIRREMMHNPL

SEQ ID NO: 12414 - protein, 1091 aa, Caenorhabditis elegans
MVFDARLGYDPDEWEECPEPEHFLVFSGFTRYMLTFAAIAFVYYFFKLLDDKNKKESGEKEEPQTSVESVLAKAGDKLHDVKEQVQQHIPESAEELMREADQYLKEQAHSVQNNVHQFAEQAANKFPSLEVDLNLGHPIDATREKFDTVLSSVNNHLHETKNMDLSPTSRDSTQFEQIPSIAPEESAFGHDFEHVPPHLKTAAEQYYAQQHQPPPVPQHKIVQPVPISPTDQQLLHEFDIYDAPAHQRMNQISEQLGQLGQKTPAQLQQLQHAQLAHQQLQQQGVFQPIQQPSPLQIQTHPQQPYFDFSQLSPASQARYNQQQFVDISQLSPGAGALIAEQQASGAFQPVTKKLGREKRLSEQDERALQDWEKEKALLEADRLKKLLDHEVGGDSTDLDSSQKAYDHFAPASHISYESHSGAAQIQPMTPTAPKRADVPAPQVTSITNVRDSQLTDYDISDFHAHDEPHYHTVLTPQQLQQNQQQHQQPSAIDRRRTTADSDDYVKVSEPIYDYPPKGHEAPVAEPKRISPTEAAQLQELYQEYDLGLDLPGVAPIQGVAKPPVQQRTPLQIQQQVVQNVQNQPNMMARQNSVPESPRTVINVPISRKTDVPIQVQQQQNQFSYNVPIQVKDDPRNLATADLFVQDAQEYVAHQQNQQDKGSFVMEEEMLSLHEPETGSNKKKLTPKNPSFEATSRQVRTNDVFERIEHDEHDDMTYAPEIQSVEIPPDQMSETSENMIDYFDKVAAESEQQIQHLQEQQNTLKKQQAPQILPAFGNRISSNSSLGSAGRSGSGVSSSDVYPYRHLRKQSSLLSVLGVTSMQEMLLAITSLDSLSEAMRKAGLETTNLIFGIDYTASNKYQGEESFGGRSLHTIHPHVTNPYQQVISILGRTLAPFAGQGRLGVYGFGDAKTGDWSVFNLKGEGGDCRSLDEVLNVYNTVTPTVALSGPTNFAPLIYQAMEICQKSRDYHILVIIADGQVTNERATRRAIVQACQHPLSIIVVGVGDGPWDMMRIFDESLPKRPWDNFHFVEFHEIVKKSTNMEDGDVKLAVQSLLEIPDQYRCICELGLLDRSIPPRGSEIRREMMHNPL

SEQ ID NO: 12415 - protein, 574 aa, Caenorhabditis elegans
MCRTLLGVAFLVVTVLSQGEKDLIQNLPGLLFKANFKSYSGYVDANANGTWKMHYMLTESRSNPDTDPLLVWFNGGPGCSSLGGLFEELGPFYVNFDGQTLYENPYAWNAKANVLYLESPIGVGYSYDTTTPGYFQANDDQSAAQNYQALTNFFNVAQPKYTNRTFYLSGESYAGIYIPMLTDLIVQGINNPNQPFPNKNFQGSAIGNGFMNVAGLLNALTLWSAYHGRVSEQNWADIKANCSKGADVDSFDFSQFTTSQNKIDYVGDGSYCGNLIQPLISQNALGNEGFDQYNFYQECYDKSVFQAPPPAGGKRHKRSAMQGVSSVQKNLQYQQLGNFQGTSNLAKNTATLVNRFSNDNQFGYFCWNEDAVSKYLNSDNVQNALNIPQAWKDQKNTWEDCRMSIYNNYTLKYNTTNRFFNNIITNLTTDFRFLIYNGDVDTVCNYLGDAKHILQVAKDNGLTSGPRTPWYYSNNQQLAGYVQTYSGKNKNNAMITIDLLTVKGAGHMVPYDRAGPSVQMISNFVWAPKNVVINYTSQDNFNPNIQLSDLVDSGSSSTVAFFISMFAVLLNIVF

SEQ ID NO: 12416 - protein, 469 aa, Caenorhabditis elegans
MKTLLLLAFFVGVTCGEEIKDLPGLDFEPNFKHYSGFFQVSDNHVLHYWFVESQNEPSNDPLIFWFNGGPGCSSLDGLLNEMGPYVANEDGKTLRENEYSWNKMASVVYIESPAGVGYSYATDGNITTNDDLTSLENYEAVKQFFTEFPQFRHHQTFIMGESYGGVYVPTLTARIVDGQKDFPINLKGMALGNGYVNEKLNIDTSVRFAYGHGLIDEKIWNTLERDCCRGCIDSCDLTQVTGHCATLVEDIFQFLWFGGLNPYDLYRDCDPNPSVNSKRMKHMLRGVAPAMAHFDELLKNQTKTSLYQFLKNKSQSQKPLKADVPCLNDTEMLSYMNNPKVRKAIHIPFNLGKWDICSDKVTTTYQKQYTDMTPFIKKIVKNHVRVLLYYGDTDMACNFMMGQQFSDQLGLRRTLKKTPWKYDRQIAGFKTLFDGLSFITIRGAGHMAPQWRAPQMYYAVQQFLNNHPL

SEQ ID NO: 12417 - protein, 569 aa, Caenorhabditis elegans
MNRLSQFKRSYSLLPQGAQAYIGGKWTASETGNSFDVLNPFNNEVVDRATNCTVKDAEKAVHSALEGFDKWAHTYSAKQRGAILHKWFEILVQRETELATLLTKEQGKPLAEARGEIQYSAAYFDWYAGEARRVYGQVVPSAVVNRLHLHTREPIGVVALIAPWNFPTAMIARKAAAALSVGCSAVVKPSGDTPLSALALAQTAEEAGIPAGVFNVITADHSNTAEISKYLCESTDVSAISFTGSTPVGKLLLAQSASTVKRVCLELGGNAPLIVFDDADLDVAVNGTMATKFRCSGQTCVSANRIYVHEKIHDQYISKLAAAMKEKLVLGDGLNPKTTQGPLVNQKAVDKCELLLSDALGKGSELICGGKRGEHGTSYEPTLITNVQSNTNIAHTEIFGPIASVQKFRDEQEVLEAANNCRVGLAGYVFGRDQSRLQRVARKLEVGMVGVNEGLISCAEAAFGGVKESGIGREGGAQGIDEFTNWNCRVAAIPCIYHLPIFFFFHCNFFLTRDEEKWFLGHGRRADKFQRPFILLCCFPPVFFCFSQLFPMLKRFPSKKIMYSVGKQR

SEQ ID NO: 12418 - protein, 293 aa, Caenorhabditis elegans
MGLVKVIKNKAYFKRYQVKLRRRREGKTDYYARKRLTVQDKNKYNTPKYRLIVRITNKDVVAQLAYSKIEGDVVVASAYSHELPRYGLKVGLTNYAAAYATGLLLARRHLKTIGLDSTYKGHEELTGEDYNVEEEGDRAPFKAVLDIGLARTTTGSKIFAVMKGVADGGINVPHSESRFFGFDQESKEYNAEAHRDRILGKHVADYMTYLKEEDEDRYKRQFSKFLAAGLNADNLVATYQKVHSAIRADASPAAKKAAKPSKRHTAKRLTYDERKQRVADKKALLLQLKEQQE

SEQ ID NO: 12419 - protein, 363 aa, Caenorhabditis elegans
MSAADMARKNSLINRQLEKEKIDSKKMLKILLLGGPECGKSTIFKQMKIIHMNGFSDLDYVNFRYLIYSNIMQSMDQLLEAAEFFHFPPDDSPSIRRALNHYKSYKVRYSTSEVELNRELADSLSKLYNAEFIKSVLNRKNELKLLDSAVYFLDDIDRISAHEYKPTEMDVLRARVPTTGITEIEFPFKQASLRMVDVGGQRSEQRKWIHCFDNVNGVLFIAAISGYNLYDEDEENRKDDGTPTKTNRLRYSMELFKRIANHQCFSKKTAMILFLNKIDIFKEKIGKYPLTTCFKNYKGVNAFEPACKYVTDRFSRLVSGDIQHEKPLYTHITNATDTRNIDRVFDSCMDVIFKISMEKVGFM

SEQ ID NO: 12420 - protein, 492 aa, Caenorhabditis elegans
MGVNDHDVSVPLQEVQSRTVEGKLTKCLAFSAFVITLASFQFGYHIGCVNAPGGLITEWIIGSHKDLFDKELSRENADLAWSVAVSVFAVGGMIGGLSSGWLADKVGRRGALFYNNLLALAAAALMGLAKSVGAYPMVILGRLIIGLNCGFSSALVPMFLTEISPNNLRGMLGSLHQLLVTIAILVSQIFGLPHLLGTGDRWPLIFAFTVVPAVLQLALLMLCPESPKYTMAVRGQRNEAESALKKLRDTEDVSTEIEAMQEEATAAGVQEKPKMGDMFKGALLWPMSIAIMMMLAQQLSGINVAMFYSTVIFRGAGLTGNEPFYATIGMGAVNVIMTLISVWLVDHPKFGRRSLLLAGLTGMFVSTLLLVGALTIQNSGGDKWASYSAIGFVLLFVISFATGPGAIPWFFVSEIFDSSARGNANSIAVMVNWAANLLVGLTFLPINNLMQQYSFFIFSGFLAFFIFYTWKFVPETKGKSIEQIQAEFEKRK

SEQ ID NO: 12421 - protein, 510 aa, Caenorhabditis elegans
MSEKSRSDTSATASLSDSSKSPSSYSTPGTTTQKIIFPDGKLTKCLAFSAFVITLASFQFGYHIGCVNAPGGLITEWIIGSHKDLFDKELSRENADLAWSVAVSVFAVGGMIGGLSSGWLADKVGRRGALFYNNLLALAAAALMGLAKSVGAYPMVILGRLIIGLNCGFSSALVPMFLTEISPNNLRGMLGSLHQLLVTIAILVSQIFGLPHLLGTGDRWPLIFAFTVVPAVLQLALLMLCPESPKYTMAVRGQRNEAESALKKLRDTEDVSTEIEAMQEEATAAGVQEKPKMGDMFKGALLWPMSIAIMMMLAQQLSGINVAMFYSTVIFRGAGLTGNEPFYATIGMGAVNVIMTLISVWLVDHPKFGRRSLLLAGLTGMFVSTLLLVGALTIQNSGGDKWASYSAIGFVLLFVISFATGPGAIPWFFVSEIFDSSARGNANSIAVMVNWAANLLVGLTFLPINNLMQQYSFFIFSGFLAFFIFYTWKFVPETKGKSIEQIQAEFEKRK

SEQ ID NO: 12422 - protein, 937 aa, Caenorhabditis elegans
MIFPIGIPMISKKRKSAQEAVSLREAAERRSQFARVPARSVSAPPRKKWFRSKQQLSGAADGMDGSSRAGSQEIVCDEFTKKLVAAITTWHDIHSSLLQLSIERSSNDSNEEHENVSVSSESSWSSASDSESDEDSATGRDSTNNHLSASAARFSISNPDLTNCQIKQMFPEMADHWRKALAKSPVVRRTAADQETSNPVNKHRSSRYWIEDEGDYHILPSEHVWLPSSTGSSASADSECYVGEKDCRRSGEKRRCAACHIVAHTNCFSLLAKLNLNCKTTFRDYATKKTPSKESTDGLTAHHWVHKWRHEGRCNTCAKSFQQKMFFQGKEKKETIAVTCSWCKESYHLKNCFARDKLEERCNRGALKEMIVPPTWILRLANRKRSSRTPSHPRKHKKSHRQFVVKPTDLWSSGPSQPLLVFVNPKSGGNKGSKALHTLCWLLNPRQVFDITSLKGPKFGLEMFRKVVTQLRILVCGGDGTVGWVLSTLDNLNWPAYPPMAIMPLGTGNDLARCMGWGGVFSDEPISQLMQAILHETIVTHLDRWRIDVEPNTSCNLEEEDDGMQSALPLTVMTNYFSIGADAHVALQFHHSRSANPQMLNSRLKNRIAYGGLGTIDLFKRSWKDLCEYITLECDGVDVTPRIKELKLHCILFHNITYYAGGTIPWGESSDNKPSCCDGKVEVLGFTTATLAALQMGGKGERIAQCSRVRVITNKAIPMQVDGEPCLLAPSIITLGFHSKVPMLKREKKTPCTPNLMRRGTRYGQKDSQVQSTSLIIQLPVIVVGRADYDNYKDCFERLKDTAYEIGIVNVESEAELDSARVLIQRLLVEHNSLPYEPDKNWRFLDYVSNAEEGTFRVSRQQEHVQSVSDVCNTDECLLILDHAFPSITDREAVELFQPQQPIPSTSTSAAPRYHNSRRISETLRIVLSSDAQETHL

SEQ ID NO: 12423 - protein, 470 aa, Caenorhabditis elegans
MKLLSILFIFVSSYSFCLAAPATDKVNDLPGLTFTPDFFHYSGYLRAWTDKYLHYWLTESSRAPTQDPLVLWLNGGPGCSSLDGLIEELGPFHVKDFGNSIYYNEYAWNKFANVLFLESPAGVGYSYSTNFNLTVSDDEVSLHNYMALLDFLSKFPEYKGRDFWITGESYAGVYIPTLAVRILNDKKNFPNFKGVAIGNGALNFPNNYNTMVPFYYYHALVRDDLYNDIARNCCNNNIGTCDIYSKFFDPNCRDKVINALDGTNELNMYNLYDVCYYNPTTNLKKAFIERQMRIAVGLPARKHNAATTVPLCAQTNNTHVYLNRADVRKSLHIPSSLPAWEECSDQVGKNYVVTHFNVIPEFQTMIAAGIKILVYNGDVDTACNSIMNQQFLTSLNLTVLGEQEKVNEAWHYSGQTGTAVAGFQTKFAGNVDFLTVRGSGHFVPEDKPKESQQMIFNFINNKDYSTPIQL

SEQ ID NO: 12424 - protein, 250 aa, Caenorhabditis elegans
MSAAHKNLLAVWAKEPKDLVAVEKALNELTKVLSASSDLNDKQSALASKDLYEISVLLAILKHDFETFDDYINQMHTYYTMAPENSENKHLMTGLHLMFLLAANRLSDFHMLLEQIPQKEQTSNAYISTPVRIEQSLMEGAYNKVVLTEKNIPSPFYTIFIRIMLDTIRREIATSIEKSFKVLTAKDATVMLLFDNDEQMKKFGQERKWHLDGERYVFEIEVAQEKPVNLDTVRVATQTLFYAKQLEQIV

SEQ ID NO: 12425 - protein, 184 aa, Caenorhabditis elegans
MSAEAVAAAPIAEEATPVVYYSIESNDRVVLKISEQAIKQSATLSNSITNLGYSAENAESMVPIPIEKVNGKTLKLVVEWCEHHKADPVPEAYPSGNTVLPVWDRKFVDIEHDALTDLVNASNFLEVMTLLTYCCKFIAGLAKGMSPEEMRVFFCIPTDEEDEKAERFGKEKTEASATSADTTA

SEQ ID NO: 12426 - protein, 180 aa, Caenorhabditis elegans
MPKKNNTKRAPPSVPKPSGPPPRLLQLTSSDGHLLQGDIRALLLSSTLAATIRELGYDKEYCAELKPVPVNNVVGFTLKLLIEWCDKHKEDDPAIALAEKDKKNICIPSWDRHFLSRLPMSNLFDLITAAYHLDVTGLINYGCKTVANSAKGKNAEEMRELFGIPEPWEQPSTSTATWDD

SEQ ID NO: 12427 - protein, 329 aa, Caenorhabditis elegans
MTSTVQSPLYSRVFSAVFYGVISVLIVFVNKILLTNYKFPSFLFVGVGQMMATILILFFAKMFRIVQFPSLDSSIPRKIMPLPLLYFFNLISGLGGTQMINLPMFTVLRRFSILMTMILEFYILNVKASKAVKISVGLMIGGSFIAAIYDLSFDALGYTMIFINNICTAALGVYTKQKLDAKDLGKYGLMFYNCLFMLLPALCVVQYTGDLDRAYSFMLSDSMTSSVWTCFLLSCICGFVLNYSLVLCTHHNSALTTTCVGPIKNLFVTYVGMFSSGDYVFQWANFTGINVSVFGSILYTYVTFRSKSTTISYKPLPMTMPIDVHKPRN

SEQ ID NO: 12428 - protein, 1299 aa, Caenorhabditis elegans
MQHGSLGPSSSSRKTTVTSTAGSVHLHHRSSNGFSTASRAQLNRHNEMDFGKMFAAMEKGHKVCKIAVLKKWDPAYKQLTLDRYSRQIFLTKLELSAVRNKPTILDIRQIREVQTLNYKLNTIKVDDKWKKDREIVNFDSKAILIISYGMGFALSYWILFVARKHMKPFVQTSLQFKVQSDQLQQVTEDQMNSDQFSFASRQLIHVPELFSSRFADLAEKHERKGLVVTFQNFLRFLDGKQFDELASNRTRALEFLNRYFQEDQAYFGDRNEPSMTVFEFCDFLFSRENSLWDPTNEKVTHDMSRPLSHYWIASSHNTYLTGDQLRSESSLDCYAQALLMGCRCIELDCWDGQKKPGSAEFIDIVIYHGYTMTSKILLRDVLHVIRHYAFVTSEYPVILSIEDNCSVPAQRLLAQELKDILGDYLLTQPANREEKQLPSPAALKKKIIVKHKKLPIESEDLAAVVKTDEFQDTEIISRECVKKGILMVKNNNSHEWTSHVFILFPDRLCYLIQTADPENPNDDTVSVSGDEEREEETPSGFGVKPEEMHVTEEWFHGRCERDEAKKRILEHKEKGNGLFMIRDSNLFIGDFSLSILHDGKVHHVRIRSKIIDKEKKYYFMDNKVCDTLYELVSYYTRHYLTTAHFKMVLTIPCPQPQPHLNQPWFSATADKEKAEELLSLVPEDGAFLIRTSSTDSSVYVLSLKVDGEFWHYRLKRDGRIFVVNQKVFENLNQIVEFYANREFVRGISLRFPVNEKDISHLTAELAEARTPGCYMDLKDLDKEVQARALRPYRGTADDELSFPANVIITVLRKEEGLWRGRYGSLTGWFPSAHVQEILPEKVSTSETSNYNTIELAGTLIERIHDADRPNVIRISQSNQHWMNKQYYLLAASSSEEADGWQNNLFELTRSVNTKMSILRTKEKEKRIAAELSNLVVYCQAVPFDPAHIYNDAFYEMCSFVEGKLDKLVEKGLLPFNSRKLSRVYPNGSRITSNNYSPVPMWNAGCHMVALNYQTGDKPMQLNQGKFLANGRCGYLLKPDYMLTDDFDPTNTEKFATAYPIRLNVQVIGGRHLSRKDKNKGICSPFVEIEIIGMPCDTKVFQTKTIASNGLNPIWNQTFTFEIQCPEVALIRFHVEDGDFVGPKTDPFIGQAVFPVDSIRCGFRSVPLKNQYSEELELSSLLVDVQMCSREGTQLIRSSSHFLQASRLAPVFAHRKITNGDSIPREMAPRLRTSATDRSLDSPTNSESRATLLSGQRGSQDSMDSAAETSSIASGTISSRDGKKKQNWLKKFSFGKSSKS

SEQ ID NO: 12429 - protein, 309 aa, Caenorhabditis elegans
MACKNPKKFFPICNSPILRDGALKGKVALVTGGGTGIGKAIATTFAHLGASVAIAARRMEKLEQTAEEIMKTTGGICEPFRMDIKDPGMVSDTFDKIDKKFGKHPDILVNNAAGNFIMATERLSPNAHGTIIDIVLKGTMNVTTELGKRCIQSKTGASVTSITAAYARSGAPFIVPSAVSKAGVEIMTKSLATEWSKYGLRFNAVSPGPIPTKGAWGRLFSGEMGDVAEKMKELNPEGRSGTPEEVANLVAFISSDHMSFMNGVIIDLDGGQQHFNHGSHMGDFLHTWDQDTWGDVENVIRGRTGKEKP

SEQ ID NO: 12430 - protein, 308 aa, Caenorhabditis elegans
MSALEETQSLCKQVDDICNNGMESVEQCNKLLDQLSKIPMSIEIIQKTNIGIKVNMMRKKVTDDAVAKRAKNIIKDWKNVVDGKSKSQDDGGAPPAKKHRKESVEEAKPEKKKIEAPYKRPEPSSRPEIVAQFASASFPPKHLENDETRLKSAQLLLSALRFGDMPQGTLDPEELAVQIEEKLYSVHRDTNKSYSAAVRSRIFNLRDKKNLALRENVLTGVVRAEKFATMTSEEMASAEIREMRDKFTKEAILEHQMSVQQGTPSDMFKCGKCGKKNCTYTQLQTRSSDEPMTTFVFCLECGNRWKFC

SEQ ID NO: 12431 - protein, 426 aa, Caenorhabditis elegans
MTDTNSQWIEMNLQRQRKMLEDKQKQKRHQSAGSVRTTSTAMSMNSMKDYPTFDNSLPFSISDNSSVSVSMNTPLIPTQDPIAQPRMQSMPRQQPQQVQESLISIGDYPDNDINAKLSKVNLTSCVVSDDEDEDKRSYADSPWNTDVVADRIPSEVLPDYNFIKNNLAKFVEDPAVEHCLYKCSITRQKSGVDKGMFPTYFLHLEEFDTDKRQKIFLLAARKRKKSTTANYLLSTDPTNLSREGEGYCAKVRSNALGTQFTVYDSGQNPKKTTNHAAIRQELAAVIYETNVLGFKGPRKMTIVMPGIEPPTENRPAVRCPVRPIQDKHTLLERYRLNDLDSLKILSNKSPQWNDETQSYVLNFHGRVTQASVKNFQIIHQSSPEYIVMQFGRISDDEFTMDFRYPLSAVQAFGIAMTSFHGKLACE

SEQ ID NO: 12432 - protein, 403 aa, Caenorhabditis elegans
MDPKPINEGMLLEDHDHGMPEEEEITEDDMNGIHNIEEDTRTISEIAMELHHPNKSQVLLDQERFLPIANVVRIMKTQMDPQAKLAKDAKECAQECVSEFISFIASEAAEICNITKRKTITADDLLTAMEATGFDNYAEPMRIFLQKYRQAHKITGPIHRTHPDYVRPPQFQMDPFVRPLFFDTEQGRRCTETQYVINGSEIVKNAPLGEEWNEQTGTLNTRADGYYMEEPMEPMPMEEVEIEEHEEIIEQDSLGAIALEQQGQMQIYVDPKTKQHFAAKETPNGMELYPLIIQDTPLQLENVSGPNQFVMNMPDGRAIPHGMGQEEPQPVSSSSVMRKIGQNPSSYAQQHHHVSHVEQHDDVEYEEEEEVDQVEEDTVPVPIAPRPAATRVQPKRTPTKRKK

SEQ ID NO: 12433 - protein, 283 aa, Caenorhabditis elegans
MEQGVPATSSEIPPFTENITIPEVVSETVTEPDEDWLWPSDPDVELATQITMAIAVIFIVKAIFDAWQSRRRQRAASRMDENAERNQIITQRRISEALHQSSHECPICLANASFPVLTDCGHIFCCECIIQYWQQSKAIVTPCDCAMCRSTFYMLLPVHWPTMGTSEETDDHIQENNIRIDDYNRRFSINRPVLDYIRDIPILIPYLIRNFFNNDIFTLVYQVRIGFVFICVITYFLLPSDMVPESIYGIIGFLDDCIIGILVFGAMFRWLREYMADRGLARN

SEQ ID NO: 12434 - protein, 405 aa, Caenorhabditis elegans
MDFESSSAGPSTSYAEEPCTLSMLPQVSAVLSETSITESNVSCQLHPSRSAALNDNVRTLIYNRTDPHIQLDMRAFYNCMEYEEALQPNYHYFTGVQENITPFHREQAIDWIYDVAKEENCDGDVFLLAVSLIDRFMSVQNILKHDIQMIAGVALFIASKLKAPHPMTASKIAYYSDNSCPIDMILQWELLIVTTLQWETESPTAFSFFDFLASRIPQIHNMRGDFQTVVQKCQKMHKLATLFPSMQCAIGLYYVSNLPTQNKELAVKIKDLLANMFQLEVNLLDSYIPMVQRCMSTTPIYTSEDAEKTEPTPSAPASTQEPEAFQELKELKEEPLPTPPPEEPAFQKLVLLEPIPLSEQTPSTPLNDSGFSSDVSSPASSEKKRRRSTDWFEEDSTPPKIFKTL

SEQ ID NO: 12435 - protein, 316 aa, Caenorhabditis elegans
MVQSLKLNSGYSIPAIGLGTWQSKPGEVAAAIKTAVAAGYRHIDCAHVYQNQKEVGEALKEILDEGKVKREELFITSKVWNTFHSEAKAHENIDIILSDLQLSYVDLMLIHWPQGYAEGAELFPAGENGKMRYSDVDYLETWKAFEAAQKAGKCRSIGLSNFTHSQIQRVWDAAEVKPACLQVELHPYFTQVKLREFCKEKGIVVVGYSPLGNPGSAFFRKDGDPNVLTNEVVAGIAKAHGKTPAQIILRWFVDSGLSAIPKSVTPQRIIENISVIDFQLSAEEIQAIDGVNRGWRLVDPSPRDGDHKYFGFNEEF

SEQ ID NO: 12436 - protein, 316 aa, Caenorhabditis elegans
MVQSLKLNSGYSIPAIGLGTWQSKPGEVAAAIKTAVAAGYRHIDCAHVYQNQKEVGEALKEILDEGKVKREELFITSKVWNTFHSEAKAHENIDIILSDLQLSYVDLMLIHWPQGYAEGAELFPAGENGKMRYSDVDYLETWKAFEAAQKAGKCRSIGLSNFTHSQIQRVWDAAEVKPACLQVELHPYFTQVKLREFCKEKGIVVVGYSPLGNPGSAFFRKDGDPNVLTNEVVAGIAKAHGKTPAQIILRWFVDSGLSAIPKSVTPQRISENLAVFDFQLTAEEISKIDGINKNWRIVDLSQRDGDHPHCPFLEEF

SEQ ID NO: 12437 - protein, 339 aa, Caenorhabditis elegans
MPIADTVTLNSGYEMPVIGYGTWQLPKNLAAERVRDALEAGYRHIDSALSFKNQEEVAAGIKDWCKIRKVRREELFLSSKIWNTYHSRNRCMQQIDEMLEIFETTYMDLIVIHWPFGWAEDEPPGERGLWPRGANGKMRYSDVDYLETWKALEDAHRSGKIRSIGLANFNIGQVEQVWTKGLIKPAVLQVEMNPFLDQEEIRQFCREKGIILTAFMLTGNPGSALYRKHEDPNLLYNETLQSIAKGHGKSVVQVLVRWAIDLRTTALVKSSESKRIRQNINIFKFRLTSQEIARIKALNIDFRILNPLLGNYDHPYFPWPHVQEEQLPQKVEEPDPENL

SEQ ID NO: 12438 - protein, 484 aa, Caenorhabditis elegans
MDRYSPYDKTVFLIFCTAYILQKAMVNVRRANFKSFWDKYSDKPDTNSMMLNHSAEELESSDRADILASLPLLHNKDVVDIGAGIGRFTTVLAETARWVLSTDFIDSFIKKNQERNAHLGNINYQVGDAVGLKMESNSVDLVFTNWLMMYLSDEETVEFIFNCMRWLRSHGIVHLRESCSEPSTGRSKAKSMHDTANANPTHYRFSSLYINLLRAIRYRDVDNKLWRFNVQWSCSVPTYIKRSNNWRQVHWLAEKVPAEDGAKGTSFNELVELIKNTWQNEQEAWDAKLDDEKYVWTDKVFSSALTSLPSNSTFFLYTPRTVSPYCHINAHTLAETFNANVWNTEIIPEYYRTSLTKSNNLKDQRVRFGWNQSLTDSVTYWQQKDALFDVFVATEFLSTVDDETIRQLPNVMSDGAKFITLEPVDEVNEAEMKQRIQELGYTLKSFTDVTDQCIEAQEQYFKDHEQLRDEKVIRKNWVLLELTH

SEQ ID NO: 12439 - protein, 376 aa, Caenorhabditis elegans
MIPTTVLSNNVEMPLIGLGTTHSGGYYHDAVLHSIKKCGYRLIDTAKRYGVEKQLGIAVKNCSVPREEMFLSTKLWPVDCGDEVYNAFQTSCEKLQTDYLDMYMIHMPQLPDWIVNQKETKEKTWRQMELLYEDGKFGFCFKCFKLAFGEATSYIALKISCNELCKLNLKLPMSISRSKNPQTNFTIITEHVRSIGVSNYSIEDLDELLEFASILPHANQVELHPWFHQADLKNYCDELGILTMGYCPLAKGKYLEDETLCKIASKYQKSPAQICLRWSIQQNVPTVPKSTDCRRLKENTNVFDFELSAEDMNTLNSFSSQNRKIVDLSNICQKMSLPDGYKLNGRVFGVPEEDETIPKSCSKCAQKQNVPLPVCI

SEQ ID NO: 12440 - protein, 298 aa, Caenorhabditis elegans
MGRKKKKVDKPWCWYCNREFDDEKILIQHQKAKHFKCHICHKKLFSGPGLSIHCMQVHKETIDKIPAAVHGRDNIHVEIYGMQGIPSGAYRGAADEEPDEKRSRMDNGPPMPTPMPFPQHFPFPGMPPMPSGPPPPSMAYGMPPMPSGMMPPRGMPGAYPPPRGYPPAPAPGVYMPPPGMPGAYPPPRMPIGHGPPGGPPMPGPPQRSRFDQPDGGDRWGPPMRGVPRTPPYENEHEHQDYQAPDDYNQGGYDDRFREGDRGGPPGGSRFDQVKAELKEEIVEVYSLISNNGISIELY

SEQ ID NO: 12441 - protein, 341 aa, Caenorhabditis elegans
MGRKKKKVDKPWCWYCNREFDDEKILIQHQKAKHFKCHICHKKLFSGPGLSIHCMQVHKETIDKIPAAVHGRDNIHVEIYGMQGIPSGAYRGAADEEPDEKRSRMDNGPPMPTPMPFPQHFPFPGMPPMPSGPPPPSMAYGMPPMPSGMMPPRGMPGAYPPPRGYPPAPAPGVYMPPPGMPGAYPPPRMPIGHGPPGGPPMPGPPQRSRFDQPDGGDRWGPPMRGVPRTPPYENEHEHQDYQAPDDYNQGGYDDRFREGDRGGPPGGSRFDQVKAELKEEIVEPNNGPPTTSSGAAAASAAAVVASKLGSRTRIVYPDDHSLSLEERRVKMLFEKRSNPYH

SEQ ID NO: 12442 - protein, 287 aa, Caenorhabditis elegans
MFKLKNGQEIPKLALGTYEAKGDQLFAAVDEALKVGYRSFDTAKYYENEKDLGLALKTLLPRHNICSEDIYLTSKVFPYSSKNAAELIRKDVNESLELLDRKYLDLVLVHYPRPLDTEDLNENNKMYRKDTWIALEKLHAEGKIRSIGVSNYEPHHIEEMRSYITIEPQVNQIEYHPHFQRKVLRAYCNKNEILFQAFSPLGRGNKTLLGDSTMERIALCHKTTVANVILAWIMKGKYGVVAKSVTPSRVAENYTSLSLELSDDEFEKINGLNLETPYVEDRGWFVL

SEQ ID NO: 12443 - protein, 352 aa, Caenorhabditis elegans
MALRKCGNLFVARLAGTSTRAASTMTVRDALNQAMDEEIKRDDRVFLMGEEVAQYDGAYKISKGLWKKHGDKRVVDTPITEMGFAGIAVGAAFAGLRPICEFMTFNFSMQAIDQIINSAAKTYYMSAGRVPVPIVFRGPNGAAAGVAAQHSQDFSAWYAHCPGLKVVCPYSAEDAKGLLKAAIRDDNPVVFLENEILYGQSFPVGDEVLSDDFVVPIGKAKIERAGDHVTIVSYSRGVEFSLEAAKQLEAIGVSAEVINLRSLRPFDFESIRQSVHKTHHLVSVETGWPFAGIGSEIAAQVMESDVFDQLDAPLLRVTGVDVPMPYTQTLEAAALPTAEHVVKAVKKSLNIA

SEQ ID NO: 12444 - protein, 277 aa, Caenorhabditis elegans
MTGRFSGKVAIITGSSFGIGRATALLFAKEGAKVTVTGRSEERLQGSKQALLDAGISDSNFLIVPADITTSSGQDALISKTLEKFGQINILVNNAGASIADSQNRAGLDQGIDTYEKVLKLNVQSVIEMTQKIRPHLAKTRGEIVNVSSVAALKFAHVRNPYYPLAKAALDQYTRSAAIDLISQGIRVNTVNPGVVATGFHESCTGLSTEESQKFYDKVGANKSAIPCGFSGRPEHIAKAIAFLADRDSSEYIIGQNIIADGGTSLVLGFHAQLPQK

SEQ ID NO: 12445 - protein, 355 aa, Caenorhabditis elegans
MFEIFTQGFSLLNLLSILAFFTTVGLFFCGIPICRQIWKRKDTKEISGAPFLMGVVGGCCWMTYGWLKNDGTVKWVTGCQVILYTTYTIFYWCMTKKKLYISLKVLGVIGICTSLVLAVHFFGMKIFHPLGIVCLTLNIADFAAPLGGIRVVIRRWATSTLPLPLCIANFLVSTEWFLYGLLKNDFYLIFPNGVGSLLAFIQLLLFIVLPRKPGQRAPIVRLWLWIRGVRVEETKEIVAELGECDEKDDKKMNRAQRWSQKIKMNVSTVAEELENVIYQLPTKDQFAYTHKIGDEDSSSEKTVETVDETKKAPVTAVDKLKDADRERKMRNALRAAQDARENALRRTISSPDLSE

SEQ ID NO: 12446 - protein, 577 aa, Caenorhabditis elegans
MKKLKRRLSAAFRPGSNNNVSITSSGGSYYDSDCEGRNNIVIGYGMMSAPLHGRTWTLSESMSHLSDKNGAILEECAVVDPTALLRVSRGGTAGRRYDTNVNYINGMHVPPPRTHSLYYPRGYNSRRNSYYGSNASVVQESMILGSDGESVEVSPCTSDQTPTGVPPRYIVNVKMRQKTARKWSEEEIQKRLSLPADLRLPVAVVDKLNRTPTLDQPLTRKNRRASLSEIGFGKLETYEKLDKLGEGTYATVFRGRSILTNKFVALKEIRLEQEEGAPCTAIREVSLLRNLRHANVVTLHDIIHTDRLLTLVFEYVDRDLKQYMDSCNNAMQMNNIRLFLYQLLRGLAYCHQRRVLHRDLKPQNLLITAKGELKLADFGLARAKSVPTKTYSNEVVTLWYRPPDVLLGSTDYSTHIDMWGVGCILFEMIAGRALFPGGTPTEQLGLIFRTLGSPRPDRHPTICEKPTFYPYANRHYNPDPLCRQIPRIDAHGFELLMKFLQYEGKDRVSAAEAVKHPFLRTIAVKCCHLRDEQSVLEADGIHIERELLASDHHHSSRRHHRGTLVKDKYRMHSSHHT

SEQ ID NO: 12447 - protein, 425 aa, Caenorhabditis elegans
MQIRVLCVSTADFSPKNLLGPSSLIFRVFFGGFLYANRIGCCLSTKSSPAEKIKPPDEIMAFHEYPVTQDYRISRKVLGVGINGKVVECEHRQSGDKFALKVLRDTQKARREVELHVMASGHGHVVSVHDVYKNSYNGVDCLLVVMENMKGGELFNRIQERGQKAFTEREAAGIVNEICSAVAHLHRMSIAHRDLKPENLLYVTTASNAALKLTDFGFAKKTDESEPQGLKTACFTPYYCAPEVLGTEKYDKSCDLWSIGVIMYILLCGYPPFYSQHGQPMSPGMKAKIKSGQYTFPSPEWDCVSEAAKDLIRKLLRTEPTERITIEQTMEHKWISHYRRVPDTPLFTSSNLNDQREQWTDMQDEMEATLASMRVGPENIQIKSLGDSNNKLLAKRRKGGASPKDDPMDDIKEEEKDDEEEKMIS

SEQ ID NO: 12448 - protein, 443 aa, Caenorhabditis elegans
MQIRVLCVSTADFSPKNLLGPSSLIFRVFFGGFLYANVKLEAPEAQKSTRGSFFSRIGCCLSTKSSPAEKIKPPDEIMAFHEYPVTQDYRISRKVLGVGINGKVVECEHRQSGDKFALKVLRDTQKARREVELHVMASGHGHVVSVHDVYKNSYNGVDCLLVVMENMKGGELFNRIQERGQKAFTEREAAGIVNEICSAVAHLHRMSIAHRDLKPENLLYVTTASNAALKLTDFGFAKKTDESEPQGLKTACFTPYYCAPEVLGTEKYDKSCDLWSIGVIMYILLCGYPPFYSQHGQPMSPGMKAKIKSGQYTFPSPEWDCVSEAAKDLIRKLLRTEPTERITIEQTMEHKWISHYRRVPDTPLFTSSNLNDQREQWTDMQDEMEATLASMRVGPENIQIKSLGDSNNKLLAKRRKGGASPKDDPMDDIKEEEKDDEEEKMIS

SEQ ID NO: 12449 - protein, 306 aa, Caenorhabditis elegans
MSTSASLSPAALQKRSDAQKFAIDLLIGGVSASVSKTVVAPIERVKILLQVQYSHKDIPADKRYNGIIDAFVRVPKEQGFVSFWRGNMTNVIRYFPTQAFNFAFNDLYKSILLKNMKRENNVLSYSVRTLVSGGLAGCSSLCIVYPLDFIRTRLSADINHHTKREYKGLVDCTMKTVKNEGFSALYRGFAISLQTYFIYRSVYFGLYDAIRNTINTDKKKLPFYASFAIAQGVTVLSSYLTYPWDTVRRRMMVKGQLSTSKAFSAARKIVHEEGVRGLYKGALANIFRSAGGALVMALYEEIHKHM

SEQ ID NO: 12450 - protein, 348 aa, Caenorhabditis elegans
MPLFKRRDGSGPAPNATIREKYDFRDVLGTGAFSKVFLAESKSDAGQMYAVKCIDKKALKGKEESLENEIKVLRKLRHNNIVQLFDTYDEKQFVYLVMELVTGGELFDRIVAKGSYTEQDASNLIRQVLEAVGFMHDNGVVHRDLKPENLLYYNQDEDSKIMISDFGLSKTEDSGVMATACGTPGYVAPEVLQQKPYGKAVDVWSIGVIAYILLCGYPPFYDESDANLFAQIIKGEYEFDAPYWDQISDSAKDFITHLMCCDPEARFTCQDALSHPWISGNTAYTHDIHGTVAVHLKKSLAKRNWKKAYNAAAAIRQLQMLRLSSNSNRLQKQASQQQPEPPTPAFHA

SEQ ID NO: 12451 - protein, 618 aa, Caenorhabditis elegans
MTVSEQLRNDLEDAANRMRISSIEMTCASKSGHPTSSTSAAEIMSTLFFSEMKYDVAEPKSASADRFVLSKGHACPILYAAWEEAGLLSHEQVLSLRKIDSDIEGHPTPRLNFIDVATGSLGQGLGVATGMAYVGKYIDKASYRVFCLLGDGESAEGSVWEAAAFASIYKLDNLVAIVDVNRLGQSQATSLGHDVETYKARFAAFGFNAIIVNGHNVDELLAAYETARSTKGKPTAIIAKTLKGKGIEGIENEDNWHGKPVPEGTVNAIKARFHGSQKGKLVAQKPINDAPAIDLHVGSIKMAAPEYKKGDKVATRAAYGTALAKLGDASPRVIGLDGDTKNSTFSDKLLKKHPDQFIECFIAEQNLVGVAVGAQCRDRTIPFTSTFAAFFTRATDQIRMAAVSFANLKCVGSHVGVSIGEDGPSQMALEDLAIFRTIPGATVFYPTDAVSAERATELAANTKGVVFIRTGRPALPVLYDNEEPFHIGQAKVVKQSAQDKIVLVGSGVTLYESLKAAEELEKEGIHATVIDPFTIKPLDGKTIAEHALKVGGRVVTTEDHYAAGGIGEAVSAALADYPTIRVRSLNVKEVPRSGPPDALVDMYGISARHIVAAVKNFQ

SEQ ID NO: 12452 - protein, 887 aa, Caenorhabditis elegans
MKIAIIGQSAFGVDVYKELRKNGHEIVVVFTIPDKNGREDLLAVEAAKDGVPVQKPSRWRKKNPETGKFETLPEMLELYKSFGAELNVLPFCTQFIPLEITEAPAKKSIIYHPSILPKHRGASAINWTLIEGDEEAGLSIFWADDGLDTGPILLQKKCKVEENDTLNTLYKRFLYPAGVAAVAESVELIATGKAPRIVQPEEGASYEPYITTKPELAQIDWSKTQRQLHNFIRGNDKVPGAWAVLNGEKVSFFGSKLWKPKKLPDDAVEVFVSEVPGGKVLVEDRGLLLPGSDGRWVIVDTVKIGTKTVPASKYGQGADQVQELVLTDEEKSTVAKLKKIWTGILKTQVSSDTDFFESGASSADVTRLVEEIKFNTGAELESGQIYAGPTLGENIDIVIRNLRGEGGISVTYDPIVLNVNNMELKFPHDQFIDGKFVGSSDGRTFKTINPATEKPICELPLATVADVDRAVRAAKKAFERGEWRQMSARERGKRLYKLAELMEEHKEELATLESLDAGAVYTLALKTHVGMSIDVWRYFAGWCDKIQGKTIPISNARPNKNLCLTLREPIGVVGLITPWNYPLMMLSWKMAACLAAAKIKLIEISGVINIVTGSGSLVGNRLTAHPDVRKIGFTGSTEIGATVMESCAKSNIKKVSLELGGKSPLIIFADADLEKAVKQACGAVFFNKGENCIAAGRVFIAKSIHDDFVKKLVEEAKQYQIGDPLDRSTAHGPQNHLAHLNKLVEYVEKAVAGGAKVEVGGKRLEREGLYFPPTILSNIDDENFAASEESFGPIMCVSSFDDDDIEDVLRRANDTEFGLAAGVFTRDSSKSLRVAEALHAGTVFVNTYQKTDVAAPFGGFKQSGFGKDMGEEALNEYLVTKTITIEY

SEQ ID NO: 12453 - protein, 1372 aa, Caenorhabditis elegans
MVVTRGLDNDVDDEREAWKQSILRAKDVMPEKVINTASGPLVALLEGTSGHHHWTETNHPRPTFCNYCREKLNGVPWHGYTCDICKVKAHRKCRDNLTEQCKWTNQSSIPQHLQFISPENSILPHQWMEGNLPMPSKCSVCEKPCGSVRKLIIFFLVPFEKKTSNFLQFQFKFLKKNKKMYDYRCIWCGCCVHDTCIGNLARACSLGHSALSVISPLAMKEVTPNGTAVLREEAYGGDSPGGSPLIVLINAKSGDSQGQRIIKKFRRILNPIQVFDIIATGPDFALTFFSHLESFRVLVCGGDGTVGWVLSAFDRLNLHSKCQLAILPLGTGNDLARVLGWGHAFYDDTLLPQVVRTMERAHTKMLDRWSVLAIEGPQADAVRRYEELVIEKVRTFLEAEQTWDIIHAANQLCTTIRDLVHSVSHTYSDLENNKLKLDDESRLGGSDTMTENCNTLLGKLDRLMKSLKEDANCLEESGFEPGDDDDCSTGDEMLKKRDSVVNRANSLKKAFREVISMAEKGIDQHYRDPNTACTKRERFRKKRSKTTPSVLTISHSNLSSSSACSPPCSPAGEDPPQDDQKEFRSASCKATFEISHSQSSSSAVLTALFNAQSARTYDELEKPSIGTVHPPTPGATREPSTAYDDDEENENVENRKEIDQKSNSKKSSVSTPEDITKGSPDRPRIYSDTTLNKNMEKMKSQSLHPICSSADKMKQSHSDSSLYADYEHLEGSSSGCGAGASGSTLSPARASDSATWSRIKERKRTVGSDLGLSSSSHLRSCRNMLSGFAGGSLIAEILLLNARVLSQMSSRRNSAANIANQIPTSDCQTPFTQYKEMCVMNNYFGIGLDAKIALEFHNKREESEKTRSRSKLFMWYGILGGKELMHRTYRNLEQRIKLECDGVPIDLPSLQGIVILNIPSYSGGANFWGRNKDGPEFTVQSFDDRILEVVALFGVIHVATSRVPNAVRLQNHRIAQCRHVRIVILGDEPIPVQVDGEPWLQPPGIMQIVHKNRAQMLARNPVFDATLKKWEEQKEKASTTTAPSTPTALGAPTSDIISFLTRAREFLRLIEGEIARLGVSSVLLQSLDDANAIVKGGASGEEDPEAIDDLEEREETVASVERVVELLEDHFGFPERTRAPVGQPKLGPTPHFNFEIHGDDPDHWRYIINSIRQDMDREEAAIREARKQDLIAGKPKRSRFTAWFHKRFGTRSAPFAFANIPYWTSEEVCAWLSSIGMSEYGSTFRKNDIQGSELMHLERSDIMDIGITKIGHVKRLQSAIVDLRAQNQRARRAQARKKRVAKDYKPDHSGPSGAGGAVDKRKESSAERYADGQPSTSSTGATTSSGKTRRIPPKDGESAPAVMQMDPASTDC

SEQ ID NO: 12454 - protein, 1321 aa, Caenorhabditis elegans
MVVTRGLDNDVDDEREAWKQSILRAKDVMPEKVINTASGPLVALLEGTSGHHHWTETNHPRPTFCNYCREKLNGVPWHGYTCDICKVKAHRKCRDNLTEQCKWTNQSSIPQHLQFISPENSILPHQWMEGNLPMPSKCSVCEKPCGSVRKLIIFFLVPFEKKTSNFLQFQFKFLKKNKKMYDYRCIWCGCCVHDTCIGNLARACSLGHSALSVISPLAMKEVTPNGTAVLREEAYGGDSPGGSPLIVLINAKSGDSQGQRIIKKFRRILNPIQVFDIIATGPDFALTFFSHLESFRVLVCGGDGTVGWVLSAFDRLNLHSKCQLAILPLGTGNDLARVLGWGHAFYDDTLLPQVVRTMERAHTKMLDRWSVLAIEGPQADAVRRYEELVIEKVRTFLEAEQTWDIIHAANQLCTTIRDLVHSVSHTYSDLENNKLKLDDESRLGGSDTMTENCNTLLGKLDRLMKSLKEDANCLEESGFEPGDDDDCSTGDEMLKKRDSVVNRANSLKKAFREVISMAEKGIDQHYRDPNTACTKRERFRKKRSKTTPSVLTISHSNLSSSSACSPPCSPAGEDPPQDDQKEFRSASCKATFEISHSQSSSSAVLTALFNAQSARTYDELEKPSIGTVHPPTPGATREPSTAYDDDEENENVENRKEIDQKSNSKKSSVSTPEDITKGSPDRPRIYSDTTLNKNMEKMKSQSLHPICSSADKMKQSHSDSSLYADYEHLEGSSSGCGAGASGSTLSPARASDSATWSRIKERKRTVGSDLGLSSSSHLRSTQYKEMCVMNNYFGIGLDAKIALEFHNKREESEKTRSRSKLFMWYGILGGKELMHRTYRNLEQRIKLECDGVPIDLPSLQGIVILNIPSYSGGANFWGRNKDGPEFTVQSFDDRILEVVALFGVIHVATSRVPNAVRLQNHRIAQCRHVRIVILGDEPIPVQVDGEPWLQPPGIMQIVHKNRAQMLARNPVFDATLKKWEEQKEKASTTTAPSTPTALGAPTSDIISFLTRAREFLRLIEGEIARLGVSSVLLQSLDDANAIVKGGASGEEDPEAIDDLEEREETVASVERVVELLEDHFGFPERTRAPVGQPKLGPTPHFNFEIHGDDPDHWRYIINSIRQDMDREEAAIREARKQDLIAGKPKRSRFTAWFHKRFGTRSAPFAFANIPYWTSEEVCAWLSSIGMSEYGSTFRKNDIQGSELMHLERSDIMDIGITKIGHVKRLQSAIVDLRAQNQRARRAQARKKRVAKDYKPDHSGPSGAGGAVDKRKESSAERYADGQPSTSSTGATTSSGKTRRIPPKDGESAPAVMQMDPASTDC

SEQ ID NO: 12455 - protein, 509 aa, Caenorhabditis elegans
MILFIVLSIVSIYLFDLFYWKRRNLPPGPLPLPLVGNLHMMSDDVKPGYSLFSNLKEQYGHVYTFWMASLPIVHVTDWNLIKQHFIKDGGNFVGRPEFPMSIELRQGPYGIIESHGDRWVQQRRFALHVLRDFGLGKNLMEEKVLGEVTAMLDRLRKTMDEVDMQSVFDASVGSVINNLLFGYRYDETNIAEFLDLKEKLNNHFQLAAKPIGGLIGMNPWLGYFPYFSGYKNGLFYELVFIFKMCFIVMIQNWMGLVEMFRKQANEKLATIDYESDDYSDYVEAFLKERKKHENEKDFGGFEMEQLDSVCFDLWVAGMETTSNTLNWALLYVLRNPEVRQKVYEELDREIGSDRIITTSDKPKLNYINATINESQRLANLLPMNLARSTTKDVEIAGYHIKKNTVIIPQISLVLYNPEIFPEPYEFKPERFLESDGSLKKVEELVPFSIGKRQCPGEGLAKMELLLFFANLFNRFDIQLHQSNPNPSVEKEFGVTMKAKSYRLKLKDRH

SEQ ID NO: 12456 - protein, 250 aa, Caenorhabditis elegans
MEAVPKDVRVKMAKRKLRRKFEITASETGYYNFGAKLRVWMLLPISILFSIIPIASSTFGGCCSMGPPPCPPPPPPMCAPPPLPCPPPPICPPQFCPPPPMCPPPPPPPPPPMCPPPPPPMPSYSPCQSYAPAPVFNQYAMQPANDCCCRCGSPCRFMARHRTHGSKLFTTEDPEEDPTCNSKKLRRVMERNMNGDPSISKRAIQKAVEEKMFGKFNVICARGDFSYVAYTETYCQVANDDVTCYAFRPM

SEQ ID NO: 12457 - protein, 118 aa, Caenorhabditis elegans
MSFLHLTCESSTESTMSGRGKGGKGLGKGGAKRHRKVLRDNIQGITKPAIRRLARRGGVKRISGLIYEETRGVLKVFLENVIRDAVTYCEHAKRKTVTAMDVVYALKRQGRTLYGFGG

SEQ ID NO: 12458 - protein, 352 aa, Caenorhabditis elegans
MGHCTSKDQKEGKRLNRRIDEQIKKDQSMSLRIIKLLLLGAGESGKSTILKQMRILHKDGFSQQDLEMIRPVVYSNCIHSMLSILRAMFHLQIEYGEPDRVRDSQLVFATVHANKEELTEELAAAMQRLWHDPGVRECYRRSNEYQIDDSAKYFLDNLPRLSSPNYVPSEQDLLRTRIKTTGITEVLFELKGLTFRVIDVGGQRSERKKWIHCFDNVNAIIFISSLSEYDQTLREDNCTNRMQESLKLFDSICNSPWFADIHFILFLNKKDLFAEKIVRSPLTVCFPEYKGQQNQTECINYIQWKFEQLNRSSQREIYCHHTCATDTNNVQFVLDACLDMIIAKNLKSMGLC

SEQ ID NO: 12459 - protein, 176 aa, Caenorhabditis elegans
MSENELSAEDTAFLEKAFELAQEALDEDEVPVGCVFVVNGTEIGRGRNRVNETGDPTRHAEMVAVTEMWKEHGTGCEDLLKKSTLYVSLEPCIMCSSAMYQLGIRKMVYGAENPRFGGVRSVGSAEKYRMEDNVQIVAGIWSERSVAMLKTFYEKLNPFAPPEKRKTKKPKLDEIK

SEQ ID NO: 12460 - protein, 313 aa, Caenorhabditis elegans
MTGGGDSKPIEKKKEDKKGFDTRKFLIDLASGGTAAAVSKTAVAPIERVKLLLQVQDASLTIAADKRYKGIVDVLVRVPKEQGYAALWRGNLANVIRYFPTQALNFAFKDTYKNIFQKGLDKKKDFWKFFAGNLASGGAAGATSLCFVYPLDFARTRLAADVGKANEREFKGLADCLVKIAKSDGPIGLYRGFFVSVQGIIIYRAAYFGMFDTAKMVFTADGKKLNFFAAWAIAQVVTVGSGIISYPWDTVRRRMMMQSGRKDVLYKNTLDCAVKIIKNEGMSAMFKGALSNVFRGTGGALVLAIYDEIQKFI

SEQ ID NO: 12461 - protein, 299 aa, Caenorhabditis elegans
MLEVVLQVLSISAITTTIALFFCGIPICMQIRRQGAVGDISGVPFLMGVLGGSFWLRYGLLKMDYVMIIVNVVGVACMAFYCVFFLIYSLPKKTFTCQLILVTSTIGGMVLWIALKPNLDYLGVICMTFNIMNFGAPLAGLGVVLKNREVSTLPLPMCVANFLVSSQWCLYGNLVSDIYIIIPNGIGMFLAIVQLALFVVLPIRENEKSPLEKLASWFTGRDSKVKDLERGDCIVSSPPSSPQKVPNETRSDVEDKFDKLMAETSSTIPSDSRRGSMGSPPSYKSRSSSDPDLSSIQSP

SEQ ID NO: 12462 - protein, 325 aa, Caenorhabditis elegans
MVQEQMKLTGTLEGHTGWVTQIATYTRNDKTTVLSSSRDKTILVWDVDSVAPVDEGPIGRPVRSLTGHNHFVSDVVISSDGQFALSGSWDKTLRLWDLNQGVSTRQFISHTKDVLSVAFSADNRQIVSGSRDKSIKLWNTLAQCKYTITDDCHTDWVSTVRFSPSNRDPVIVSAGWDKVVKVWNLGNCRLKTNHIGHTGYVNTVTVSPDGSLCASGGKDGQAMLWDLNEGKHLYTLPGNDVINAMSFSPNRYWLCAAVGSSIKIWDLEDKKEIEELKPEIASSGSSRGSSPQCISLAWSQDGQTLFAGYTDNIIRVYQVSIRASN

SEQ ID NO: 12463 - protein, 248 aa, Caenorhabditis elegans
MSDTVEELVQRAKLAEQAERYDDMAAAMKKVTEQGQELSNEERNLLSVAYKNVVGARRSSWRVISSIEQKTEGSEKKQQLAKEYRVKVEQELNDICQDVLKLLDEFLIVKAGAAESKVFYLKMKGDYYRYLAEVASEDRAAVVEKSQKAYQEALDIAKDKMQPTHPIRLGLALNFSVFYYEILNTPEHACQLAKQAFDDAIAELDTLNEDSYKDSTLIMQLLRDNLTLWTSDVGAEDQEQEGNQEAGN

SEQ ID NO: 12464 - protein, 125 aa, Caenorhabditis elegans
MVADHFRYLVQYDDINREEHAHKSRIAYQEALGIAKDKMQPTHPIRLGLALNASALNFDVLNLPKEANEIAQSALDSAHRELEKMKSSLDSYDISNLKRARTLYDLLKSTHEQRVDGKEGEEADN

SEQ ID NO: 12465 - protein, 785 aa, Caenorhabditis elegans
MGASHLHDDPRPGSPVDHQPTTWGGIIKKWPKQTFLIVGNELCERFSFYGMRAVLTLYFFNILNFSQSFSTVLFHAFTVICYSSPLLGSILADGYIGKFWTIFFISIFYACGQILLAFSSIAPSGSSHHPLLDLLGLLIVGLGTGGIKPCVSAFGGDQFPAHYTRMISLFFSMFYFSINAGSLISMWLTPYFRSMSCFGHDSCYPLAFGIPAILMIVATLVFMAGSFWYKKVPPKENIIFKVIGTITTALRKKASSSSTHQRSHWLEYSLDGHDCALSTECKNLHGNCAQRRYIEDIKRLFRVIVMMIPVPMFWALYDQQGSTWVLQAVGMDAKVFGFEILPDQMGVLNAFLILFFIPIFQSIVYPTIEKLGFQMTMLRKMAGGGILTAVSFFVCGIVQLFVNPTLPYIPMANEAHLTIINTIPSCDFNVLIDSREPFDLLRKSGIAPDDSVRKPISFTGDDFFQPNITFDNLAPNCPKFTAEPMLAPATSYVLTLSPNGWAYNAVRPEKPKSGKGELSMGLNLIVPCDKIPSNVTWEQCNGTEGYSGAIALCKVESDVITDNNNVCDPTAKGKFYVLSNANPLDVHDFSKKSTVTAFGRTYSPIEMKPGTYRLFYTDDSRTHFTPLNLPPVQQDHMGGQYLITVSTRSKNDSEVLATTESLVSYNRVSILWQIPQYVILTAGEVLFSITGLEFAYTEASPQLKSVVQALWLFTTAIGDLIVVVIFMLNIFSDVAVQMFVFGGIMLFVIFVFILLAVFYYEYADYSNESEVLTEKMIVDDDHTRI

SEQ ID NO: 12466 - protein, 377 aa, Caenorhabditis elegans
MFPQTTMDHILHPTPREGYYVVELNRSVWVVPNYYINLTPIGTGAYGTVCAAECTRSGTRVAIKKFNRPFQSIIHARRTYRELRLLRCMCHENIIDLLDVFTPNENVNDIEDVYFVSMLMGADLSNILKIQRLNDDHIQFLVYQILRGLKYIHSADIIHRDLKPSNIAVNEDCELKILDFGLARQTDSEMTGYVATRWYRAPEIMLNWMHYTQTVDVWSVGCILAELITGKTLFPGSDHIDQLTRIMSVTGTPDEEFLKKISSEEARNYIRNLPKMTRRDFKRLFAQATPQAIDLLEKMLHLDPDRRPTAKEAMEHEYLAAYHDETDEPIAEEMDLNDDVRADTIDEWKKIIWEEISDFQKNVAFADEEEDEEKMES

SEQ ID NO: 12467 - protein, 474 aa, Caenorhabditis elegans
MASVPSSSSLPVSHVRRHEDVSTPSAPPTKRSNNQSQPPESYEPNTWLQQQREQEQQKKLAAENIKKQSIEATGNNEMVGEEEEDILSKPCGPHKRRFQFVMIRNITFAIPEGYDVEPNSIEYLGGGSFGNVIKTSAVCRDGLRRYVAIKKMREPFFDPHHARRIFRETKLLQLMRHDNIICALDIYTPDEENDFRDVYVVTEFAGRSLYQILKQQRDYGRRVLTDEHIKFIIYQIIRALKYIHSANIIHRDLKPGNLALTDDSDLMILDFGLARSLEKKDTSLTQYVQTRWYRSPEVIYWKIDSYTNLADMWSLGCIAAELLTGEPLFPGDEPNAQYQRITQLCGSPDEELLTKIENDNSSAIKAVIQSYTTHKRRNFRDVFSAHNPSEDFIDLLEKLLVLDPEKRITVEEAIQHPYLAEFSLPEDEPRADHIFDLDDSQARTRFEWRDAVWKEIMNYKRLSSSPLIPGEADR

SEQ ID NO: 12468 - protein, 743 aa, Caenorhabditis elegans
MDSDYIFHNGDDIRNMGLEEMRRQKVLLASELKAIDAQISDLAFNNYGTYADAGRATHDCSKTFGEMRDKTVNLSDQAEELTSAFVEFRAKAKQLSEEQDLVRKALDKSNPIWELLTLPSRMDICIRAGYYDLAYTLTNYGLQLQQQTQLYRNPLIKKVADHLVEARAYLLEELFNKFAGPLDLAESIKVVNNVRKMPSLTANQLRIAVLQHRDIYLEKQILDISGNVDMIVQAIEIYRTSMYDTLVLYLAVFPENEVVRKNPNADPRWESWPVLPPNSILSQWVISNVKKMLDLITKADVKSAVDLSAVWTKLMAMASSFGRMGIDFRPLIAGKLTKLIEQRFRQNVQEATSRLTGSSRDIVMIGIDPASLPQFETAPDSPPVAAAELSLWDDMTIYTNSVVDALNGLRFILTPVVLSTVVVSLRDSIRSILTWLASSHSNSANFSRAVRIVCTSVAPFFEKCVAFFFPPATVSKIFGSSISKRQYLQFIELDMKQLAASCDGAEKIEEIVKPLLQKRTLEEIGLENVLKPTKPEEEKTKFFLEETVEDGPGLAEPQEEASESVKEQETTSELEKKHGTDFETAETQEMVSEPVKEHETTSELTKEQEPAFEPEKLHETPPEPMEPQNFGESEAKAAHNPEAHLELGETSENQEIREQEHKEVVITSTEPEFHEIDLNSAVLIPKIAVEPQLDPISEYLTELTQDDPIEEEEGWGWGDDDGEEQEISSKEVESPKEKCKKDD

SEQ ID NO: 12469 - protein, 310 aa, Caenorhabditis elegans
MTRHGKNSTAASVYTYHERRRDAKASGYGTLHARLGADSIKEFHCCSLTLQPCRNPVISPTGYIFDREAILENILAQKKAYAKKLKEYEKQVAEESAAAKIAEGQAETFTKRTQFSAIESTPSRTGAVATPRPEVGSLKRQGGVMSTEIAAKVKAHGEEGVMSNMKGDKSTSLPSFWIPELNPTAVATKLEKPSSKVLCPVSGKPIKLKELLEVKFTPMPGTETAAHRKFLCPVTRDELTNTTRCAYLKKSKSVVKYDVVEKLIKGDGIDPINGEPMSEDDIIELQRGGTGYSATNETKAKLIRPQLELQ

SEQ ID NO: 12470 - protein, 751 aa, Caenorhabditis elegans
MAKSVSPEEQAAAQAADEEKTKEELEWAEKGSLLCRIKNQKVKEMALVTIKSKQFLNYYSSYWFNFVPNALKSVALSELLEVRSGYQTDNLQRASKKYEFQELAPESRCFSVIFSHAKFLHKSVDFSADSKETRDKWVSVLTHLISVAKHQRVVFNETAWLIDKFQQADTNKNGLLSFDEVWNLLKRMNLQISERYAKAIFRESEFENSRDNKLNEKEFLNFFERLTDRPDLRFVMTQASSDNVETLTVADLQRFLTEEQGFENVDLKKAEQILTTFEQTVQDKQKEKLMGLMGMRRLMQSRWGNVFKPGHESIFQDMDQPLTHYFVNSSHNTYLTGLQVKGEATVEGYISALRKGARLLELDLFDGEHGEPVITHKRTFIESITLRNSLEAIKRTAFETSPYPVILTLENHVGFVQQAVMADLFKEILGDSLYIPPKDSHRHPLSSPNKLKRKFLLRGKKIILEEDIEEPDEDDSPTDKDKHHVHPHPVAPELSALIGLPSVKLSHNIYQDVNKHPFDGSPSLSENKVYTMFEAAVPIFTYTAERLVKSYPKGLRQDSSNMHPMVSWLCGIQSVAMNFQTAGEELDLNAGLFRINGNCGYVLKPSCLLDGVDPRSMAKPKLKLGIGLFSAQYLPKSEPGKEIIDPYVSVQIFGIPRDETKAKTRIIKDNGFNPEWRDNFYFTLSCPELAIIRFCVKDFDSTSSNDFVGEFSIPVMSLRTGFSQIQLNTGYQHTLDPSASLFVRIAMEEEY

SEQ ID NO: 12471 - protein, 342 aa, Caenorhabditis elegans
MSPLPENTLIGMCNPLLDIQTTVEKAFLDKWGLKENDAILCDDKHNDMFTELTRDFKVEYIPGGAAQNSLRVAQWILNAPNRTVFFGAVGKDQYGDLLASKAKEAGVNVHYQINETVKTGTCAALINGTHRSLCAHLAAANTFTQDHLQKEENQKIIEQAKYFYVTGFFITVCPPAILQLASHSAEFNKTFTLNLSAPFISQFFFDKLSEIIPLVDVLFGNEDEAAAFAKANGWETTCVKEIALKAAALPKKSTKPRLVVFTQGPEPVIVVEGDKVTEFPVTRLPKEEIVDTNGAGDAFVGGFLSQFIQGKGVEASVTCGSYAAQEIIKKHGCTVPSVCKYH

SEQ ID NO: 12472 - protein, 140 aa, Caenorhabditis elegans
MAGGKGKAGKDSGKSKSKVVSRSARAGLQFPVGRIHRFLKQRTTSSGRVGATAAVYSAAILEYLTAEVLELAGNASKDLKVKRITPRHLHLAIRGDEELDTLIKATIAGGGVIPHIHRYLMNKKGAPVPGKPGAPGQGPQ

SEQ ID NO: 12473 - protein, 194 aa, Caenorhabditis elegans
MIAEAAAVEVQANEAPVVAPIMYKVESNDGKVFEISDEAVKQSNILSNLISTCAPEDVASMDPIPITNVTGNILKMVIEWCEKHKGEALPVEDDSVPKNINVPEWDTNFLKIDNEVLFDLIVACNYLDVPGLMNYGCKMVANMAIGKSPDELRIIFAIPTDEEDEAAERAAKEKAEAEKKAIADKDAAEPSTSK

SEQ ID NO: 12474 - protein, 194 aa, Caenorhabditis elegans
MIAEAAAVEVQANEAPVVAPIMYKVESNDGKVFEISDEAVKQSNILSNLISTCAPEDVASMDPIPITNVIGNILKMVIEWCEKHKGEALPVEDDSVPKHVNVPEWDTNFLKIDNDVLFDLIVACNYLDVPGLMNYGCKIVAMMAIGKSPDELRIIFAIPTDEEDEAAERAAKEKAEAEKKAITDKDAAEPSTSK

SEQ ID NO: 12475 - protein, 192 aa, Caenorhabditis elegans
MSAEVAAVEIQEAPVAAPIMYKVESNDGTVFEISDEAVKQSNTLSNLISTCAPEDVASMDPIPITNVTGNILKMVIEWCEKHKGEALPVDDDSVPKHITVPEWDTNFLKIDNEVLFDLIVACNYLDVPGLMNYGCKMVAMMAIGKSPDELRIIFAIPTDEEDEAAERAAKEKAEAEKKANAEKDAAEPSTSK

SEQ ID NO: 12476 - protein, 172 aa, Caenorhabditis elegans
MSAPIVDAPAAEIVYKIISSDGVVSKMSEKAVQQSKTLSNLIENLGYTIENIETRDPIPVTNVNGKTMAKVAEWCEKHKADAIPEDNMNVLKTLTIPEWDQKFLKIEDEALFDLILASNFLDIKGLMYFGCKTVSNMAKGKTTAELREIFGINTDEQDAAEETAQRAAAEVA

SEQ ID NO: 12477 - protein, 172 aa, Caenorhabditis elegans
MSAPVADAPAAEIVYKIISSDGVVSKMSEKAVQQSKTLSNLIENLGYTIENIETRDPIPVTNVNGKTMAKVAELCEKHKADAIPEDNMNVLKTLTIPEWDQKFLKIEDEALFDLILASNFLDIKGLMYYGCKTVSNMAKGKTTAELREIFGINTDEQDAAEETAQKAAAEVA

SEQ ID NO: 12478 - protein, 339 aa, Caenorhabditis elegans
MISEATRRVLHDLKALTESRKQMEKAGLLSPQELSRKICIEEQMKFEIAECLRKAQEKADEKKRENEKVIGQLTYRLERKIREMNRLKEEEEYMEEVDKRYEARLNKEREEKMKNGLEIIKIDQLEDWNVDGKIVLIIVKHSNKNKSYIKFVFSNFMAMVKSPKSSKKAAARAAKARETAETNAFLDSIFILISSDGEKFQTDGHCIRHSKVLMQASKSLETPDTPIQVEKVQGDTLNRVLEWCNNHRDDGKYVSQCGPSLRLPQWDFRWLKDLDNQELVDLINASNDLQMQQLMDYACKTVANMAKGKNPAQLRELFGILTDEEEAELALNEPGPSTA

SEQ ID NO: 12479 - protein, 313 aa, Caenorhabditis elegans
MSGGGDSKPIDKKKEDKKGFDTRKFLIDLASGGTAAAVSKTAVAPIERVKLLLQVQDASLTIAADKRYKGIVDVLVRVPKEQGYAALWRGNLANVIRYFPTQALNFAFKDTYKNIFQKGLDKKKDFWKFFAGNLASGGAAGATSLCFVYPLDFARTRLAADVGKANEREFKGLADCLVKIAKSDGPIGLYRGFFVSVQGIIIYRAAYFGMFDTAKMVFTADGKKLNFFAAWAIAQVVTVGSGILSYPWDTVRRRMMMQSGRKDVLYKNTLDCAVKIIKNEGMSAMFKGALSNVFRGTGGALVLAIYDEIQKFI

SEQ ID NO: 12480 - protein, 390 aa, Caenorhabditis elegans
MEVDLPVHNEYDASRFHQVTIRDPIAGADSTFTIPTRYVNLSFLNAGAQGTVVMADDLVTTQRVAIKKMQQPFVMTMSAKRAYREFILLTTIKHPNIIRLLNAFTPDTSLSTFREVYLVMELMTHNLHEVIHRLRLDHKTLSFFVYQSLCAIKHLHNSGVIHRDLKPSNIVVNDRCVLKVLDFGLARKKNVDTSMRMSDYVVTRYYRAPEVILGLPYSEKVDIWSVGCIFAEMINHTVLFPGKDRIDQWTKIYSVLGTPDDHFISQLGQSAAMYVRSLPRHQARAFSEIVPDTNFLPETENPRVHLTPHVARDLLFNMLKINPEERYSVEDALNHPYVKLWFKDDEVNAPASENRYDQEIDFADKTLIEWKELIFNEVQRYQADHDIFTG

SEQ ID NO: 12481 - protein, 518 aa, Caenorhabditis elegans
MMNASTKFSDNYDVKEELGKGAFSVVRRCVHKTTGLEFAAKIINTKKLSARDFQKLEREARICRKLQHPNIVRLHDSIQEESFHYLVFDLVTGGELFEDIVAREFYSEADASHCIQQILESIAYCHSNGIVHRDLKPENLLLASKAKGAAVKLADFGLAIEVNDSEAWHGFAGTPGYLSPEVLKKDPYSKPVDIWACGVILYILLVGYPPFWDEDQHRLYAQIKAGAYDYPSPEWDTVTPEAKSLIDSMLTVNPKKRITADQALKVPWICNRERVASAIHRQDTVDCLKKFNARRKLKGAILTTMIATRNLSSRNLLNKKEQGPPSTIKESSESSQTIDDNDSEKGGGQLKHENTVVRADGATGIVSSSNSSTASKSSSTNLSAQKQDIVRVTQTLLDAISCKDFETYTRLCDTSMTCFEPEALGNLIEGIEFHRFYFDGNRKNQVHTTMLNPNVHIIGEDAACVAYVKLTQFLDRNGEAHTRQSQESRVWSKKQGRWVCVHVHRSTQPSTNTTVSEF

SEQ ID NO: 12482 - protein, 726 aa, Caenorhabditis elegans
MSKYEVLQGFYAVHDELGSGGFGKVRLATHLLTNQKVAIKIIDKKQLGHDLPRVQTEMDALRNLSHQNICRLYHYIETEDKFFIVMEYCSGGEMFDYIVRKERLEESEARHFFRQLVSAIAFVHSQGYAHRDLKPENLLLTEDLHLKLIDFGLCAKTEKGRIDKHNLDTCCGSPAYAAPELIQGLQYKGNEADVWSMGILLYTLLVGALPFEDDNMQIMYKKIQSGCFYEPEFLSPLSKQLLRAMLQVVPERRISVKKLLEHDWLNHKYTQPVKWNTIYDKNFIDRDVARVMSKYYGFESTDKMIEKIKEWNFDYMTSTYYALLHRKRNGMEIILPMVRNSTNTAPPNVQNILCSPTIHASLENNLDKSGLEDDDSDPSSISSSSDISARLKKNCVVSDESSSSRFVKPMSPAAEKDKKMSYVNAMLTMPSQFTGRSPLRIPESPMSVRSSDSASLGSAATPSRGGVKDNDKENASTGKNYRMGASTCKSRGPLKITGVGKAENVTIKTQYLTLKISRNENYKEGTMKSVYTTPNTRPTLRGLFSPGNAEHKKRQRARSSDRASIGMPPGSPVSIGSAHSANNADGRTPRSRIKTNRLPQRVFTSLERKKEKLITLLTPRKMQRDSPQVLKDVKNMVNVSMTASQDPEEVRNLLKKVFDDERMRYELNGWKFLATQETVHGWMTVELEIVRLQMFDKVGIRRKRLKGDAFMYKKVCEKILQMAKIE

SEQ ID NO: 12483 - protein, 471 aa, Caenorhabditis elegans
MSPNCGLKCHGGPGYASPADAIKGPREEVLFVTAPNAADGPDAIFTVDVNPESDTFCQVISRVDVPHIGDEVHHTGWNACSSCHDKPTEKRSHLIVPCLNSDRIYIINVENERKIYLEHTIEPSKLHSLNLSFPHTSHCLADGNIMISTLGEANGTPSGNFLLLDGKTFEPKGTWPADEKTVPFNYDFWYQPRRNVMISTEWGSPNHIKKGFNPAHVGEGLYGNSVHIFEWDSKKYLQTIDLPQPLGALPLEVRFLHEPTSEHAFVGCALGSGIFRIHPVEENSTTHAATLVAFIPSKKVSGWALPEMPALITDILISMDDRFLYVSCWLHGDIRQYDISDPLKVKLNSQVYIGGSVHTESNVKVLEGEKPIEALYVKGRKIEGGPQMLQLSLDGKRLYVTTSLYKKWDDQFYPEHVKSGATMVQVNIDPESGKMEINRDFLIDFGKIEGGPYLAHEMRYPGGDCTSDIWI

SEQ ID NO: 12484 - protein, 419 aa, Caenorhabditis elegans
MSNRNGGGGGGDYQDVIESLRRTQLIFEEDDNNSSDSAPQANHLSRHQTSNSLVEDMVNHSNGNPPPVPPGITQQQCQIGLTPRMSASPPSAVSTISGTAVLGKTMARVQSNPPGSIPHNTTTTAQGIQSVAPHIPIGGGGATDDSSAEILSVFECPVCLEYMLPPYMQCSSGHLVCSNCRPKLQCCPTCRGPTPSVRNLGLEKIANTVRFPCKFSTSGCPLNFHHADKTEHEELCEFRPYCCPCPGASCKWQGGLSDVMEHLKKIHKSITTLQGEDIVFLATDINLPGAVDWVMMQSCFDYNFMLVLEKQEKYDPAQPTQMFYAVVQLIGSKKEADNFVYRLELSASRRRMSWEATPRSIHEGVVVAIQQSDCLAFDSNAAQLFAENGNLGINVTISRIDTPQRRHPNELENSDLEYD

SEQ ID NO: 12485 - protein, 317 aa, Caenorhabditis elegans
MLRVTTSIRKTTKNAVGPRTNLEEVLNCIAMAEDIYNYLVHHEKKYVLDDSFINGGNVNSKMRRILVDWLIQVHLRFHLTPETLHLTIFVLDRIIVKNIVSKAEFQLLGVAALFVASKFEDIYLPDILEYEMITDNTFSKKQIMAMEQTILNALNFDLSCPSSLVFLRCISKTLTENDVNPIDKEAFYYVHNISKCLGELALLDSVMSTVPRSHVASASMIITLNVITVDGINPKTAASMIRKQLGASKQDIYDAIALLAQVAYKNFRHQKLCAIREKYQSSKFGRVSYLMTDEILEKIHRMGRNVEASEAETSEME

SEQ ID NO: 12486 - protein, 234 aa, Caenorhabditis elegans
MTDLLLDPAIRTWVFLPIVVITFFIGILRHYVSLLLMNKKKVELENIADGQYLLRARLLRENGRFLPKTSFNARRQYLCAEETGYLSKAQQRPAKGPNPMDPSQMTEMLKGNMMNMIPMIVVGGWINWTFSGFVTTRVPFPLTLKFKAMLQRGVDLVSLDSAWVSSASWYFLCMFGLRSIYTLVLGSENAADQSKAMEDQMAMTGSAVNPQADPRAAFKGEWEALQMIQHQFAL

SEQ ID NO: 12487 - protein, 172 aa, Caenorhabditis elegans
MSDISAAFAQHEITPKIIENAPKQKLHLCWDGIQVEPGMTMQVRNLKNAPRWALPGADPESIYTVLMIDPDNLSRKNPSVAEWLHWLVCNIPASNIIDGINGGQHQMAYGSPAPGPRTDLHRYVILMWEHAGRRISVPKPSSRAKFNVKQFIEKNKLGDPIAGNFFLAQHEG

SEQ ID NO: 12488 - protein, 361 aa, Caenorhabditis elegans
MLRATNNRRTSNNVEKDSLQMAKHGNGPLKPVNAQGLQTKREAREILALKPSNPAPVETAQKSQRINLQDAETKCLAMADDIYKYLVHHEKKYLLEECFMEGGEPTPKMRRILVDWLVQVHVRFHLTPETLHLTVFILDRMLQKKVTSKADLQLLGISAMFVASKFEEVYLPDIHDYEFITENTYSKKQILAMEQTILNSLNFDLSCPSSLVFLRCLSRILSENDASPIDNQAFCYTYNISKCLGELALLDSVMASTPRSHIASASMIIALEVHPVDGIEAENAVSVICKQLGASKKVIEDAVALLAEVSYKNFKQGKLVAIKNKYQSSKLAQVSNLMTDDVLEKINRMGQNAKVDASEME

SEQ ID NO: 12489 - protein, 375 aa, Caenorhabditis elegans
MNLPSKFHQVTITDPIAGAGITFTIPTRYVNLKFLNVGAQGIVVMADDLVTTQRVAIKKMQQPFLLTMSARRAYREFILLTTLKHPNIIRLLNAFTPDTSLSSFQEVYLVMEFMTHNLHEVIHRLRLDHETLSFLVYQSLCAIKHLHNLGFIHRDLKPSNIVVNERCVLKVLDFGLARRRNVDMRMSDYVGTRYYRAPEVILGLNYSEKVDIWSVGCILAEMINHTVLFPGKDIRDQWTQISSVLRTPDDHFINQLEPIGAVYVRSLPQHLARAFNEIVPDSNFLPETENPKDHLTLHMARDLLFNMLKINPEERYSVEDALNHPYTMDDEVNAPASEIPDDEVNDIDDWTLIEWKRLIFNEVQGYQTDHDIFNE

SEQ ID NO: 12490 - protein, 667 aa, Caenorhabditis elegans
MSSRLFVFFLICYATADKIEKELISDGFQLFTWKWDDVHHVYVITVWLLIASLAKILFNLMKPISKWCPDSSLLIIVGLALGWILHQTSLSGATLDSHTFFLYLLPPIIFDAGYFMPNRALFENFDSVLVFSVFGTIWNTFAIGGSLLLMAQYDLFTMSFTTFEILVFSALISAVDPVAVIAVFEEIHVNEFLFINVFGEALFNDGVTVVLYQMFKSFALIGSENLSVLDYATGGLSFFVVALGGAAVGIIFAIAASLTTKYTYDVRILAPVFIFVLPYMAYLTAEMVSLSSIIAIAICGMLMKQYIKGNVTQAAANSVKYFTKMLAQSSETVIFMFLGLSTISSQHHFDLYFICATLFFCLIYRAIGIVVQCYILNRFRAKKFEMVDQFIMSYGGLRGAIAYGLVVSIPASITAKPMFITATIAVIYFTVFLQGITIRPLVNFLKIKKKEERDPTMVESVYNKYLDYMMSGVEDIAGQKGHYTFIENFERFNAKVIKPVLMRHQKRESFDASSIVRAYEKITLEDAIKLAKVKNNIQNKRLERIKSKGRVAPILPDKISNQKTMTPKDLQLKRFMESGENIDSLYTLFSDLLDRKLHEMNRPSVQITDVDGQDDIQDDYMAEVGSRSNLSAMFRSTEQLPSETPFHSGRRQSTGDLNATRRADFNV

SEQ ID NO: 12491 - protein, 647 aa, Caenorhabditis elegans
MGHEYDIEELFTWKWDDVHHVYVITVWLLIASLAKILFNLMKPISKWCPDSSLLIIVGLALGWILHQTSLSGATLDSHTFFLYLLPPIIFDAGYFMPNRALFENFDSVLVFSVFGTIWNTFAIGGSLLLMAQYDLFTMSFTTFEILVFSALISAVDPVAVIAVFEEIHVNEFLFINVFGEALFNDGVTVVLYQMFKSFALIGSENLSVLDYATGGLSFFVVALGGAAVGIIFAIAASLTTKYTYDVRILAPVFIFVLPYMAYLTAEMVSLSSIIAIAICGMLMKQYIKGNVTQAAANSVKYFTKMLAQSSETVIFMFLGLSTISSQHHFDLYFICATLFFCLIYRAIGIVVQCYILNRFRAKKFEMVDQFIMSYGGLRGAIAYGLVVSIPASITAKPMFITATIAVIYFTVFLQGITIRPLVNFLKIKKKEERDPTMVESVYNKYLDYMMSGVEDIAGQKGHYTFIENFERFNAKVIKPVLMRHQKRESFDASSIVRAYEKITLEDAIKLAKVKNNIQNKRLERIKSKGRVAPILPDKISNQKTMTPKDLQLKRFMESGENIDSLYTLFSDLLDRKLHEMNRPSVQITDVDGQDDIQDDYMAEVGSRSNLSAMFRSTEQLPSETPFHSGRRQSTGDLNATRRADFNV

SEQ ID NO: 12492 - protein, 497 aa, Ralstonia solanacearum
MTRTDLPPAPITLNDPALWRTQAFLAGAWTDADDGSTRDVTDPATGRVIGTVPAMGAAETRRAIEAAQAAQRAWRKVTARERARILRKLADLMLEHQQDLARILTAEQGKPLPEATGEIAYAASFIEWFAEEARRVYGDTIPAPQGDRRIVVNKEPIGVTAAITPWNFPIAMMTRKVGPALAAGCAMVVKPALETPYSALAFAELAARAGVPAGLLSIVTGDAQGIGGELTANPVVRKLSFTGSTAVGRLLMRQCADDVKKLSLELGGNAPFIVFDDADLDAAVEGAMVAKYRNAGQTCVCANRFYVQRGIYDAFAARLSEAVRALRVGNGAEPGVQQGPLIHQRAMDKVRAHVDNAVAQGARVLVGGKPHALSAQGGAFFEPTVIVDARPGMLVAHEETFGPLAALIPFDTEDEAVAAANDTEFGLAAYFYTRDLGRAWRVSEALESGMVGVNTGLISTAEAPFGGVKQSGLGREGSKYGIDEYLEIKYVCMAGLG

SEQ ID NO: 12493 - protein, 474 aa, Ralstonia solanacearum
MNAVTDLKHDYLVADIKLADWGRKEIAIAETEMPGLMAIRDEFAASQPLKGARIAGSLHMTIQTAVLIETLKALGADVRWASCNIFSTQDHAAAAIAASGTPVFAFKGESLKEYWDFTHRIFEWADGGTPNMILDDGGDATLLLHLGAKAEQDASVIAKPGSEEETFLFAAIKEKLAKDATFYSRNLDAIKGVTEETTTGVHRLYQMAQRGELRFPAINVNDSVTKSKFDNLYGCRESLVDGIKRATDVMIAGKVAVVAGYGDVGKGSAQALRALSAQVWVTEIDPICALQAAMEGYRVVTMDYAAEHGDIFVTCTGNYHVITHDHMAKMKDQAIVCNIGHFDNEIDIASVEQYQWEEIKPQVDHVIFPDGKKIIILAKGRLVNLGCATGHPSYVMSSSFANQTIAQIELWTEAQKGSSKYPVGVYTLPKHLDEKVARLQLKKLNAQLTVLTDKQAAYIGVSKEGPYKADHYRY

SEQ ID NO: 12494 - protein, 309 aa, Ralstonia solanacearum
MPSRRLATILATALAPCLWGTTYIVFTQTLPVSHPLLVGALRALPAGILLMLLGPGLPPRDKLGRLALVGLANIGVFFALLFVAAARLPGGVAATVMSVQPLLVGLLAWPVLRRRPRPVQLPAALAGSLGVGLLILGPAARLDAIGVAAALGAAASMATGTVLIERWGRVGTPLALAAWQLALGGLVLLPVALAVEGLPPVPTLRNAAGFAYLIVIGTALGYWLWVRGIGRLGADVTFLSLLSPLTATVLGALLLGEWFSPVQAAGALLILAATVAGMALSRRARMAGTPEQRPARPVHPEGPRVGASR

SEQ ID NO: 12495 - protein, 346 aa, Ralstonia solanacearum
MTAPLPYTRAANLPALLRERILILDGAMGTMIQRYKLTEAQYRGERFASHPVDVKGNNELLLLTRPEVIREIHEQYLAAGADLIETNTFGATTVAQEDYKMAELAYEMNVVAARLAREACDKYSTPDKPRFVAGAFGPTPKTASISPDVNDPGARNISFDQLRDAYYEQGKALLEGGADVFLVETIFDTLNAKAALFAIDQLFEDSGERVPVMISGTVTDASGRILSGQTVEAFWNSLRHAKPITFGLNCALGAALMRPYIAELAKICDTAVSCYPNAGLPNPMSDTGFDETPEVTSSLVDEFAAAGLVNLVGGCCGTTPEHIRAIAERVAQRKPRAWPGQYREAA

SEQ ID NO: 12496 - protein, 112 aa, Ralstonia solanacearum
MKLIMAIIKPFKLDEVREALSQVGVSGITVTEVKGFGRQKGHTELYRGAEYIVDFLPKVKIEVAVPDDVLERAVEAIEKSARTGKIGDGKIFVTDVEQVIRIRTGETGGDAL

SEQ ID NO: 12497 - protein, 306 aa, Ralstonia solanacearum
MNAVIPVNTVSAVATQPSSNAWALAFPGSLGNLDAYIQSVNRVPMLTAEEEQQLARDYHATGNLDAARRLVLSHLRLVVSIARQYLGYGLPHADLIQEGNVGLMKAVKRFDPDQGVRLVSYAIHWIKAEMHEYILKNWRMVKVATTKAQRKLFFNLRSHKQDAHATFTSDEVDAVAQELNVKGAEVREMETRLSGGDIALEGQIDDGEESFAPIAYLADTHNEPTRVLEGRGRDRLQSEGIETALAKLDDRSRRIIEARWLHVNDDGSGGATLHELADEFGVSAERIRQIESAAMKKMKGALQSFA

SEQ ID NO: 12498 - protein, 238 aa, Ralstonia solanacearum
MRALVTGGSGAIGQAVSEALARAGHEVWVHANRNLEQAEAVAQRIVAAGGTAHAIAFDVTDAQATEAALAPVLDGAPVQILVNNAGVHDDAPMAGMTQQQWRRVIDVSLNGFFNVTQPLLMPMIRTRWGRIINMASVAGVMGNRGQANYAAAKAGLIGATKSLAQELASRGITVNAVAPGIIASPMAGEAFPAERIKQLVPAGRAGQPDEVAGMVAYLASDAAAYVTGQVLSINGGLA

SEQ ID NO: 12499 - protein, 301 aa, Ralstonia solanacearum
MATATDPARRPLDGTAIGLMVVLCLCWGLQQVAIKVAVHDVGPVMQAGVRSAIASVLVLAFALWRGTRLTLRDGTLPGGLAAGTLFGIEFLCIFIGLGHTTASRMAVFLYTAPIFTALGLHAFVPGEHLRPRQWLGIGVAFAGMVLAFADGMLHPAAGPSTSLGDALGVLAGVLWSATTLVVRASRLSEAPAAKTLLYQLAVSAVLLLTMAAGTGQAWTANLTPTALASLAYQSVLIAFASYLVWFWLLRRYLASRLSVFSFLTPMFGVAFAVLLLHDPVGLRFALAAALVLSGILLVNLR

SEQ ID NO: 12500 - protein, 470 aa, Ralstonia solanacearum
MQDKYLDFVRSGFGKWLSTNLGLPQPVPLRRHRPGEPEFAGPFLVGAAPGGALRETLAALFAGMGVPTRFHDSHPEWLGAANRQGQITGRFVAPTGQEGEASDRLGGIVFDATGIASTEGLEALYTVFHDGVRAIGRCGRVVVIGRPPEGCAAPQAAIVQRALEGLTRSLGKEIRRGCTVQLVYVAEGAEPAAASTLRFLLSARSAYVSGQVVRVRPATAATVDWQQPLAGRTALVTGASRGIGAAIAQVLARDGARVLCLDVPAAQPALDGVARAIGGEALAYDIAEAETPARLARQLAAMGGIDILVHNAGITRDKTIARMTEAAWRSVLDINLAAQLRINDALLAAGALHAGGAIVCVSSISGIAGNPGQTNYATAKAGVIGLVQACAPLLAERGITINAVAPGFIETQMTAAVPFTIREAGRRMNAMAQGGQPVDVAEAIAWLACPASNGVTGNVVRVCGQSLLGA

SEQ ID NO: 12501 - protein, 298 aa, Ralstonia solanacearum
MDTLVQPRVEHARRVERVVTGHATSDGAGVRLTRVLTQPLQRRLDPFLMLDAFRSDDPNDYLAGFPDHPHRGFETVTYMIAGRMRHRDNAGHEGLLQTGGVQWMTAGSGIVHSEMPEQEDGVMEGFQLWLNLPARDKMTTPWYRDIPSAEIPGFTTEGGVAVRVIAGESHGVQGAMTRDATQPLYLDLSLPAGTAFAQPLPARHNAFVYVFRGSALVGDAQAPGGAGLQRVDDKQMAILANTEGSDGVVIRADDAPARVLLVAGQPLNEPIAQYGPFVMNTQEEIFQAVRDFQAGKFA

SEQ ID NO: 12502 - protein, 368 aa, Ralstonia solanacearum
MKTKAAIAWKSGAPLTIEDVDLQGPRAGEVLVEIKATGICHTDYYTLSGADPEGIFPAILGHEGAGVVLDVGAGVTSLKAGDHVIPLYTPECRQCKFCLSRKTNLCQAIRATQGKGLMPDGTSRFSIDGKPIFHYMGTSTFANHIVVPEIALAKIRPDAPFDKVCYIGCGVTTGVGAVVYTAKVEAGANVVVFGLGGIGLNVIQGAKMVGADKIIGVDLNPAREAMARKFGMTHFVNPKEVGNVVDHIIQLTDGGADYSFECIGNTQVMRQALECCHKGWGKSIIIGVAEAGAEISTRPFQLVTGREWKGSAFGGARGRTDVPKIVDWYMEGKLNIDDLITHTLPLERINEGFDLMKRGESIRSVVLY

SEQ ID NO: 12503 - protein, 213 aa, Ralstonia solanacearum
MLRIWGRLSSVNVQKVVWCARELSLDHERIDVGGAFGGLDTAEFRALNPNGMIPVIEDGISGTDGEHFVLWESNAIVRYLCARYGPGNLYPLELHERADADRWMDWQTTSFSPSMVDAFLQLVRTPEDQRDPARIERSRLATERTSAILDAVLARQPYVAGQRFTMADIACGCAAHRWLSLPLERPACPHLERWMAELRDRRAAQEVLALPLA

SEQ ID NO: 12504 - protein, 360 aa, Ralstonia solanacearum
MDRAATFELEMTRLIRAPRERVFDAFTDQAALATWHCPRGMSVLEASADPRVGGRYRVVMGGRDGSRHIAVGEYQKLDRADFLAYTWAWESGSMPPDLKTLIEVTLTDHDGGTRLHMRHSGFPDTQTRDGHMAGWQSVFNRLSDYLDPEGSAGTVTVYGDPRSSYCRTVRMALAEKGVRYTLQPVPPHSPELLAHNPFGRVPAFSDGPIEFYETRAILSYIDEAFDGPSLLPQWGATAHARGEQWISLINCHAYDAMVRRYILQYIFPKGENGQPDRKVIDAALPEIAAQLDALEQAYQERDYLVGSTVSMADLFLAPILAYLGMFPEGAALLEARPNLRRGQAAMRARPSFAATQPQLS

SEQ ID NO: 12505 - protein, 249 aa, Ralstonia solanacearum
MTQALNNQVALVTGASRGIGRAIALELARQGATVVGTATSEAGAQAISAYFAEAGVKGAGVVLNVNDAARCEAVIDEAIKTHGGLNILVNNAGITQDNLAMRMKDDEWMAVIDTNLSAVFRLSRAVLRPMMKARGGRIINITSVVGSAGNPGQANYAAAKAGVEGMARAMAKEIGSRNITVNSVAPGFIDTDMTKVLSDEQHTALKAQIPLGRLGMPEDIANAVAFLASPAAGYITGATLHVNGGMYMG

SEQ ID NO: 12506 - protein, 427 aa, Ralstonia solanacearum [sequence omitted]

SEQ ID NO: 12507 - protein, 283 aa, Ralstonia solanacearum
MRRIQHRTQGNAMNDTFTMPAFGLGTFRLTGEAAIDSVRTALELGYRAIDTAQIYANEAEVGQAIAASGVPRRDLFLTTKIWVDNLAADRLIPSLKASLARLRTEQVDLALIHWPSPGGAVPMAEYLGALDEARREGLTRALGVSNFTVALLREAIETVGAAQIATNQIELHPYLQNRKVAAFAQSQGIHVTSYMTLGVGRVLADPVLADIARAHGATPAQVVLAWAMQLGCSVIPSSTRRANLQSNLAARDLRLTGDDMARIGALDRGERIADPAGIAPDWD

SEQ ID NO: 12508 - protein, 268 aa, Ralstonia solanacearum
MPYTAPKRIALIDIPFFHRPMFTRIREDIRAIMERDPAARSRWEVLTCYPGLHAIIVHRAAHACWGAGFRWLGRWLSHLGRFLTGIEIHPGAQVGRRVFIDHGMGVVIGETAEIGDDCTIYQGVTLGGTSLYKGAKRHPTLGKGVVVSAGAKVLGGFVIGDGARVGSNAVVLKPVPAGATAVGIPARILERDVPGAVQPALKQEFSAYGITPDADDPVSLALKRLIDHSALQQERIESILSALDRLGAHLENSPNDPFDASELKRMLK

SEQ ID NO: 12509 - protein, 448 aa, Ralstonia solanacearum
MFLADIRSIAALAWPVLVGQLAVIAFGVLDTAMAGRASAADLAAIGLGGSIYVTVYISLMGVLQALSPIAGQLYGAGRHGEIGEEVRQAAWLGLALSAIGMLLLWFPAPLLRLADASPELTSKATAYLRYEALALPAALGFRIYSALNNALSRPVMVTVLQLGGLALKFPLNALFLYGGLGLPAMGGPGCALASMIIGWLWCIAGALILMRNPVYRPFRIFTQFSPPHLGRLWGLVRLGVPMGLTYLIEITSFTLMAIFIARMGTVVLAGHQIAANVGAVAYMVPLSLSIATSTLVAQMIGARDRDAARRIAWNGLKLAAACAIAVGGCVLLLRRDLVGLYTRDATVMAIAVPLLPFIAFYQLFDALQVTAAFILRAYKIALIPTVIYALSLWGVGLGGGYLLGFGLLGESAAALRGAAGFWAANALSLAVAGTLLVGYFNRISRAAD

SEQ ID NO: 12510 - protein, 377 aa, Ralstonia solanacearum
MPRQKAATSANPADETIGAVDGPNAPNGRSGRRARGAAPAASDDVEVVDPLIDEAPAAEPADIADTSDANDSADESDEEDEDGEEAAPEEDFRTVLQAELAADTVQHYLNRISIKPLLTPAEELHFSTLAKAGEFAARQVMIERNLRLVVSIAKGYLNRGVPLLDLIEEGNLGLMHAIEKFDPERGFRFSTYATWWIRQSIERAIMNQARTVRLPVHVIRELNQVLRAKRHLEKSGIDGRDASIEDIAHLLGKTTEEVQDVLSLNEHTTSLDTPFDLDPGTSLLDFLSDEHGASPDQEVAHRELSQLMKSWLARLSDKHRYVVERRFGLNHIEPATLEELAAEMGLTRERVRQIQQEALVKLKRHFASQGVRKDAVL

SEQ ID NO: 12511 - protein, 393 aa, Ralstonia solanacearum
MMRITVLGATGSIGDSTLDVVRRHPDRYRVFALTANTQVDKLAALCRVFRPAMAVVGSATAAEVLRDQLGAEATGIDIRFGPEALEEAAAHPDCDAVMAAIVGAAGLRPTLAAVRAGKRVLLANKEALVMSGALFMDAVRQHGATVLPIDSEHNAIFQCLPQQRPSFGHGVARIVLTASGGPFRTRAVETLAEVTPDQACAHPNWVMGRKISVDSATMMNKGLEVIEAHWLFNVPVERLEVLIHPQSVIHSMVAYDDGSVLAQLGNPDMRTPIAYGLAYPERIEAGVPLLDLAATGTLAFEAPDLHRFPCLALAFDALRAGGTAPAVLNAANEVAVEAFLQRRIRFTEIAAVVGDTLARTAIGPADSLDTVFAADAQARRRAEHYIAASCLQS

SEQ ID NO: 12512 - protein, 795 aa, Ralstonia solanacearum
MTNLSMDGAYVLPFEQLRMTDVEVVGGKNASLGEMISQLDSAGVRVPGGFATTALAFRDFLQHNNLTERISQRLASLDVDDVKALAAAGKEIREWVATAPFQSRLEQEIREHFERVSKREGAEASFAVRSSATAEDLPDASFAGQQESYLNVSGIDDVLDKIKHVFASLYNDRAISYRVHKGFAHDVVALSAGIQRMVRSDCGASGVMFTIDTESGFQDVVFITSSYGLGETVVQGAVNPDEFYVFKPTLAAGKYPIIRRSIGSKLIKMEFTQAGEEGRVKTVDVPGELRNRYSLVDEDVVELAKYAVIIEKHYGRPMDIEWGKDGKDGKIYILQARPETVKSQSVGKVEQRFRLKGSAPVLTTGRAIGQKIGTGPVRVINDPAEMERVQPGDVLVADMTDPNWEPVMKRASAIVTNRGGRTCHAAIIARELGVPAVVGCGDATDLLKDGTLVTVSCAEGDEGKIYDGLLETEITEVRRGEMPPIDVKIMMNVGNPQLAFEFAQIPNGGVGLARLEFIINNNIGVHPKAILDYPQVDSDLKKAVESVARGHASPRAFYVDKLAEGIATIAAAFYPKPVIVRLSDFKSNEYKKLIGGSRYEPDEENPMLGFRGASRYIAEDFAEAFEMECRAMKRVREEMGLTNVEIMVPFVRTLGQAAMVVDLLGKYGLKRGENDLRLIMMCEVPSNAILAKEFLEYFDGFSIGSNDLTQLTLGLDRDSGMELLARDFDERDPAVKFMLSRAISTAKSMGKYVGICGQGPSDHPDFAEWLAKEGISSISLNPDSVIDTWQKLGSA

SEQ ID NO: 12513 - protein, 487 aa, Ralstonia solanacearum
MRLVQKALTFDDVLLVPAYSAVLPRDTSLRTKLTRTIELAIPLVSAAMDTVTEARLAIAMAQQGGIGIVHKNLKPEEQAREVAKVKRFESGVLRDPITIGPDMKVRDVMALSAQHGISGFPVLEGNKVVGIITNRDLRFEEELDAPVRAKMTPGEKLVTVREGASLEEAKRLMNKHRLERVLVVDGNFELRGLITVKDIQKATEHPLASKDERGSLRVGAAVGVGPDNDLRVDLLVKAGVDVIVVDTAHGHSQGVLSRVRWIKDKYPQVQVIGGNIATAEAAKALVDHGADGVKVGIGPGSICTTRIVAGVGVPQISAVSNVAEALKNTGVPLVADGGVRYSGDIAKALAAGAHTVMMGGMFAGTEEAPGEVFLYQGRSYKSYRGMGSVGAMKDGAADRYFQEDNTANVDKLVPEGIEGRVPYKGSVLPIVHQLTGGIRSSMGYCGCASIAEWHEKSQFVQITAAGMRESHVHDVQITKEAPNYHLD

SEQ ID NO: 12514 - protein, 478 aa, Ralstonia solanacearum
MQQRDTLFINGQWVAPQGKGTIDVIHSTTEAVMGTIPEGSAADAEAAVAAARAAFDGWAATPAPKRAEIIQKIADGLKARSEALAQLIAGEVGMPIKLARAIQVGSPVFNWGHFARLLGAFPFEARVGNSLVVREPVGVVGAITPWNYPLHQITLKVAPALAAGCTVVLKPSEVAPLNAFVLAEVIEAAGLPPGVFNLVTGYGPVVGEVLASHPEVDMVSFTGSTRAGKRVAELASQTVKRVALELGGKSASVVLDDADLAAAVKGTLSACFLNSGQTCSAHTRLLVPRARYEEVKALAKQFAATYVPGDPAQETTRLGPLISAVQRDRVLGYIRKGLEEGAELIAGGPEKPEGVSTGYFVRPTVLGNVKPSDTVAREEIFGPVLTILCYDDEEEAIRIANDSIYGLAGGVWSGDEARAMRVARRIRTGQVDINGGPFNMLAPFGGYKQSGNGREQGQYGLEEFLEYKALQLKPAQAT

SEQ ID NO: 12515 - protein, 276 aa, Ralstonia solanacearum
MTDTQPAVTLGDGARMPQLGLGLWRTPAGETAGLVRTAIEAGYRLVDTAAAYGNERGVGEGVRAAGAEPAVFVTTKLWNEDQGYDRTLRAFDESLRCLGLPAIDLYLIHWPAPSRGRYVESWRALIRLRDEGRARSIGVSNFGAEHLARIIDETGEAPAVNQIELHPWFQQRALRAFHARHGVRTESWSPLGQGGLLHDLTVREIAARHGKTPAQVVIRWHLDNGLIVIPKSAHPDRIRENIAVFDFCLTPADQAAIAGLDRADGRIGPDPVAAGF

SEQ ID NO: 12516 - protein, 301 aa, Ralstonia solanacearum
MRQVKFLNGRSIFAKLRPLHLPAPGANGPARHYNSQGPRIMGLSINLEGKVALITGASSGLGARFAHVLAAAGAKVVLASRRVERLKELRADIESKGGSAHVVRLDVTDPDSIRAAIAHAETEAGTIDILVNNSGVSTTQRMVDVTPDDFDFVFDTNTRGAFFVAQETAKRMIARARGAEKNGSPLPQSRIINIASVAGLKVLSQIGIYCMSKAAVVHMTRAMALEWGRHGINTNAICPGYIDTEINHHHWETEAGQKLVQMLPRKRVGKPQDLDGLILLLASDQSDFINGAIINADDGMV

SEQ ID NO: 12517 - protein, 1155 aa, Anabaena sp.
MKSPVNSKPKILVVDDEPDNLDLLYRTFYRDYKVLRAISGPAALDLLAQEGEIAVIISDQRMPIMSGTEFLSLTATQYPDIIRIILTGYTDVEDLVEAINAGKVFKYVTKPWEAEELKAVVRQALDTHNVLKARTRELTRTLRQESLLNTVTNTIRSALDYRQILQAIVDTVGHMLEVDVCLLRSFQDGQLVDEGFVYQKDSPAAVEKTIHDSAPLTILADTVWETREVQIIHDVAGDERIHGDSPELQHRNDAFAAADIRSSLVVPLICQQELMAVLALHQCSQARVWGEEEVQLVLMVADQAALALSQAYAYEQVRALAKRESLINTITTAIRSSLNPEDIFAAITQKLGQALQVDGCVLSLWTEEDEFVKCVGLYDSSRHSEDSLDNHRLITQELPESQAPILENPILQEILKTHEPVIITDMNHSDWETKRFDLHLKMPARSLMVVPLLADGKCIGSITLREGKRARQWLSADIELAKAVAAQAAIAVQQSHLYQKTREQAERLLQLDKQKTEFFQNISHEFRTPITLIQGPLESAVGTGEGLSYAQSAIALCNSRRLLRLVNQLLDLQRLDAGRMQPSFRPCDLVDFVSQIVESFRPYCEKKALHLTTELDECPTVYIDMEKFDKVVYNLLSNAMKFTPEGGTISVKLQSQGHHCILQVQDTGIGIVKEQIPHLFERFRQAEGSENRSYEGSGLGLALVKELVELHGGRVTVDSVYGKGTTFTLWLVIGNAHLPLQQVSDTPVELTTSRASVELADLELVEPTLENIDIETINPLPISETQHTANSTQQSTHSILVVDDNPDLRTYVSDILRRSGYQVYTARNGYEGFSKVQELTPNLIVTDLMMPLVTGLEMIRMVRNDEKVKGTPIILLTAKVDEETRIESTEHGADAYLAKPFNDRELLAEVRNLLALKENEKRVLELNTYLTESVLKRFLPPALVSKAAAGSLSLDLRPEPRLITVLFSDIVGFTQLANTLRSRRVAELLNEYLEFMTKAVFDNGGTVDKFMGDAILALYGAPEELTPNEQVRRAVNTARAMHSSLAQLNQRWRNQGIFDTHDYGGVQFRCGIHQGTAVVGMFGSAERADYTAIGPSVNIAARLQSAAVPGTILVSAAVADYLQDEEITKGSPLKLKGIDETVLTFAVKSELMVNR

SEQ ID NO: 12518 - protein, 260 aa, Ralstonia solanacearum
MGTLKHLFDLSGKTALITGGSRGLGLQIAEALGEQGARIVLSARKADELKDAQAHLLSLGIAADWIAADGAVEADIQRLADEALAKLGHVDILVNNAGATWGAPAEDHPVEAWDKVMNLNIRGLFLLTQQIGKRSMIPRQYGKIVNVASIAGLKGNPPGTLDTIAYNTSKGAVVNFTRALAGEWGKYGITVNAIAPGFFPSKMTRGSLEKLGVDKLTEKSPLHRLGDEEDLKGVAALFASDASKHITGQILAVDGGVSVV

SEQ ID NO: 12519 - protein, 262 aa, Ralstonia solanacearum
MKGLEGKVAIVTGGATLIGAAVVRTLRSYRVKVALFDIDAASGNRVAAEDSDGTRFWPVDITDDRQLERGVADAAAHFGRVDFLVNLAATYLDDGAKSGREDWLKALDVNLVSAVMAARAVHPHLAAAGGGAIVNFTSISSKVAQTGRWLYPVSKAALVQLTRGMAMDYAADGIRVNSVSPGWTWSRVMDALTHGDRAKTDRVAADYHLLRRVGDPEEVAEVVAFLLSGHAAFVTGADYAVDGGYSAMGPEQAKPAIARLAE

SEQ ID NO: 12520 - protein, 502 aa, Ralstonia solanacearum
MAQLLTVSEYAAMAGKLALPTQAFIDGAFVPAVSGKTFQTTNPATGNVLAEIAACDTRDVDIAVAKAKAAFEDGRWHRRSPAQRKATLLRLADLLEQHAHELAVMESLDSGKPIRECQATDVPETIHTIRWHAELIDKIYDSTAPVGSNALSLVVREPIGVVGLVLPWNFPLLMLAWKIGPSLAAGCSIIVKPAKETSLTALRVAELAHEAGVPAGVFNVLPGGGKEVGEPLGRHMDVSMVSFTGSTDTGRLFLKYAADSNLKRIVLECGGKNPAVVMNDVDDLDAVAQHVVNGAFWNMGENCSASSRLIVHADVKDALLARIGVHMREWKMGNPLDPEHRVGSLVSESHFRKVRSYLEHAGAEQLRVAFGGGTEGGIFVEPTVVDGVGQGSLLFREEIFGPILSVTTFTRMEDAIALANDSVYGLAASVYTDSLNNAIRLSREIRAGVVTVNCFGEGDVTTPFGGYKESGFGGRDKSIWAHDQYTEIKTIWIDVPDCTAAK

SEQ ID NO: 12521 - protein, 338 aa, Ralstonia solanacearum
MKRINLTRYLIEEQREHNTIPAELRLLLEVVARACKAISHSVNKGALAGVLGSAGTGNVQGETQQKLDVIANEVLLEANEYGGNLAAMASEEMESFYEIPHRYPKGEYLLLFDPLDGSSNIDVNVSIGTIFSVLHMPKPGQTVTEADFMQPGVRQVAAGYAVYGPQTTLVLTVGNGVHMFTLDREVGSFILTNRDVKIPADTKEFAINMSNMRHWAPPVRRYIDECLAGTEGPRGKDFNMRWIASMVADVHRILTRGGIFMYPWDKREPGKAGKLRLMYEANPMAFLVEQAGGAATNGHQRILEIQPEKLHQRVAVILGSKNEVDRVTQYHREAQQTA

SEQ ID NO: 12522 - protein, 755 aa, Ralstonia solanacearum
MAKSKITEVESKESAASARAAKTGTARTSTAKPNKAADADTKRTVREAEAIPTPTSPAPRAEAAAEPKKRGRKPRAGAQADDESSTDVTEEFDEAPAAPAPKSDKQKARDRKAKEKALLKEFAATQQGGSEEELEARRQKLKALIKLGKSRGYLTYAEINDHLPDDMVDAESMDTLVATLNDIGIAVYEQAPDAETLLLNDNAPSVTTEEEAEEEAEAALSTVDSEFGRTTDPVRMYMREMGTVELLTREGEIEIAKRIEAGLKDMVMAISACPVTISEILAMGERVANDEAKIDEYIDGLIDPNADAAEAAQAGDEDEDFEDEDADESGDEEEDEDDDGSGSSAASARQLEELKQAALAKFAIIGDQFEKMRRAFEKEGYKSKPYLKAQEAIQNELMTIRFTARNVERLCDTLRGQVDEVRKLERAILNIVVDKCGMSRGDFVSRFPGNETNLGWINTVVADGKPYSAIVERNIPAVHELQQKLIDLQARVVLPLAELKDVNKKMSEGERRAREAKREMTEANLRLVISIAKKYTNRGLQFLDLIQEGNIGLMKAVDKFEYRRGYKFSTYATWWIRQAITRSIADQARTIRIPVHMIETINKMNRISRQILQETGNEPDPATLAEKMEMPEDKIRKIMKIAKEPISMETPIGDDDDSHLGDFIEDTNTLAPAEAALHGSMRGVVKDVLDSLTPREAKVLRMRFGIEMSTDHTLEEVGKQFDVTRERIRQIEAKALRKLRHPSRSDKLKSFLEGS

SEQ ID NO: 12523 - protein, 636 aa, Ralstonia solanacearum
MTYELLNTIDAPAELRRLDRRQLGTLADELRAFVLESVAQTGGHLSSNLGTVELTIALHYVFNTPDDRIVWDVGHQSYPHKILTGRREQMATLRQLDGISGFPRRSESPYDTFGTAHSSTSISAALGMALGAKTQGENRVAIAVIGDGAMSAGMAFEAMNNAGVYRNLPLVVVLNDNDMSISPPVGALNRYLARLMSGQFYAATKKGVEKLLSVAPPVLEFAKRFEEHAKGMLVPATMFEEFGFNYIGPIDGHDLESLVPTLQNIRQRALEGGRPQFLHVVTKKGQGYKLAEADPILYHGPGKFNPQEGIKPAARPAKVSYTQVFGQWLCDMAAADKRLVGITPAMREGSGMVEFEQRFPDRYYDVGIAEQHAVTFAGGLACEGLKPVVAIYSTFLQRGYDQLIHDVALQNLPVVFALDRAGLVGADGATHAGAYDMAYLRCIPNMMVMAPADENECRQLLSTAFAQDCPTAVRYPRGAGTGVVVQPTLEPLPVGKAEVRRASTAPAGQRVVILAFGSMVAPAAAAAERLDATVVNMRFVKPLDAACVLEMARTHDYVVTVEEGCVMGGAGSACLEALAAAGVATPVLQLGLPDRFVDHGDHAALLALCGLDANGILASIRERFAVQPRAVQPRVA

SEQ ID NO: 12524 - protein, 112 aa, Ralstonia solanacearum
MKQITAIIKPFKLDEVRESLADVGVTGLTVTEVKGFGRQKGHTELYRGAEYVVDFLPKIKIEVVVADSQVDQVLDTIVKAAKTGKIGDGKIFVTAVEQVIRIRTGETNEAAV

SEQ ID NO: 12525 - protein, 478 aa, Ralstonia solanacearum
MHAQHFIANRLMAADSGLRIKVFDPSDGQPFAEIARGNATDISVAVHAARRAFDGIWGRLAPAERGRLLMRVALRLADHEEELARLEARDTGKPMRQARADARAIARYFEFYAGAADKLHGQTIPYQPDTTVLTVREPHGVTAHIIPWNYPMQIFGRSVGAALAVGNACVVKPAEDACLSILRVAELAAEAGLPDGALNVVTGYGHEAGAALAAHPGINHVSFTGSPETGKLIVRAAAENHVPVTLELGGKSPQILFADADLDAAIPAVVSGIVQNAGQTCSAGSRVLIERGLYETVLDRLASVFEAIKVGPSTLDLDCGPLINPRQQQRVWDFVSDAQHANIPVMAQGLVVPEAPETGYYQAPMLLRDVPPTHRLAQQEVFGPLLAAMPFDGEAEALALANGTPYGLVAAVWTRDGARQLRLARALKAGQVFINNYGAGGGVELPFGGTGQSGHGREKGFEALYGFTTVKTIAIRHG

SEQ ID NO: 12526 - protein, 442 aa, Ralstonia solanacearum
MATTTPPLGPSAGALPPQSASGFEEATYRKVSWRLIPFLLLCYVVAYLDRVNVGFAKLQMLNDLKFSETVYGLGAGIFFIGYFLFEVPSNVILHRVGARMWIARIMISWGLISAAMMFVTTPAMFYVMRFLLGLAEAGFFPGIILYLTYWYPAERRGRTTTFFMTAVALSGVIGGPISGWALKTFGGVYGLAGWQWMFLIEGIPSVVIGLCVLAYLDNRISHARWLTDEEKALLTRNIAAEEAQKEDAPIAAIMASPRVWLMSLIYFSFVMGLYGVSFWLPTLIKQTGVADPLSVGLLTAIPYGAAVVAMVLVARSADRTRERRWHIAIPALAGAIGLVLSAVWHTNTTLAMAALTLGTMGILTTLPLFWSLPTAFLAGTGAAAGIALINSLGNLAGFLSPYAVGWLKDTTRSTDSGMYLLAASMVLGALLTLSVPARTVNR

SEQ ID NO: 12527 - protein, 638 aa, Ralstonia solanacearum
MRHVHGVPAGNGLAAQSVIPDPIPCTPLTASLRPLLTKLGLASRAPLELDARAKLLAAVHRGAPMGIAASVVLPVLTLAAFWDSGNRLALAGWCLIMLCLTASGLRFYFGYRYDMTRMTLAAHTRKWWTGMRIMSAVGGLAWGSSAGLYLVSPSLEFSSLLMIVIIGVAAGAVLSQAPVPSNLLILGTGILTPHFALAEQAFPEHGLYVRCVLLFFAAFLARHAANIHSTLVREIQLENESRQLARRYQDEKQRALSASEEKSRFLAAASHDLRQPVHALVLLVEALRARNQSESLAPLVEQLASGAQTIDLLFRSLLDLSKLESRKTSPTLEPVDLGEVITEVVQQFLPDARAKGLALTQRIPPLPVFGMAEPVLLRRALFNLLQNALRYTSHGGVMVALRVRQKHLRIEVWDTGIGIAPEHQKDIFSSYYQVENPERDPSQGLGLGLAIYKECVRLLRGTHGVRSVPGRGSMFWMALRPVPAEIKAPLAAQPRSEQKRAVLEQPRFSGVVLVVDDDAQIRNAWHALLEAWGVEVHSAADGPTADHLLMRGLRPQIIFCDLRLPGKEDGLQLLERWQVSHPEAHAVLLTGDRNSAALARAEEAGYLLLAKPMDPNMLRVLLKRWLRGRAAEPQVAAY

SEQ ID NO: 12528 - protein, 401 aa, Ralstonia solanacearum
MELQGKHFVLGLTGGIACYKSAELVRLLTKAGATVQVVMTDAATHFITPVTMQALSGRTVFTSQWDDRVGNNMAHIDLSREADAIVVAPASTDFLAKLAHGLADDLLSTLCIARDCPLLVAPAMNRQMWAAPATRRNAAQLRADDVTLLGPDAGDQACGEVGDGRMLEPEAIVEALIGFFQPKLLRGRRVLLTAGPTFEPIDPVRGITNLSSGKMGFALARAAAQAGADVALVAGPCHQDTPAGVLRIDVQTAQQMHDAVMRELDTARTDVFIAVAAVADWRVAQAADNKLKKQSDTDVPALSLTQNPDILATVARRADAPFCVGFAAETERLEEFGEAKRRKKGIPLLVGNLGHKTFGRDDNEVALFDPAGITRLPRADKLTLARQIVAAIAERVQGARP

SEQ ID NO: 12529 - protein, 310 aa, Ralstonia solanacearum
MRRSDAIELLILAALWGGSFLFMRVAAPPFGPVALIALRVAIASAFLLPVLAMRGGLGALRPHWPHLLAVGVLNSAVPFCLLAYAELTLTAGFTSVLNAAAPLFAAIVAFAWLGERMSAWRVLGLAIGFVGVIVLVGGSSALDARQGGLAVAAALGATVLYGLAGSYAKRYLTGVPPLAVATGSQIAAAVVLAPLAVWLWPAHTPTGSVWLHVIGLGIACTGIAYILFFRLIAHVGPTRAVSVTFLVPVFGVLWGILFLGEQLTLNMVAGCAVILLGTSLSTGVLASGKRAAAGTGSGADDKASPLRSGR

SEQ ID NO: 12530 - protein, 265 aa, Ralstonia solanacearum
MTAPPTSFPPRLAGKVALVTGATQGIGAATARLFARHGARVIVNALVRDAAAEAFAASIGHDGNVLLVQADVRYRDQADAMVAAGVARFGGIDVLVNNAGINVFSDPLALSEADWARCLSVDLEGAWHCARAVLPHMLARGAGSIVNIASVHGHKIIPGAFPYPVAKHGLIGLTRALGIEYAARGIRVNSISPGLILTPIAEAGFAAAPDPEAERRRQADLLPCKRIGEPEEVAYTALFLASDEARFINAADILIDGARSQLYHE

SEQ ID NO: 12531 - protein, 844 aa, Ralstonia solanacearum
MPSPLICAERIRLQQRATDKTSAIRAAGRLLADTGCIDPAYIDSLLRRETVANTFLGHGVAIPHGMGEDRHLIRQTGIAVLQFPDGLEWHPGQTTHLVFAIAAQSDEHITLLRRLTRLLNDDARLRQLFSTQRAEDIVAALSQDAPAPAASAPGGDLAERLALTLNYPSGLHARPAAQWVETARRFAARVQVRHGAETADAKNLVALLQLGLAAGAALTLSAEGPDARAALTALQHTIRSLTAQERAQAARDTQAARTRQIARGWQPAADLPAIGGIGASPGLAIGTVHVMQPGVSAIPDHPVPLATGGDLLDRALADTRAELAALARDTAARLGEAEAGIFKAQAELLGDTDLMTLTCQAMVEGHGVAWSWHHAVERLAERLAALGNPLLAARAADLRDVGRRVLGHLDPALRGTAQALPDGPCILVAQDLSPSDTAALDTRRIAGIVTAQGGPTSHTAILTRTLGIPAVVAAGPAVLDVASGTQAIVDGSGGQLYLDPDAAAVAGAEAWLREDAARAQREQAERGLPARTRDGHAVEIAANVNLPAQAIEAVTLGAEGVGLMRTEFLFLERDHAPDEDAQHEVYAAMLGALGGRPLIVRTLDIGGDKQVPHLNLPKEENPFLGVRGARLLLRRPDLMEPQLRALYRAASGGGPLSIMFPMITSLGEVIALRAACERIRAELDAPAVPLGIMVEVPAAALLADQLAEHVDFFSIGTNDLTQYTLAIDRQHPDLAAEADSLHPAVLRLIQLTVQGAARHGRWVGVCGGLAGDPFGALLLTGLGVHELSMSPRDIPAVKARLRDAHVRQLTELAGQALACASAEDVRALEATLPAHRAGTEMAAA

SEQ ID NO: 12532 - protein, 451 aa, Ralstonia solanacearum
MPPAQSRPAADSVLPLSFSTGVAVRRPDGFLFMSESLIRQDGALMIEGVALEAIAARFGTPTYVYSRAALTANYRAYAAACEGRNARVQYAMKANSNLAVLQIFAQLGAGFDIVSGGELRRVLAAGGKAADVVFSGVGKTADEMRLALEAGVACFNVESIPELHRLNEVAGSLGKTAPVSLRVNPDVDAKTHPYISTGLKGNKFGVAFDEVLPTYRAAAAMPNLRVVGIDCHIGSQITEVSPYLDAIDKVLDVVARLDAEGIRLSHIDVGGGLGITYTDETPPDITAFARTLLDRIEQRGFGDRTVLFEPGRSLVGNAGLLLTRVEFLKPGAAKNFCIVDAAMNDLARPAMYEAYHHIVPVRERGGAPTVYDIVGPVCESGDWLGRDRALDAQPGDLLAILSAGAYGFTMSSNYNTRGRAAEVIVDGDRVHVARERERFEDLIRGEQLLSA

SEQ ID NO: 12533 - protein, 994 aa, Ralstonia solanacearum
MATMLRRALPAPAHLWRRGRTALLLCATAIALLTTSDRAQADRTTRALPPMGHPLMPSAAAQMASGTPAAAIALWTLAVLSMRHVQLRRENRRRRRAEADLARQLDFHHRLLESLPFPLAAQDTQHRYVAVNAAFCHLFGQPREALLGRTPAHLGWRCAHTAARAQDIDRRATAASQGACEALTITAADGRERHVLYWVAPVHGPDGRPGGTVASLIDIDGIRDAQAPAEQRAQRLHELTESLPALVCQFEMRPGTAARGRMRHLAGNASETLGAPAGKARGRLPSPARLVHRDDRQRMRGAALQSAAQLTLLDQQFRHGNGDGPVRWLHIRARPRRGADGCTVWNGYLRDVTAERAQADALVSARQAAESALRAKDRFLATMSHEIRTPMNGVLGLVELLLQTRLEREQQRMMTLVQESSRALLHVLDDILDYAKIEADRLSITPAPTDLRALLDSTVGLLASRAHERSLAVRVDVDAAVPATVSVDGMRLRQVLCNLLSNAIKFTEHGSVRLSAKCMETAADTVHLIIRVTDTGIGIAPEAQATLFTPFVQADSTITHRQCGTGLGLAISRQLARLMGGSLDMDSTPNVGTTLTLRLEVPVVDARYRLPRLASATVRVAVDDDTCRHGLEQFAVAAGLRVVHTGTADLTLVDSVRAPADAPRIVPVTGDAPYTGPGRSIPRPEALSTNPLNWQAFVQACDTALARPADGHAANGMPKSRTVPEPAPAAETPGMHILVAEDHPINRELITRQLRLLGYRVTLAEDGAAALQRLCETRFDALLTDCCMPRLDGFDLARQIRQREQQAPGGRRLPILAITATTLAEEHARCRTVGMDGYVLKPTTLATLQDALSRLGNAAVSPDAAKAPATAPDNALAFRLDDLRQTLGDGPAAVSLIRVFTTALGDDARQLGGLLATADRPALRKWTHRTGGALALLHHTAIDAEMSAFRHAVHSADDTGLRQAGARMLQLLAHLQGVMRLAETPSPGTAPTCQ

SEQ ID NO: 12534 - protein, 506 aa, Ralstonia solanacearum
MRYAHPGTPGAVVSFQSRYGNYIGGRFVPPVKGQYFTNTTPVTGEAIAEFPRSTAEDIDRALDAAHAAADAWGRTSAQDRSLILLKIADRIEQNLERLAVTETWDNGKPIRETLNADIPLAADHFRYFAGCIRAQEGAAAEINEHTVAYHIHEPLGVVGQIIPWNFPLLMAAWKLAPALAAGNCIVLKPAEQTPLGICVLLELIGDLLPPGVLNVVHGFGKEAGEALATSKRIAKIAFTGSTPVGSHILKCAAENIIPSTVELGGKSPNIYFEDIMQAESSFIEKAAEGLVLGFFNQGEVCTCPSRALVQESIYGSFMDAVMAKVAAIKRGDPLDTETMVGAQASEQQFNKIRTYLEIAREEGAECLAGGEAEAMSGKLANGYYIKPTLLKGHNNMRVFQEEIFGPVIAVTTFQDEAQAIQIANDTEYGLGAGVWTRDINRAYRVGRAIKAGRVWTNCYHLYPAHAAFGGYKKSGVGRETHKMMLDHYQQTKNLLVSYDTRPLGFF

SEQ ID NO: 12535 - protein, 308 aa, Ralstonia solanacearum
MDGCSLPDVPMSPKDLLLALTVVLVWGVNFVIIKVGLHGVPPMLLGALRFALVAFPAILFVPRPKIALKWLLAYGATISFGQFAFLFSAMYVGMPAGLASLVLQSQAFFTLTIAAVVLREPIRWYHLAGMAVAACGLAMIGVAGTSGAGAATGMTTAGFLLTLCAALSWSSGNIVTKRIGPVNVVSLVVWGALIPPVPFFLLSYWMEGPQQIAHSLANLGGTSIGAIVYLAFGATIFGYSLWSRLLARYAASQVAPLTLLVPVVGLVSAALLLGERLVPAQWLGGAVVMAGLLLNVFGGRLAARLALV

SEQ ID NO: 12536 - protein, 179 aa, Ralstonia solanacearum
MPRSSAAAKDSDAHQPTPPEAAGLRRRDRIAVRESGVHGRGVYAVAAIAKGKKIIEYKGEHISWKEALRRHPHDPDDPNHTFYFSLEDGSVIDAKYGGNRARWINHACKPNCEAREKDGRVFIHALRDIDAGEELFYDYGLVIEGRQTKALKAQFACHCGAKKCRGTMLAPPEKKEKKQ

SEQ ID NO: 12537 - protein, 401 aa, Ralstonia solanacearum
MLSEQSKPLIDASVPVLREHGLTITQTFYRNMFASHPELTNLFNMGNQANGSQQQSLASAVFAYAANHGNNAALAPVVGRIVHKHAAVGIRPSHYPIVGRHLLGAIAEVLGDAATPELLAAWDEAYWLLAAELIAAEARLYAHTQSGPDHRQPVRIIERHAQAEDVVSFTLEAVGGAKLADFLPGQYISVQVELAPGVLQQRQYSLSDAPNGRTWRISVKRDAGGSGRPAGTVSNWLHDNARPGEVLLVSQPYGDFVPQLATDSPIVLMSAGVGITPMIATLNALARRNTARKVVFSHAGQAASHVAHADDLERAAQVLPDFAAHVFLESGEAADFAARPARPGRMTVETFLDDGVADADFYLCGPLPFMQAQRAALLAGGVPAGRIHREVFGPDLLDDIL

SEQ ID NO: 12538 - protein, 368 aa, Ralstonia solanacearum
MKTKAAIAWKAGAPLTVEEVDLQGPRAGEVLVEIKATGICHTDYYTLSGADPEGIFPAILGHEGAGVVLEVGAGVTSLKAGDHVIPIYTPECRQCKFCLSRKTNLCQAIRATQGKGLMPDGTSRFSLDGKPLFHYMGTSTFANHIVVPEIALAKIRPDAPFDKVCYIGCGVTTGVGAVVYTAKVEAGANVVVFGLGGIGLNVIQGAKMVGADKIIGVDLNPAREAMARKFGMTHFINPKDVGNVVDHIIQLTDGGADYSFECIGNTQVMRQALECTHKGWGQSIIIGVAEAGAEISTRPFQLVTGREWKGSAFGGARGRTDVPKIVDWYMEGKLNIDDLITHTLPLERINEGFDLMKRGESIRSVVLY

SEQ ID NO: 12539 - protein, 274 aa, Ralstonia solanacearum
MTTQMPIASPRTEFYERAFGGFHDQAVAEVRKETYGEDLGQNDWSTVDEMRQFSQWLELSPQSHLLDVCSGSGGPALFLARNSGCRVTGVDLHPDALQTGRQLAQALELHDRSQFVECDVRQRMPFPDGTFDALWCIDSVIHIPDRLALLREWCRLLKPGGRFLYTDPTLVTGMVSKEEILLRGTPGYFLYTPIGLNERLIEQAGLRLDMQADLTHSITELSERWHAAREKRCAVLTATEGEEAFARMQSFLTATHRVSVEGRLSRWVFVGVRP

SEQ ID NO: 12540 - protein, 520 aa, Ralstonia solanacearum
MERRSFLTAAGLGLAAPFGLTPRDVMAMATESPDAWASGFAAARAERAWLAGFEGVSADLPPSALTVEGRFPAALHGSLYRNGPVRHQIGGLRYHHLFDGDGMIQRYDIDTRGARTRVTHRGVFVRTDKFVADTAAGRPVRGTFATLLPGMVPIDSPDAINVANTSVVMRGDELLALWEGGSATRLDPDSLRTLGVKTWRADYAGMPFSAHPKVEADGTLRNFGVSSAAGLLTVYCVGADGALRRAQSVRVPQMAMVHDFAVTQRHLVFLLPSFIYDVERARDGASFLDAHVWRPELGMRALVLDKNDAARMRWFELPAGFVFHVGNAWSSPDGQRIHLDYVRSDDAAIVTTALRELMRGHIVHPAAPARLTQLTLDLRSGRAGQTATPYAAEFPKIDTRRTGLRHRALFCVANAVSRPGADSPIGFDTLMRFDTESGHVQRYRFAQRALVEEHLFVPAGPNAPEGEGWLLGTVFDVDAGRTLLTVFDARNVSAGPVAVAAREGVVPQGFHGLFRSRMAA

SEQ ID NO: 12541 - protein, 342 aa, Ralstonia solanacearum
MFLKNAWYVACTPDEIADKPLGRRICGERMVFYRGQEGKVAALEDFCPHRGAPLSLGFVRDGHLVCGYHGLTMKADGKCASMPGQRVGGFPCIRQFPVVERYGFIWVWPGDPEQADPARIHHLEWAESEAWAYGGGLYHIQCDYRLMIDNLMDLTHETYVHATSIGQPEIEEAAPQTKVEGDAVVTSRFMENIMPPPFWATALRGAGLADDVPCDRWQICRFTPPSHVLIEVGVAHAGKGGYHAAPEHRVGSIVVDFITPETETSIWYFWGMARNFRVDDAALTDTIRQGQGKIFSEDLDMLESQQRNLLAYPERNLLKLNIDAGGVQSRRVLERLLERERQ

SEQ ID NO: 12542 - protein, 484 aa, Ralstonia solanacearum
MFESQLLIGGKQRAAAGGATCERPNPATGDVASRAAAASLADADAAVQAAHAAFPAWAAMLPGERRRLLLKAADVMERRADDFIARGVAEAGGVPGWYGFNAALAAGMLREAAAMTTQVGGEVIPSDVPGSLAMGLRQPCGVVLGIAPWNAPLILGTRAIAMPLACGNTVVLKASEICPALHSLIGAVFEEAGFPAGVVNVITNAPADAPAIVERLIAHPAVRRVNFTGSTRVGRLIAEQAARHLKPVLLELGGKNPLVILDDADLDAAVQAAAFGAFFNQGQICMSTERIIVDRAIADRFVERLTDKAGALRAGRPGQDGAVLGGMVDASAAQRIRHLVDDAVGKGARLRTGALRIDGNIVQPAVVDGVTPAMALYGEESFGPVVAVLRAADDEDAIRLANDSEYGLSAAVFSRDIARAMQVARRIESGICHINGPTVHDEAQMPFGGVKASGYGRFGGKAAIDAFTELRWITVQAGARHYPI

SEQ ID NO: 12543 - protein, 492 aa, Ralstonia solanacearum
MNAPQAMRFLDDAQWDGLLFQGRWVPPLRRRTADVMEPATGRKLTRVGLADAQDVDAAVEAAAAAQPAWVAMPPRERANVFRRAAMLFEQHFDELALAIARETGAALFKGEHEVREAITLCHVAAGMPLEAQGQVLASPAGRLSYARRAPFGVVGVISPFNFPLFLTLRSVAPALAAGNAVVIKPDLRTPVSGGYVIARVFAEAGLPAGLLHVLPGGAEAGEALVVHPRVPMIAFTGSPGVGRRIGELAGRHLKKVSLELGGANALIILDDADLDLAVSNAAWGAWLHQGQICMAANRILVHASLADALTARLVEKAEHLPVGDGASGQVALGPLIDQKQLQRVHAIVQDSVAAGARLLAGGSYEQLFYRPTVLAGVRPGMRVFDEEVFGPVANIIVFRDDDEAVALANDSQGGLAAGVISASVGRAMALGQRLRVGMVHINDQTVNDDCVNPFGGPGIAGNGTSMGGPADWEEYTQWRWVTVKESAPRYPF

SEQ ID NO: 12544 - protein, 255 aa, Ralstonia solanacearum
MPHAPSTSSNPRLAGRAAIVTGGSRGIGAAIARRLAADGAHVAVVYRSHHDEADAVVRAIRDTGAKAIAVQADVSDAASVRAMVDTVQRAFGEIDILVNNAGILASQPVGSIDQAAFDRQFRINAFSAILVSQAVLPQMPARGGRIVNVSSSLVFRPRAGLAVYAASKAAVSALTQAFALELGPRNITVNAVAPAMTRTDMTAPLPDALKARLRDATPLGRLAEPEDIADAVAFLACDDSRWITGRTLLTDGGFV

SEQ ID NO: 12545 - protein, 242 aa, Ralstonia solanacearum
MSRRVLVTGASRGIGRAIANRLASDGFEVCVHCRSGRSDAESVVSAIQAQGGTARVVQFDVRDRVACRTLLEADVAEHGAYYGIVLCAGVTRDAAFPALTEEDWDIVLETGLDGFYNVVHPLTMPMIRLRQGGRIVTIASVSGVMGNRGQVNYSAAKAGLIGATKALAVELASRRITVNCVAPGLIDTEMLAEVEHLDHALKTVPMNRVGQPAEVASVVGFLMSDGASYVTRQVIGVNGGMV

SEQ ID NO: 12546 - protein, 413 aa, Ralstonia solanacearum
MHRELIERYLQGATSPVCAYLYDLDHLRERAARLSAMLPPGCELFYAIKANSDAPVLAALDGAVAGYEVASLGEVVRAREVGAQARIVFGGPGKTDDELQGALERGVELIHVESELQLRRLDAIACRMGRRARVLLRVNPNPLSADAVGKRAQGTLTMGGQPTQFGIEEDAVPDLIRLARTLPGVEVVGLHLHALSNNLDADSHLALMRHYLSLALRLRREHGLTLDTLNVGGGIGVDYADPSHAFDWRRFCDGLGVLLAEAGAGCRIVFECGRFIAADCGYYVTEVVDLKRNHGRWFAVLRGGTHHFRLPASWQHNHPFAILPNARWDYPFERPSVLAQAVTLCGELCTPKDVLARDVVVDRLRVGDRIVFQLAGAYGWHISHHDFLSHPHPERRFVGALHAASDARLEVAA

SEQ ID NO: 12547 - protein, 245 aa, Ralstonia solanacearum
MPAIATLQRANHGSHFRAYGLRGAAALIDPFIGVDHAWMSAPTFPPHPHAGFSAVSYLFLDSETGIDNRDSIGTHNLIRPGGLHWTTAGRGIVHEEVPAETGKTVHSLQIFVNLPPQRRDIAPFALSLAPQDIPVVQLPGVKVRVPVGRFGEVRAPLDPPTDVTMLDISLEAGAALALPIAAGHSAFVMPIFGTVMVDGEDFGHDDLRLPVFTPREAPRAITLQAPHGSAKVMLFSGAPLHTSAT

SEQ ID NO: 12548 - protein, 136 aa, Ralstonia solanacearum
MTVSCNFQTGSEYEWPGANHAPRFKPDHPVTELEGDKDVFGDGSVMLISTPGHTPGHQSLLVKLPKTGALVLSGDAVHFQSNWDNRRVPSINFDQDKTRASMQRIADLLVREKAQLWINHDKAQRDTLKMAPAYYE

SEQ ID NO: 12549 - protein, 605 aa, Ralstonia solanacearum
MRMNHAPGLLLPNLPRRRFVQGLAAGGVIAGLGLGGIAPSAAAAGATALGTAPVLRGTEFDLVIDETPVNFTGKPAMATTVNGMLPGPTLRWREGDTVTLRVTNRLREPTSIHWHGILLPFQMDGVPGLSFHGIAPGETFTYRFQVRQSGSYWYHSHSGFQEMTGVYGGLIIDPAGSDPIRADRDYTVLLADWTDEDPMRILAKLKTQSDYYNYHQPTVADFFRDVASDGWQAALAKRRMWNQMRMSPTDLADLSGATLTHLANGITPAGNWTGLFAPGETVRLRFINGAGSTFYDVRIPGLKLKVVQVDGQDIEPVTVDEFRFGPGETCDVLVSPKDDAHTIFCQSMDRTGYARGTLAVRPGMQAPVPALDTPQWLTMTDMMGDMGGMGGMDHGGMTMMDAGDITPMAPADTDGMAMMDGSGGPDDLRVPSRKVRHARTEYGPGTDMRVDTPRTNLDDPGIGLRGNGRRVLVLADQHTLGGPLDRRGPQREIEMHLTGNMERYTWSIDGVEYGRSAPIHFRHGERLRVILHNDTMMTHPMHLHGMWSELEAPDGRFQVRRHTVPVQPAQRISFLVTADALGRWAWHCHLMLHMDAGMFREAVVA

SEQ ID NO: 12550 - protein, 292 aa, Ralstonia solanacearum
MTPFIALCLLITYVVWGTTYLAIRFALTDLPPFLMMGSRFLAAALLLTPIVLLRQRERVSPRQLRNCMLVGAFLLVGGMGMTAVAQQTISSGATTVMIASMPLFSTLWMLLAGGRLRAYEVAAIALGSIGIAVLFRGAEFQASTAGVLALTTAIASWSFGSQLSKHLDMPKGLTAFVLEMAFGGVALTLLSLATGEHWPRQIGLHAALAWGYQVTFGSAIAFTAYMALVQRVSTVMATSYVYVNPPIALLMGAWLADEQVAPQTLGATAIILSAVVVLTAGATRAARRAAPA

SEQ ID NO: 12551 - protein, 488 aa, Ralstonia solanacearum
MIQNFINGAYREGRAGKRFRDLDPCTGRLVAEVSEAGKEDVDDAVQAARAALNGPWGKLTLAQRCDLLYAVADEIDRRKEDFLAAEVADTGKPRALASHLDIPRGAANFRVFADAVRNVATECFTGTAPDGKPSLNYALRRPKGVIAVVCPWNLPLLLMTWKVGPALACGNTVVVKPSEETPATAALLGEVMNAVGVPAGVYNVVHGFGPDSAGEFLTRHPDVDAITFTGETRTGAAIIKASADGIKPVSMELGGKNPALVFADADLDAVIAGLKRSVFENTGQVCLGTERVYVERPMFDKVVRALAEIAGTLRPGLPGDPHANFGPLISGEHQRKVLGYYALARDEGATVHYGGGVPDMPPDLREGAWIEPTVWTGLPRDSRVLTEEIFGPCCHVEPFDSEEEAVRLANGTPYGLATSLYTGDVNRAHRVSAKLKVGVVWVNTWFLRDLRTAFGGSGKSGIGREGGVHSLEFYTELSNVCLKLEPQA

SEQ ID NO: 12552 - protein, 258 aa, Ralstonia solanacearum
MTPPNLNLFDLSGRTALITGASSGIGFALAGGLARAGARVVLNARGPEKLAQAADSLRAQGADVHTAAFDVTQSTAVAEGIARVEAELGPIDILVNNAGMQRRAPLEQFETDQWHELMKTNVDSVFLVGQAVARYMIPRGRGKIINICSVQSELGRPGIAPYTASKGAVKMLTKGMAIDWGPHGLQVNGLGPGYFKTELTQALVANAEFTAWLVGRTPSRRWGDVEDLTGAAIFLASKASDFVNGHILYVDGGVTATL

SEQ ID NO: 12553 - protein, 437 aa, Ralstonia solanacearum
MSSTPIVSQDAIAQAAVVPRAYSVLASSTFAFTICFAVWTMFAILGIPLQKQLGLSETEFGLIAATPILTGSLARVPLGMWTDRFGGRIVFFLLMLATVVPIWFVAEATRLWQFLLLGMLVGLVGGSFSVGTPYVARWFPKSRQGFAMGIFGAGNAGAALNKFVAPLLVVAAGTWTVVPRVYAVAMLVTALLFWFGSATNPAHAAGKSVSLRAQLRVMKDPRVWRYSQYYSVVFGGYVGLSLWLTRYYVSEYGFSIKTAAFLAACFSLPGGVLRAVGGWLSDRYGASRTTWAVMWVCWVAFFLLSYPQTQFTVTSTRGPLDFHIGLSPLAFTALIGVVGVAMAIGKASVFKFISNDFTDNIGAVSGAVGLAGGLAGFVLPILFGVLVDLTGIRSTCFMLLYGAVCVSLVWMHFSFRAGRGGMPSEPPRPAALAQRAA

SEQ ID NO: 12554 - protein, 676 aa, Ralstonia solanacearum
MRSIVKSLLHPSSRAPAAHRAQDAALFSTHPQGDAPPIRPSAWLVAIGAAVAGTFARLMLESAAGIRLPFYLAFPVVTVAAWYGGFWPGVVAIAGYAALFAGLAALQISPPPAQPILPTQLVVLALGTLLICVLCEQLRRARAGAERRARAETQQRVSQQRLLAALQASPISLYDVDNTMHFTWVHNPVFGLQPHELLGRTVREVFGRRAASRLTDAGQRVIATGLPTRVEFAFRRRHTQRVVYDVVVMPLRDDTGEIIGLTNAVIDITEHRQAEARRALLLEAESRAREEAERASRLKDDFLATVSHELRTPLNAVLGWAQLLAMRPYDEAMFRRGLEAIERSARTQVHLIDDLLDMSAILSGKVPLEIGPVDLADVLERARETIEPMARQKQITVDTEYLPVPLLQGDAGRLKQVFWNLLANAVKFTPEGGHVRITVQAGADGLVATVRDTGIGIEPTFLPHVFDRFQQADLSSTRRHGGLGLGLAIAKQLVELHHGHITAASSGADLGTTMAVTLPLHAPPSNEPPGRAPGLVTGTAAPALDGLRVLVVDDNAESLGVIALMLERYGAEVVTVASGAAALDALDRAAGGPPFDALVSDLAMPGMDGMQLLRAIRARGLTALPAIAVTAFADPIRLKAAKEAGYQSVITKPIFPGELGHVLAANVRRATGPQDA

SEQ ID NO: 12555 - protein, 441 aa, Ralstonia solanacearum
MTGKATRIDLFSLRTPQMRAFHLTWLAFFVCFYAWFACAPLMPVLKGEFHLTPGQIANINIAAVAVTILVRLIVGPLCDRFGPRKTYTGLLVLGAVPVLGVALAQSYEAFLFFRLAIGAIGASFVITQYHTSVMFAPNVVGTANAAAAGWGNAGGGVAQGTMPLLLTAIVMLGVTQGMGWRLAMVVPGVAMLIVAVLYWRYTQDCPEGNFDDLRAAGKTIEGGKKGGWGSFVTAAGNYRVWLLFVTYGACFGVEIFIHNIAAIYYVDHFGLSLSAAGMAAASFGLLALFARALGGIVSDRVARSRGLDARTLLLCVLMVGEGLGLLGFAHAGTASLAVLAMLGFGLFTHMACGATYALVPFIDRRALGGVAGIIGAGGNVGAVAAGFLMKGLGDAQQTLSVLGVMVMLSAICAVAVRFSAEHKAREQALYDNTLAAGAANV

SEQ ID NO: 12556 - protein, 271 aa, Ralstonia solanacearum
MSQDQLPEWFELRGALERMASEGTLLKSVVDRFLNQPRFEGALSILLADQLASARASAAQLLPVIEQAYRDHAELSRLAVSDMRATMERDPATDCLSTVFLFSKGFHALEAYRVAHHYWCAGRQGTALSLSHACSCLLGVDIHPAAKIGAAVMFDHASGIVIGETAEIGDEATLLHGVTLGGNGRHRCDRHPKIGAGTFIGAHASIIGNIRIGKDSIIGAGAVVLADVPDNSVAVGVPAKGKARERKPDAEFQPVLAAAGVAGSPSPVFLG

SEQ ID NO: 12557 - protein, 493 aa, Ralstonia solanacearum
MALTFDQLRHTGLIRTDNLIDGRWSAGADGARYAVTDPATGSIIAQVADSSAADARAATDAAARALPAWRDTLPAERAAILRRWHAAIVANADALGRLISLEQGKPFAEGRGEVMYGASYVAWFADEATRIYGDLIPQQQRGKRMSAIKEPIGIVAAITPWNFPLAMIARKIAPALAAGCTVVAKPAEDTPLTALALAQLAQEAGLPPGVLNMIAASRERGVAAVADWLQDGRVRKITFTGSTPVGKHLARESAGTLKKLSLELGGNAPFIVFDDADLDAAIAGLLSAKFRNGGQTCVCPNRVYVQAGVYDRFAAMLAARVSALKVAPATDPDAQIGPMINARAVDKIERHVQDAVAHGARVLAGGKRLPEVGAHFYAPTVLADAHPGMALCGEETFGPVVPLFRFTDEAEAVQAANDTPFGLAAYFYSQDVRRIDRVAHALEAGIVGINEGALASEAAPFGGVKESGYGREGSKYGLDDYLSIKYLCQGGLA

SEQ ID NO: 12558 - protein, 1098 aa, Ralstonia solanacearum
MPQRLLTKTGRYSRRVLYGCTAALSIAIVGAVLLLGRGIIDQYGDRQVARFVRTSGEVRTEVDGLSARLAQFADLYEGVWNLRQNDVVPTRRYAGKLAADRGATVTGADLTATPVTLISSLDRPADGARLAMALRVLRDVSGAPLMDAQKLGVTLDGFLYTPDATFLAAFPALRPADLRSAREQGPQPFIRERIAAVEQRIASSAPEAVRGRRPLWYPADETNGHASVSQLIVPMYRDNARVLTIALTLPDAQFTRFFLRKESRRPGFFLLSQTGQRSLGDLPADLEERRLLDTVLANADWSRQAGAEPTTFYKDGVFFVSRRIAGPDWIAVYAYRWQDVWSDLQHEFFAGMVFCVLVLGLLWATAAYFDLRVTRPLLSDAKKLIEAEHFSKAIIDTLPIGIGVYSPETDSILLENSVAVRMLGNVSNEQRLRFYRYVMHERDAEPVPGARHSFIEVRWERAEGQSSYIGVASSWTRFGGRSAVLLGLVDMNERKANEILLMEAKQTADEANRAKSMFLAIVGHEIRTPLHGAMGHLELLARSALSLEQREWVDMTSRSFDALLTLVNDLLDSTKLEANALQISPVPMCPNEVLERCARSFGAAIVQGGVAFHCITDPDLDLVVDGDDQRLTQILQNLLSNAAKFTERGTITIASRCLKREDGKVWARFEVADTGIGIPAAMQSTIFNPLAQADDSISRRFGGTGLGLFLCRNLAHLMGGRISVRSEPGIGSAFRVDLPFAQNTRAPAPPPPVLTGLSVELLCPVSQWRGMLAERLRRWGATVRPAEASAAEPLHIRLAVEADGRAWHAADLGTVPLLGTVFVTAKGPLHAHRDGQKIEVSSFTREGLLAALTELTGAAARPAETPVSMAVDEGLGADLDILVAEDDAVNRTLIRHQLAALGCQRVRVAVDGVEALEMWLERRADLVITDLGMPRLDGIGLLHKLRELDPRARVIATSASVSAEIKADVEQFSSLLQKPVSLGDLRRILRQEMLSRTASPTPAVAEPVRADALDALLRQAFRTEWNKERKSIEQALAGKDMDALRRRVHRLQGALMALGADALVEELRGLQDIYSRADWALIAIRCHQLLAHVDASVG

SEQ ID NO: 12559 - protein, 796 aa, Ralstonia solanacearum
MKEPVVSHFVPERGITSAPGRSYGTEPLDVFWVDDLLDGTRLHVSAAARQRWGMSPETLCGPREHWLAHVHSGDHAALRAAWQGLAQGRDFALEYRWIGTDGAEHRVRECGYRLPAQGGAATHAVGVVEDMTQRLRTLAELTESEFQLQWLAESIPFPIVQLGPDHCIRFANHAYAQRFGLPAADVLGRHVRELMGHEAYQRVLAHLMKGFAGQRVDFEMELEYPYVGPGRRFIHAAYTPQRGPDGKVVALVCIIEDITERKEAERERFRHQREFVTLVENAPDIIARLDPALRCVYINRAVTEAFGVPSGELIGQALSDSGLPACITGPLEAAAQCAFDTGGEQALTLHLEADAARPHVAHYNARVIPEADRHGEMESALLIIYDVSERTEAERERNALLLREQAARAQAEAAAHARDQFLAVVSHELRSPLNGIQSWAYVLENQLAEGSQPVQRALAGIRTGVAQQVRLIEDLLDATRVMSGKLRLTRQPFPLRTALERALDSVRAQAAERRITLHEAWSLGTEEIDGDADRIQQIVWNLLSNAIKFTQEGGDVWLAADVSGEVARIVVRDNGRGIAPAFVPHLFDPFRQADGSHTRRTGGLGLGLALVKRLTELHGGLVHAQSDGEQHGAIFTVYLPLHEGAELTAALAEDVVRPGPLPSLGGLRVLLIDDQQDAREALATLLGQVHAEVGSAGSGDEAIAQLEAWGGLRRPHAVVCDIALPDEDGYAILQRIRGWERRHLPAGVAQVPAIALTAFAQPHDRARALASGFQEHLSKPVSPRDLVRALRTLARR

SEQ ID NO: 12560 - protein, 894 aa, Lupinus luteus
MPSLHSLIFLLLLGVVITPPVLANYKQPTYEPPTPIFEPPPFETLPPVYEPPPVYHPPREKPSIENPPPSYEKPPPHEKPPHEKSPPEYSPPHEEPTPEFPPSHEKSPPLYPSPHEKPPIECPPPHDKLPPIYEPPNEKPPPLHPPPHEKPPIDYPPPHEKPSPVYEPPYEKPPILHPPPHEKPPPLYESPSEKPPHVHPPPPHKKPPIGYPPSYEKPPPVYEPPYEKSPPVHQPPYETPPIENPPHEKPPIHESPYEKPPPVHPPPHDKPSIEYPPPHEKPPVYEPPYDKPPPVHPPPHEKPPIEYPPPHEKPPVHEPPYEKPPPEHSPPHDKPPIEYHPPHEKPPIEYPPPHEKPPIEYPPPHEKPPIEYPPPHEKPSIEYPPPHEKSPVYEPPYEKSPPVHPPPDEKPPIEYPPPHEKPPVHEPPYKKPPPHDKPPIEYPPPHEKPPVYEPPYEKSPPVHPPPHEKPPIVHPPPHEKPPLFEPPFEKPPPVHPPPVHPPPHEKPPIEYPPPHTKPPIEYPPPHVKPPIQYPPPHEKPPIEYPLPHEKPPVYEPPYEKPPPVHPPPHEKPPIEYSPPHEKPPVHEPPYEKPPLVHPPPHDKPPIEYHPPHEKPPIEYPPPHEKPPIEYPPPHEKPPIEYPPPHEKPPVYEPPYEKPPPVHPPPDEKPPIEYPPPLEKPPVHEPPYEKPPPVQPPPHDKPPIEYPPPHEKPPVYEPPYERSPPVHPPSHEKPPFVYPPPHEKSPMHEPPYEKAPPVHLPPHEKPPIEYAPPHEKPPVEYPPPHVKPPVEYPSPAEKPPTHEKPPIEFPPHEKPPVYEPPYEKPPSVCPPPHEKPPHHEKRSALYPPHHRKPPNHHKPLPYKKPPFYKSHQWKSHQATSPNLMPSSTSFQKNDE

SEQ ID NO: 12561 - protein, 134 aa, Caenorhabditis elegans
MHQAGNINDQAGRSSNSDGNASDDGHPPALTPILLKSYLKNSDAKSHLTLSNAHSMPAVGLGTWQSNAEDVISAVKAAVKNGYSLIDTASGYNNEEFIGTAIKEVIAEGVVKREDLFITTKVPNLFSSLRLVSL

SEQ ID NO: 12562 - protein, 317 aa, Caenorhabditis elegans
MSSATASIKLSNGVEMPVIGLGTWQSSPAEVITAVKTAVKAGYRLIDTASVYQNEEAIGTAIKELLEEGVVKREELFITTKAWTHELAPGKLEGGLRESLKKLQLEYVDLYLAHMPAAFNDDMSEHIASPVEDVWRQFDAVYKAGLAKAVGVSNWNNDQISRALALGLTPVHNSQVELHLYFPQHDHVDFCKKHNISVTSYATLGSPGRVNFTLPTGQKLDWAPAPSDLQDQNVLALAEKTHKTPAQVLLRYALDRGCAILPKSIQENRIKENFEVFDFSLTEEDIAKLEESKNSQRLFLQDFMTGHPEDAFAAERK

SEQ ID NO: 12563 - protein, 456 aa, Caenorhabditis elegans
MTKKGRNVVQSVGLLVLFGIYQCNAQYVVDVMRMTSFGEEELVHKCLAKGGNFGMDVSDFIISEENLGCGVGVEPVDACGPVRIAQNHTTRCHNLFAFVSRSNISHPCKFSHQAFMVQNSTYPFRLVIFYNYPGQEPISMEGTELRDKVNIPVLMISHACKEEIAKKFSDTAGYRLRVRIDPGYYELFRYLIPFLVVIVFCFALFLITLCVRGCVERRKLNKRRLSKRNLKKIPVKKYRLGDDPDTCAICLESFASGEKLRHLPCRHVFHCNCIDVWLTQTRKICPLCKRKIGTDSDSECSTNDLASTSQGPNDATALYNNADNQSGFELPVPQGQMVDLWSSQEALVDQDIVLHNTTRRSITGFVRNAFRKLRNSPRHRDVDVHSGLEGGSYLVRQQTTSNDNDHLLENEVSDPTSSSELNIPSSEELTVPTSISTHSLDTATTTTPSSPSHSCQ

SEQ ID NO: 12564 - protein, 506 aa, Caenorhabditis elegans
MASLNYREEFKNILQKLIDSPNEQHDPLTNFIGNEFARSEKLMDSVNPSTGKPWIKIPDGTAREVDQAVEAAKEAFKTWKKTTVQQRSALLNKVANLIEEFNDDIAILESRDQGKPIGLAKVMDIPRCVQNFRDFANAALYSLSTSTILEQPTGKFVNYVKNDPVGVAGLISPWNLPLYLLSFKLAPALVAGNTVVCKPSEMTSVTAWVLMHAFKLVGFPPGVVNMVIGEGKSAGQRLVDHVDVPLISFTGSTVIGKKIQEDGAKLNKKVSLEMGGKNPGIVYSNYRKSDIASIARSSFLNQGEICLCTSRLFVQKPIFADFVKSYVEEAKKFTVGDPTTQVQIGAMNSKVHYEKVKSYIELAKKEGADILCGGVTTIQNGCENGYFITPTVIVGLHDASKVMTDEIFGPVVCITPFDTAEEVIERANSTPYGLSATVWSSDSDELLNTANELRAGTVWCNTWLARDLSMPFGGCKQSGNGREGLHDSLHFYSDAKTVCVNIAAKY

SEQ ID NO: 12565 - protein, 950 aa, Caenorhabditis elegans
MAAEGHNVDANLVDMRPNHGHYFVKKTFGKPAYCHHCCDKIWGMLTTGYSCEMCNFVCHEKCLRTVVSYCSSVALQLIKNPVAHTWSAPCLIKRKYCCVCRKRTDDALSVECEVCEYYVHVDCSDLAVSDCKEAATYVANMESANTVQYHHMREGNLPKESKCIVCRKTCFSTECLAGMRCEWCGQTAHAVCYRQMDKECDFGVLRKIMLPPMCLTIPRTELPMEQLLNISSHDQPQSLSSPSKIQADDVSTSGEDVKEREDFEIIRVFDGNNSYRSQISRNIVVAKHVSVQQVRDAALRRFHINDTPERYYITQVVGEVEEEILEDPVPLRNVKRPEGKRAQIFIRYYDDPDKDEVKVYGGWLRKVPVTFCAISVSKDTVVQDLVTDALYHFGLDGSCWNRYNLIEVSLDRGVAERTCNPQENVLQLVRNLRKDSLRRYHVVRFYVQEKEDPHDHAVFVGNLPVSLAQRQYERILLKLLGAKEKPFTAIGPIYFEYGSLIITFNTPKAATAAVQKLQSAIYEEKKLIVLCLPNVQPQMIPKDVEPLLVLVNVKSGGCQGTELIQSFRKLLNPFQVFDVLNGGPLVGLYVFRNIPKYKILACGGDGTIGWVLQCLDIAKQDAACFSPPCGIVPLGTGNDLARVLRWGGGYTGEENPMDILKDVIEADTVKLDRWAVVFHEEERNQPTSSGNQTEMNEQTMNNPEDQTSMIIMNNYFGIGIDADVCLKFHNKRDANPEKFQSRLFNKTQYAKIGLQKMFFERTCKDLWKRIELEVDGRIIELPNIEGIVVLNLLSWGSGANPWGTSKEEGNFSKPTHYDGLLEVVGISDVSRLGLIQSKLAAGIRIAQGGSIRITTHEEWPVQVDGEPHIQPPGTITILKSALKAQMLKKAKKSRRGGATNATSLTHPHPETSESMSGPLGVPSTLGDPNHGKTTPDNTAADSDEEGDAFL

SEQ ID NO: 12566 - protein, 952 aa, Caenorhabditis elegans
MAAEGHNVDANLVDMRPNHGHYFVKKTFGKPAYCHHCCDKIWGMLTTGYSCEMCNFVCHEKCLRTVVSYCSSVALQLIKNPVAHTWSAPCLIKRKYCCVCRKRTDDALSVECEVCEYYVHVDCSDLAVSDCKEAATYVANMESANTVQYHHMREGNLPKESKCIVCRKTCFSTECLAGMRCEWCGQTAHAVCYRQMDKECDFGVLRKIMLPPMCLTIPRTELPMEQLLNISSHDQPQSRKVSSPSKIQADDVSTSGEDVKEREDFEIIRVFDGNNSYRSQISRNIVVAKHVSVQQVRDAALRRFHINDTPERYYITQVVGEVEEEILEDPVPLRNVKRPEGKRAQIFIRYYDDPDKDEVKVYGGWLRKVPVTFCAISVSKDTVVQDLVTDALYHFGLDGSCWNRYNLIEVSLDRGVAERTCNPQENVLQLVRNLRKDSLRRYHVVRFYVQEKEDPHDHAVFVGNLPVSLAQRQYERILLKLLGAKEKPFTAIGPIYFEYGSLIITFNTPKAATAAVQKLQSAIYEEKKLIVLCLPNVQPQMIPKDVEPLLVLVNVKSGGCQGTELIQSFRKLLNPFQVFDVLNGGPLVGLYVFRNIPKYKILACGGDGTIGWVLQCLDIAKQDAACFSPPCGIVPLGTGNDLARVLRWGGGYTGEENPMDILKDVIEADTVKLDRWAVVFHEEERNQPTSSGNQTEMNEQTMNNPEDQTSMIIMNNYFGIGIDADVCLKFHNKRDANPEKFQSRLFNKTQYAKIGLQKMFFERTCKDLWKRIELEVDGRIIELPNIEGIVVLNLLSWGSGANPWGTSKEEGNFSKPTHYDGLLEVVGISDVSRLGLIQSKLAAGIRIAQGGSIRITTHEEWPVQVDGEPHIQPPGTITILKSALKAQMLKKAKKSRRGGATNATSLTHPHPETSESMSGPLGVPSTLGDPNHGKTTPDNTAADSDEEGDAFL

SEQ ID NO: 12567 - protein, 287 aa, Caenorhabditis elegans
MEHREYVKNNMPLIGIGTWQVQKEEILRQVIDAGFKEGYRFIDTAQVYNNEAKIGRILEKLLPANGLKREDIWITSKLAPSNAGVKKARESIEESLSNLKVEYLDLLLIHWPGSSLKSENPANKKLRVESWNVMCEMMAEGKLRSVGVSNFEICHLEELKKDSNVVPAVNQVEYHPHFHQDDLVKYCNENNIHFQAYSSLGSPTYRKQLSEEPLIKELAQKYNVEIPVLLLGFAYCQGISVLPRTTNPEHVATNFKVTKLAITQEDIDRLLALTVEHKTCWDPRVVV

SEQ ID NO: 12568 - protein, 292 aa, Caenorhabditis elegans
MLNYDKMEKIGEGTYGTVFKARNKNSGEIVALKRVRLDDDDEGVPSSALREICILRELKHRNVVRLYDVVHSENKLTLVFEYCDQDLKKFFDSLNGYMDAQTARSLMLQLLRGLSFCHAHHVLHRDLKPQNLLINTNGTLKLADFGLARAFGVPVRCFSAEVVTLWYRPPDVLFGAKLYNTSIDMWSAGCIFAEISNAGRPLFPGADVDDQLKRIFKQLGSPSEDNWPSITQLPDYKPYPIYHPTLTWSQIVPNLNSRGRDLLQKLLVCNPAGRIDADAALRHAYFADTSDV

SEQ ID NO: 12569 - protein, 135 aa, Caenorhabditis elegans
MEQQIQMDEQENDESQGNDDQQNMSMSSSELHTMQDDHPGILLKTNTRMSITVKKLHVCGEWKWLQGGEDTCGICRMEFESACNMCKFPGDDCPLVLGICRHAFHRHCIDKWIAAPTNQPRAQCPLCRQDWTIVE

SEQ ID NO: 12570 - protein, 827 aa, Caenorhabditis elegans
MLLSPEQFSRLSEYAAYSRRKLKDMLSDFQQDGKFYSYLSVDGQHSRFPFCRQCIKHFKTINIDGFRAFLIDYFGADLPSDLVDQLFLSFSKPPIKERRTSLFEDAISTVRAKFSESLSGRMAGLNIAGGSGQQTDRSQSSEPQALVCIPEDDVMGPRVANNDSQEPRIPLKPLICTLSLLEADTPENKLDVVFHVYDSDGNGFLDKSEIDGIIEQMMNVARYQQWDTIELEQVIRQMMVDIDYDNDGIVSFDEWRRGGLTNIPLLVLLGFDTEMKEDGSHVWRLRHFTKPTYCNACCSILVGWGGKQGLSCSLCKYTVHERCVRSAATNCIRTYSSRQQDKLYHHWQDANATAKCVKCKATVGVFQGKGCRWCHNYVHHRCMSALAQECDLGALVHHILPPTHIFPAFLERKTSTSLKNHNFSSHSASLLQAVSPSNDCRPLLVLVNPKSGGKQGVKILQKFEYLLNPRQVYDLSKTGPEPGLQLFSTLKNCNILVCGGDGTIGWVLESMDKMTFPHGRPPVAVLPLGTGNDLARCLRWGGGYENENLHKILEQIEKSSLIDMDRWQIKIEITENKSARRASEKGDTPPYSIINNYFSIGVDASIAHRFHVMREKFPEKFNSRMRNKLWYFELGTSETLSSSCKNLHEQIDILCDGESIDLGQDASLEGIALLNIPSIYGGSNLWGRSRKSKGRMPGLFPMKNAEKMQLQTRVQDIGDGLIELVGLESAMQMGQIKAGVRGARRLSQCSTVVIQTHKSFPMQIDGEPWMQPPCIIQITHKNQAKMLVGEFRHILELSINFFLFTAAAPRKRSSWMLLKRQSTNDDN

SEQ ID NO: 12571 - protein, 473 aa, Caenorhabditis elegans
MHYHHPTILPFFLIFMRFLQSSVDAVYTNVKLQCIDSEEVYGTLQTELTFSNKDGGGSTFLPAYTDLCAPDMKFDDSQRVFFCKNCIQNCLSRVETAPKNILIVADVKAPNNRVSWFHVQTPVSNIRESGKQCNVENSNAMQSPEETSTDALRSFSKTSVLFVSISFIILMVISLAWLVFYYVQRFRYAHAKDRLQRRLFNAARKALTRIPTMTITPGMTQELQSDCAVCLDPYQLQDVIRLLPCKHIYHKSCIDPWLLEHRTCPMCKNDILKHFGYWNDIRNDIQMPTNSRGIADDFTIRLELGEQEHQAPSADVISPEANSDTSDSQGFSFDNSEHHHSESFGYGTSSTVPPQLVLNASNAKSFVMPLSSRGVSQGPQASRDFRSARAPRDHRASLHELPRPQTSAASQGQIVNLVQVKSRSASITRSAATIRKESLPTPIEITTSTVIPATSSTSGTTMTTATATNSHVI

SEQ ID NO: 12572 - protein, 327 aa, Caenorhabditis elegans
MALNFWKSSHCQQWIFDKTEIWKQRAEDMKIYNEEEYNRLNIFWANFITAVATEGAHSQANVGCKLRQQVIATAIIYFKRFYLRQSFRDMCPFLVASTALFLACKVEEHTTLSVSSFLKNTAIVLPKRWGVTFETTSTKNGVVYDSEFILVEILDCCLVVHHASRPMCPPPPPREIFDKNWNSGIFLIFFLNFLVKKMENCGIFSEKLENFEFFNLEAIEAQCQKVANDSLRCDVSLIFPPHVIGLSSIMVAMELMGRGEELEAWLVEVDTDFEKVTDCVEQIYKMYTLWKSFDEKEEVKKLMAKLPKPNQQPPPQQQHQHQQGYHL

SEQ ID NO: 12573 - protein, 509 aa, Caenorhabditis elegans
MGPQPVHRLHSLDHKPDESSEEWKTSTKLEALGSMEGELAHLLSTCKPETLNHNKTELSGFRNLFARFLRAKPTVDWSKIEPLPEGAIRPYKSLGHVVDKELIASQLRKLVVVKLNGGLGTSMGCKGPKSVISVRNDLTFLDLTMQQIQTLNKTYGVDVPLVLMNSFNTNEDTQKVLKKYANVKVSVHTFSQSQYPRINRETLLPIVKSLEADDNECWYPPGHGNFYEAFHNSGLLDKFLADGKEYCFLSNIDNMGATVDLSILNFVLNPSPDQTAPEFLMEVTDKTRADVKGGTLIQYEGRLMLLEIAQVPKDYVDEFKSISKFRIFNTNNLWAKLDAMRKIVVENKLEMEVIVNPKHLDRGLDVIQLETAAGAAIKSFSGAVGVNVPRSRFLPVKKTSDLLLLMSNLYDIDNGSLTLSHQRSFPTTPLVKLGSSFDKVKDYLGRFNGIPDLLELDHLTVSGDVWFGKDVSLKGTVIIIANHGDRIDIPPGSILENKIVSGNLRILEH

SEQ ID NO: 12574 - protein, 497 aa, Caenorhabditis elegans
MNVSFSTSSLSVSNSRTRLISFRETEHGDQKSSEEWKTSTKLEALGSMEGELAHLLSTCKPETLNHNKTELSGFRNLFARFLRAKPTVDWSKIEPLPEGAIRPYKSLGTSMGCKGPKSVISVRNDLTFLDLTMQQIQTLNKTYGVDVPLVLMNSFNTNEDTQKVLKKYANVKVSVHTFSQSQYPRINRETLLPIVKSLEADDNECWYPPGHGNFYEAFHNSGLLDKFLADGKEYCFLSNIDNMGATVDLSILNFVLNPSPDQTAPEFLMEVTDKTRADVKGGTLIQYEGRLMLLEIAQVPKDYVDEFKSISKFRIFNTNNLWAKLDAMRKIVVENKLEMEVIVNPKHLDRGLDVIQLETAAGAAIKSFSGAVGVNVPRSRFLPVKKTSDLLLLMSNLYDIDNGSLTLSHQRSFPTTPLVKLGSSFDKVKDYLGRFNGIPDLLELDHLTVSGDVWFGKDVSLKGTVIIIANHGDRIDIPPGSILENKIVSGNLRILEH

SEQ ID NO: 12575 - protein, 522 aa, Caenorhabditis elegans
MNVSFSTSSLSVSNSRTRLISFRETEHGDQKSSEEWKTSTKLEALGSMEGELAHLLSTCKPETLNHNKTELSGFRNLFARFLRAKPTVDWSKIEPLPEGAIRPYKSLGHVVDKELIASQLRKLVVVKLNGGLGTSMGCKGPKSVISVRNDLTFLDLTMQQIQTLNKTYGVDVPLVLMNSFNTNEDTQKVLKKYANVKVSVHTFSQSQYPRINRETLLPIVKSLEADDNECWYPPGHGNFYEAFHNSGLLDKFLADGKEYCFLSNIDNMGATVDLSILNFVLNPSPDQTAPEFLMEVTDKTRADVKGGTLIQYEGRLMLLEIAQVPKDYVDEFKSISKFRIFNTNNLWAKLDAMRKIVVENKLEMEVIVNPKHLDRGLDVIQLETAAGAAIKSFSGAVGVNVPRSRFLPVKKTSDLLLLMSNLYDIDNGSLTLSHQRSFPTTPLVKLGSSFDKVKDYLGRFNGIPDLLELDHLTVSGDVWFGKDVSLKGTVIIIANHGDRIDIPPGSILENKIVSGNLRILEH

SEQ ID NO: 12576 - protein, 511 aa, Caenorhabditis elegans
MAQRHVSVGCFSTFSEAEAKSSEEWKTSTKLEALGSMEGELAHLLSTCKPETLNHNKTELSGFRNLFARFLRAKPTVDWSKIEPLPEGAIRPYKSLGHVVDKELIASQLRKLVVVKLNGGLGTSMGCKGPKSVISVRNDLTFLDLTMQQIQTLNKTYGVDVPLVLMNSFNTNEDTQKVLKKYANVKVSVHTFSQSQYPRINRETLLPIVKSLEADDNECWYPPGHGNFYEAFHNSGLLDKFLADGKEYCFLSNIDNMGATVDLSILNFVLNPSPDQTAPEFLMEVTDKTRADVKGGTLIQYEGRLMLLEIAQVPKDYVDEFKSISKFRIFNTNNLWAKLDAMRKIVVENKLEMEVIVNPKHLDRGLDVIQLETAAGAAIKSFSGAVGVNVPRSRFLPVKKTSDLLLLMSNLYDIDNGSLTLSHQRSFPTTPLVKLGSSFDKVKDYLGRFNGIPDLLELDHLTVSGDVWFGKDVSLKGTVIIIANHGDRIDIPPGSILENKIVSGNLRILEH

SEQ ID NO: 12577 - protein, 639 aa, Caenorhabditis elegans
MVQVAPVAAGAGSGQTRPSSDPKTGWFVYMLAFSAVIGGFLFGYDTGIVSAAMLYVPNASGIKPLDSVWQEIIVSITPGVAAIGSLCSGPGSDFLGRKKIIIGASVTFTIGAIICAAAWTKIILLIGRILLGLAIGFASMIVPIYVSEASPSHIRGKLVTGFQLMITVGLVIANIIGGAFSYVDPDQVGWRQKSDFFLEFLLPNSQLISIFSKFHFQSFPNPPFSRLMFAFAAVPAIIQFVCFLFLPESPRWLYEHGRTVEAREVLTRIYNGHTEWVDYEINEISFSYEEELRAKAEHAGNGPTIIRILKTPHVRKAMIIGSLLQMFQQLSGINTVMYYTGNIIRSAGVKDNHTTIWISVGTSAINFLGTFIPIALVERVGRRVLLLVSMIGVILFLIAMGVSFLLINNDSLRTFDQQNYTLNYNPSVKHAAKCLKYSNCDFCVTDENCGFCESKVAKKGYCLPFPSDDSSDYSATGICEFSNLTNNGTDFEWEDTYCHTKFTVLPIIIMVFYLLSFSAGYAPLPWVLNAEFYPLWARSTAVSVSTACNWIFNLIVSLTFLSLSQAATKYGTFFIYCGCTMVALVFVFFFVPETKGYSIDEVEMLFMTKEERRKAQKVLDESKEGKHRNSVAMSFDTKF

SEQ ID NO: 12578 - protein, 531 aa, Caenorhabditis elegans
MKDRFKQKYTAGAAVAYMSRKQALKKLQLTLKDFRRLCIIKGIYPHEPAHKKQANKGSTANKVFYYRKDINFLAHEPIINKFRDYKVFLRKLNHLKAKKEEDKLKKLYENKPVYSLDTIVKERFPTFGSALRDMDDALSLCFTFAMLPHTRVLKEGMIDSCRKLTAEFMHYVIESQSLRNTFISIKGIYYQAEVHGEKITWVVPHERGLPHVTDVDFTVLVTFVEFYIAMLGFVNFKLYQDIGLFYPPQIGQVVKTDEMETEEYKEKVYSLAKPLAKRKDVEQAEDDEPLDLLGEDSDALAQKVREAKSIKTMFKGCVFYLNRECPKEALTFIIRNGGGIVGWEGGPTDLKADSKNISHHVVDRPMDKLEVNRLYVQPQWVFDCLNARRKLPTERYMPGVALPPHFSPFTSEKAGDYIPFERLEELRSMGKDVSDLEAAIPKTMDELPMRRKEVKPEKPKGIHIAVGQMHKKSKEKFHETVEKGQELKMRELMISKKHQRVYHSMKTTFKRNRNDALKLKKKAKLAKATEA

SEQ ID NO: 12579 - protein, 233 aa, Caenorhabditis elegans
MPASVTHVIFDFDGLLVDTESAYTEANMELLRKYGHVFTMDLKRRQMGKRHDESIRWLINELKIGDLVTPEEYSRQYDELLIEMFKRSPAMPGAEKLVRHLLHTGVPVALCTGSCSRTFPTKLDNHKDWVNMIKLQVLSGDDPEVKHGKPHPDPFLVTMKRFPQVPESADKVLVFEDSYNGVLSALDAGMQCVMVPERSIFDPDSDPEFKNRVTVILNSLEQFKPEDFGLPPY

SEQ ID NO: 12580 - protein, 235 aa, Caenorhabditis elegans
MASETKAPSEEPTSSSNKDESARFECNICLDAAKDAVVSLCGHLFCWPCLSQWLDTRPNNQVCPVCKSAIDGNKVVPIYGRGGDSSDPRKKVPPRPKGQRSEPPPQSFAGFNWGGDGGMMGGGGPNVHFSFGIGTVNGLFPLMFMLPFIQGIFPLSFVASFFGNGNQGAAAAGGGNGGGNDGNDGTHAHTHGHTHGPRGHGESAAPGSRMAQEEEYLSNIFKYIGFFMLFWLLFV

SEQ ID NO: 12581 - protein, 309 aa, Caenorhabditis elegans
MGHRSRSNSRSQSRSRENSRGRSRSASKSPVYHRRERESSRSRSPRARYGGGGGGGGGGGRGRNQQYDRENPQPSKCLGVFNLSSYTTEKDLRDVFGEFGEINKCDLVYDRPSGNSRGFGFIYFNLIEDATAARDKLCNTDLDGHKIRVDFSLTKRGHSPTPGQYMGDRRGGGSSGGGRFGGGGGDRFNDRGSRGGDRYGGDRRGGGGGGGGDRYGGGGGDRYGGDRYGGGGGRRGSPDRRGGFRSGGGGGGYMRSGGGGGGPDRRDHRDNDRNGGGGGHRPYDPSFRRRVESYGSGNSGGGGGRRDRY

SEQ ID NO: 12582 - protein, 332 aa, Caenorhabditis elegans
MDPIREGEVAHEGDSVYTLNDFTKLEKIGEGTYGVVYKGKNRRTNAMVAMKKIRLESEDEGVPSTAVREISLLKELQHPNVVGLEAVIMQENRLFLIFEFLSFDLKRYMDQLGKDEYLPLETLKSYTFQILQAMCFCHQRRVIHRDLKPQNLLVDNNGAIKLADFGLARAIGIPIRVYTHEVVTLWYRAPEILMGAQRYSMGVDMWSIGCIFAEMATKKPLFQGDSEIDELFRIFRVLGTPTELEWNGVESLPDYKATFPKWRENFLRDKFYDKKTGKHLLDDTAFSLLEGLLIYDPSLRLNAKKALVHPYFDNMDTSKLPAGNYRGELELF

SEQ ID NO: 12583 - protein, 509 aa, Caenorhabditis elegans
MSHVNQAVSCIFCYFQEMSFVCGISGELTEDPVVSQVSGHIFDRRLIVKFIAENGTDPISHGELSEDQLVSLKSGGTGSAPRNVSGTSIPSLLKMLQDEWDTVMLNSFSLRQQLQIARQELSHSLYQHDAACRVISRLSKELTAAREALSTLKPHTSAKVDDDVSIDESEDQQGLSEAILAKLEEKSKSLTAERKQRGKNLPEGLAKTEELAELKQTASHTGIHSTGTPGITALDIKGNLSLTGGIDKTVVLYDYEKEQVMQTFKGHNKKINAVVLHPDNITAISASADSHIRVWSATDSSSKAIIDVHQAPVTDISLNASGDYILSASDDSYWAFSDIRSGKSLCKVSVEPGSQIAVHSIEFHPDGLIFGTGAADAVVKIWDLKNQTVAAAFPGHTAAVRSIAFSENGYYLATGSEDGEVKLWDLRKLKNLKTFANEEKQPINSLSFDMTGTFLGIGGQKVQVLHVKSWSEVVSLSDHSGPVTGVRFGENARSLVTCSLDKSLRVFSF

SEQ ID NO: 12584 - protein, 300 aa, Caenorhabditis elegans
MSKEKSFDTKKFLIDLASGGTAAAVSKTAVAPIERVKLLLQVQDASKAIAVDKRYKGIMDVLIRVPKEQGVAALWRGNLANVIRYFPTQAMNFAFKDTYKAIFLEGLDKKKDFWKFFAGNLASGGAAGATSLCFVYPLDFARTRLAADIGKANDREFKGLADCLIKIVKSDGPIGLYRGFFVSVQGIIIYRAAYFGMFDTAKMVFASDGQKLNFFAAWGIAQVVTVGSGILSYPWDTVRRRMMMQSGRKDILYKNTLDCAKKIIQNEGMSAMFKGALSNVFRGTGGALVLAIYDEIQKFL

SEQ ID NO: 12585 - protein, 207 aa, Caenorhabditis elegans
MADEIFKAFIGGLPYDSIATDIETILKHCKFTDEELKKFDIHLVHDRDSGSFKGFAYVTFENEQQMNTAISGLNGADFGNRVLKVNRAQQRDRSDRGGGRGGRGGNFGDRGGRGRGAGGFRRGGEGGRFNEGERRGGFGGGGHRGGYRQRRESEEQHKAEETSDPSAPPAERPRLNLKPRTTDAAEIEARKKQEEEETKRRQEKLFQ

SEQ ID NO: 12586 - protein, 634 aa, Caenorhabditis elegans
MVSWGRGKDAYYLYISREQEEDDDDSLSFYSSQKDTEDEFCGCLFPDPEIPGSSSSSGCSSSSTELYDLAAAHAALISRQQQILSQAIPIIPEHQLAAVAAHHQHHQQLHPSVQYQLVAAATHHNHHQPQAAQPHYSAVVPRSDVIQQPPHFALHHHLQNLVQQQQQQQAHHHHQQLVGEMALVSHTHPAAVGSTTCYEKNQQKQQQVQQIPTQPQVAHVSSNAILAAAQPFYPPPVQDSQPDRPIGYGAFGVVWSVTDPRSGKRVALKKMPNVFQNLASCKRVFREIKMLSSFRHDNVLSLLDILQPANPSFFQELYVLTELMQSDLHKIIVSPQALTPDHVKVFVYQILRGLKYLHTANILHRDIKPGNLLVNSNCILKICDFGLARTWDQRDRLNMTHEVVTQYYRAPELLMGARRYTGAVDIWSVGCIFAELLQRKILFQAAGPIEQLQMIIDLLGTPSQEAMKYACEGAKNHVLRAGLRAPDTQRLYKIASPDDKNHEAVDLLQKLLHFDPDKRISVEEALQHRYLEEGRLRFHSCMCSCCYTKPNMPSRLFAQDLDPRHESPFDPKWEKDMSRLSMFELREKMYQFVMDRPALYGVALCINPQSAAYKNFASSSVAQASELPPSPQAW

SEQ ID NO: 12587 - protein, 296 aa, Caenorhabditis elegans
MKMREIEENAFEFKSGALCVHDGVCTHCIPYHPGMSTSLRLTQSLHFLGKSTMLSSKLAIVTGGGSGIGQAICKKFAASGARLIVADLKKSAAEATAGNLPGNGHSAFEIDVSDPEHVARLQEFIKSSGESPSVLVNCAGITKDATLLKMSQNQWQDVMNVNLNSVFLMSQMIARESVAAGSPLSIVNVSSIVGKIGNFGQTNYAATKSGVIGFTKSAARELATKNIRVNAVLPGFIRTPMTEAMPPKVLDAMVSMVPQRRLGETEEIANAVLFLASDMSSYVTGTTLEVTGGLGM

SEQ ID NO: 12588 - protein, 512 aa, Caenorhabditis elegans
MILLLFITLFALGSTAPADQQITSLPNLTEPLRSKHYAGYLSISDVKQLFYWYVESEESPETAPVVLWLNGGPGCASMEGLFIEMGPFRVRNYGEEVNRNPWTWNRIANIIYLDAPAGVGFSYYNTTKKVFTDDEVAQDNFNALKMWFARFPERKTNDFYIAGESYGGTYVPMLSARITKANVDFPQFKGMLVGNGCVDDQINFNTNIMYQYYHAVVDETQMQNVTQQCCNGTMDCDYYTISQGNDTCGDLVNQLSYSIYYTGYDPYFLYFACYLNPNLPYPPHEEIRKLQKNVLRNNLYKKIIGESPVLKNKYFYPPSNDIQGQPDCASHDDHFPYLNSPEVKKALRIPDYVPKYEMCNMEIAENYQSQYPTMKKFFDTVIDAKKHVAMFNGDADTLCNYVENSQFIYKTLKKTVKTAMMPWNDPVQLPMAVGQVTEYDGITLISIKGGGHFPAATEQKPKETFQMFQNYVKHQNYSTPVAFDKTFNLTSTIIAVGSKLFLSFCISIILFL

SEQ ID NO: 12589 - protein, 574 aa, Caenorhabditis elegans
MCQSTSRSKDKILSVNDRVAFFSLFHSIQLTPVHYTGHVLTELTPLFSLNVSEFFVVLFSNKQDTVFNTIFSVSKMVFTVPSDLSGGLYFLNGKRTTIESTETFDVIEPRIGQVVAKCPKATADIVDQYVKAAADAQSAWGETTALDRGKVLHKVADLIREHAEEIAIWEVKTNGKPIYEARCDIASSADTFDFFGGIATAVLQGDSLELPGGPSQRIAYTRREPYGVVGCIGAWNYPFQTCVWKVAPALAAGNAVVYKPSPFAPASPVLLGEILTAAGVPKGVYNVIQGEQEAGVALCEHNLVAKVSFTGSVASGEAVQRQAATKNVKPVTLELGGKSEIIIFDDSDVKSAVASAMLANFLNQGQVCTNATRVFVQKGILASFTEAIVQEANDKLKVGDPLLEDTRVGANINEGHLQRILGYVESAKQEGGVVLRGGVRVHPTGVEGGAYFEPAIITGLSDEARAVREEIFGAVMLILPFETEEEVIARANNTTYGLAAGVFSGNLARGHRVAARLQAGTVFINTYNDTEVNVPFGGFKNSGHGRENCIDTLRAHTQTKAIYVNVQDTTEHCF

SEQ ID NO: 12590 - protein, 485 aa, Caenorhabditis elegans
MRSALSLKPSNGNAAKSQAVNNKNVIKNAPLGGKLTRQIGTSNLLQQALPSKKIDESPIIKIDAKDSFKVFEDQEPEKENSSENVDATEKDSNVIPAEDNNMIHELERKMEEKSRAEKLKFKFMQTRDNSDITSRFSEPPSEFSVLCDDDDCDKVSVASSTFTTSVRATFSSFHFDENQRKKEFGKEEAVKKIQKKAAKEARDDSMFSSEEFFPDIIKYMLHRQTKNRASHECFDIQSQVNEEMRTILIDWFSDVVKEYNFQKETFHLAVSLVDRALSMFNIDKMRFQLVGTTSMMIAVKYEEIFPPEIEDFALITDNTYRVPDILLMERFLLGKFDFVVAMPTSSWFGTCFAKRMNFTKKMRNTVHYLLELSLIDVHFLRYRPSDIAAAACCFANLQADVESWPQKMVDDTGISTEDFVDVLRDLHRMYLNASTADFKSIFYNYSETAQMEVALLPAPTDKLRSMFPSIFVTAPKSSNDSSSPQ

SEQ ID NO: 12591 - protein, 233 aa, Caenorhabditis elegans
MDTFFPIIFSTELKKPICLQIYRQGHVGDISGFPFLMGTLVLPFWLRYGFLRNDVMLISINCAGIPIAVFNAMFFLYFSKPKKYYMTQLSIVTIIILTMLMLIHFNPNVQFLGFVCIVLNLITFGSPLAGLRVVLRDREVITLPFVLCLVQLIVQCLWNLYGILIQDFFLVIPTAVGIMISLVQLSLFLIFPRKRDGYSPMAKVARCVFGSSNNRKEVPDEPQKIVVESNTVY

SEQ ID NO: 12592 - protein, 278 aa, Caenorhabditis elegans
MTRFAEKVAIITGSSNGIGRATAVLFAREGAKVTITGRHAERLEETRQQILAAGVSEQNVNSVVADVTTDAGQDEILSTTLGKFGKLDILVNNAGAAIPDSQSKTGTAQSIESYDATLNLNLRSVIALTKKAVPHLSSTKGEIVNISSIASGLHATPDFPYYSIAKAAIDQYTRNTAIDLIQHGIRVNSISPGLVATGFGSAMGMPEETSKKFYSTMATMKECVPAGVMGQPQDIAEVIAFLADRKTSSYIIGHQLVVDGGSSLIMGLHCQDFAKLLH

SEQ ID NO: 12593 - protein, 326 aa, Caenorhabditis elegans
MSLERVFLKKTLAEFFCQNFVKSLQAVSCVSRDDVIKFSKDFMAGATAAAISKTVIAPVERVKLILQLQNSQTTLALENRYKGIVDCFIRVPREQGFLSFWRGNWVNILRSCSQESLGLSFKEFFRKYSLEGVDPKTQHSRWLVGNLVAGGGSGCATLATIYPLDFIRTRLAIDLGKRKSDREFTGMFDCAKKIIKSDGVPGLYKGLIPSLQYMIIYRGAYYGLFDTTAPYMNSDGKMTFTEAFLVGQVVTLIAAMTSYPLDTVRRRLMMGAGKKTLPFNNTISCIKYIYTKEGPKAFFHGALVNAIRGTGAALVLAIYNELQKYM

SEQ ID NO: 12594 - protein, 277 aa, Caenorhabditis elegans
MARFSGKSVIITGSSNGIGRSAAVIFAKEGAQVTITGRNEDRLEETKQQILKAGVPAEKINAVVADVTEASGQDDIINTTLAKFGKIDILVNNAGANLADGTANTDQPVELYQKTFKLNFQAVIEMTQKTKEHLIKTKGEIVNVSSIVAGPQAHSGYPYYACAKAALDQYTRCTAIDLIQHGVRVNSVSPGAVATGFMGAMGLPETASDKLYSFIGSRKECIPVGHCGKPEEIANIIVFLADRNLSSYIIGQSIVADGGSTLVMGMQTHDLMSVLSQ

SEQ ID NO: 12595 - protein, 237 aa, Caenorhabditis elegans
MSDELSVKRHKSDPDESIEEIMPEIRPPLTRTHKIVRDESGKHNLLLILTGSIAVMKAPELISELYEKIGRDRILIKVVTTENAMKLCHIQKLEFDEIVYEDRDEWSMWRERGDKVLHIELRKWADSALIAPLDANTMAKIANGLCDNLVTSIIRAWDLSKPCYFAPAMNTHMWENPLTMQHRTVLKSQLKFKEICPIQKELICGDVGTGAMASIGTIVSLVAALVRDQQAVRIQCG

SEQ ID NO: 12596 - protein, 279 aa, Caenorhabditis elegans
MARFSGKVALITGSSNGIGRAAAILFAQQGAKVTITGRNAERLKETRHEIKKSGIPAENILAIVADVITDEGQMRLINDTVRKFGHLDILVNNAGGALMDAQGRVGMDQDISVFDNTMQINMRSVVTLVQKAKEHLIKSKGEIINVSAMAAGHHGDPIATFYGMSKAALDQFTRSSAISLIQHGVRVNSVSPGFTKTGFGEAMGFPPIAMKKVISFYESHKECAPSGAIAQPGDIAQVILFLADRTMSSYIIGQSIIADGGSSLVMGMHAHDMLDILKA

SEQ ID NO: 12597 - protein, 284 aa, Caenorhabditis elegans
MSRFTDKVAIITGSSNGIGQATARLLASEGAKVTVTGRNAERLEETKNILLGAGVPEGNVLVVVGDITQESVQENLIKSTLDKFGKIDILVNNAGAGIPDAQGKSGVNQSIDTYHKTFELNVQSVIEMTQKARPHLAKTQGEIVNISSIGAGPAAQVASPYYSIAKAALDQYTRTAAIDLVPEGIRVNSVSPGAVSTGFSAVSRGLTEEKSKAFYDYLGAQRECIPRGFCAVPEDIAKVIAFLADRNASNYIIGQTIVADGGTSLILGAHAHGAKMMQAVFKEL

SEQ ID NO: 12598 - protein, 358 aa, Caenorhabditis elegans
MPRIENEPKLDFKDVLLRPKRSTLKSRADVELDREYVFRNSKATYTGVPVVASNMDTVGTFEMAAALNNHKIFTTIHKHYSVDEWKAFAASASPDTFNNLAISSGISDNDWTKLNTVITELPQLKYICLDVANGYSESFVEFIRRVREAYPKHTIMAGNVVTGEMVEELILSGADIVKVGIGPGSVCTTRKKAGVGYPQLSAVLECADAAHGLNGHVMSDGGCSNPGDVAKAFGAGADFVMIGGLFAGHDQSGGDLIEHNGKKFKLFYGMSSDTAMKKHHGSVAEYRASEGKTVTIPYRGDVNGTVQDILGGIRSACTYTGAKHLKELAKRATFIRVTQQTNDMYVPFEVPTVPAPSK

SEQ ID NO: 12599 - protein, 257 aa, Caenorhabditis elegans
MASPATKFLTDRVALVTASTKGIGFAIAKQLGAAGASVVVCSRKKENVDEAVAALRLENIDAHGTTAHVGNKSDRTKLIDFTLDRFTKLDILVSNAAVNPHYGDLMKVTDSQWDKLLDLNVKSAFELTKEAVPHLEASGRGNVVFVSSVAGYSPMNEIGAYSVMKTTLTGLSKSLALNLARRNIRVNSIAPGIIQTDFSQVLFSDESEKQKWLSQIAQRRFGDPDECAEAVAFLVSDEASYISGETIGINGGMHARI

SEQ ID NO: 12600 - protein, 221 aa, Caenorhabditis elegans
MVVLVTRSLLPALFFASRAPFAAATTSARFQRGLATMAAEAFTKHEVIPDVLASNPPSKVVSVKFNSGVEANLGNVLTPTQVKDTPEVKWDAEPGALYTLIKTDPDAPSRKEPTYREWHHWLVVNIPGNDIAKGDTLSEYIGAGPPPKTGLHRYVYLIYKQSGRIEDAEHGRLTNTSGDKRGGWKAADFVAKHKLGAPVFGNLFQAEYDDYVPILNKQLGA

SEQ ID NO: 12601 - protein, 478 aa, Caenorhabditis elegans
MIDQSQAAPSSSTSSSHLMHHHSNNYPSYTNPSASSSNHSNMGHPNASTGQTSAVQRMDPFNQIPSELYGSASSTSIAASTRQPSSQSQPSQQFRQMPADLGASTSTMHSVAPIDIYDNYGNASTSDLRRSSVRGDPRRKEIYAYNAPFTLFSHGWSAATDPSRKFRLAVSSFIEEYSNKIHIVQLDEEAGELVHRSTFDHPYPATKIMWIPDQKGTFPDLLATSGDYLRLWRIGTDNNACIESLLNTNRTAEYCAPLTSFDWNELDMNLIGTSSIDTTCTVWQLETGQAIGTTRPTAAIDGTVRTQLIAHDKEVFDISFSRGSAQIFASVGADGSLRLFDLRRLEHSTIMYEDPQRQPLLRLAWNRNDHNYIATFGQDSKEVLILDLRLPCTPVARLRNHEATINGLSWAPHSGSHICTAGDDYQALIWDVHEMPKPINDPILAYRAQAEVNQIHWSSSFPDWISICSDNKLEILRV

SEQ ID NO: 12602 - protein, 388 aa, Caenorhabditis elegans
MATNGHAVNGEAHVMQQVAQQPAPPGPLAPQGIGRQNEIVIGGRDRRCEIYKFTSDQQLYASAWSNKNDIKFRLAVGTVSDVSVNPCAANKVSIVQLKDETGELVETASFPMEFPANAVGFIPDPDNVYPDLIATTSDCLRLWRVVDGKVHPDAVMINNTNSQYGSALTSFDWNELEPRYIGVSSVDTTCTIYDVEVGCAIGQTKPTAPFTLKTQLIAHDKPVHDIEFAKINGGRDHFATVGADGSARMFDLRHLNHSTIVYEDPNKEKLQRLSWNKQEPYFMALFAENSQEVQILDIRMPCNILCRLRNHTGPVNGIAWAPHSPHHICTAGDDSQALIWDLQQVPRPVDDPILAYSAGGEVNQIHWGPVHSNWIAICFNKTLEILRV

SEQ ID NO: 12603 - protein, 297 aa, Caenorhabditis elegans
MSDSFANVPGGSQKLNSGYNIPFVGFGTYKVTGENVPPAIDAALTAGYRMFDTAKYYLNEKELGEALKILLPKHGLSRSDVFLTSKFFPESKNCREACRGFVEESLQSLQTDYIDMYLVHYPKPNDSDNDDVNNAEYRKIAYEVLEEAKAAGKVRSIGVSNYEIVHLEELKTYAKVPPCANQLEYHPHFARIPLQKYCKEKNIFFQAFSSLARHEPKLIEDPVVVELAKKHNTSVPLVLLAWALRQNVGIVPKSVTPSRIVENFKVIDIALTPEDIQSLTALDRGQHYIRCTGWLVK

SEQ ID NO: 12604 - protein, 283 aa, Caenorhabditis elegans
MSIKLNTGYDCPLIGLGTYKIIGDQVLPVLDAALTAGYRLFDTAKVYNNEKEIGDALEILLPKHNLKREDIFITTKMHPNTVENVKKLVDESLSLLKTSYIDMYLIHYPKSFDYGDQDPMNKTLRIATWNDLWECKNAGKIRSVGVSSFEIRHLEELKDLGKNFPPCCNQVEYHPHFTREELKNYCKSEGIFFQAFSSLARHNETLLSSEIITRLAEKYHVPKTTVLLSWATSQKVGIIPKSTNPERLAQNLKTVLLEEEEVKKICNLNLDKHYVRTTGWLVL

SEQ ID NO: 12605 - protein, 437 aa, Caenorhabditis elegans
MSSLSIPRQSLYYVNKVTEGRSVSNVQVVSPCQKQGQTYVTAFTPLTSNVQVHTSLEQLSTIRNADVLIFNNALSQIITNADLLTDFLKNATNATAIGGTVIIREDLKDCSDKRQVARLTDYFDVFRTTDSDGNNTGLDLYTVDQVEHSNYVEQNFLDFIFVFRKKVFAPTTDATITFRDFLDKTQYTNTGIDAYEWMFGVNFISPGGYDENLKIIKRFGDFKPGQTMLDIGVGIGGGARQVADEFGVHVHGIDLSSNMLAIALERLHEEKDSRVKYSITDALVYQFEDNSFDYVFSRDCIQHIPDTEKLFSRIYKALKPGGKVLITMYGKGYGEQSDKFKTYVAQRAYFLKNLKEIADIANKTGFVNVQTENMTPRFKEILLEERGHLEQNEAEFMSKFTQRERDSLISGWTDKLGYIEKDNHNWNFFLAQKPFPK

SEQ ID NO: 12606 - protein, 260 aa, Caenorhabditis elegans
MPSNCRRFEGKVAIVTAATKGIGLAIAERLLDEGASVVIGSRNQKNVDEAIEYLKNKGLTKVAGIAGHIASTDDQKKLVDFTLQKFGKINILVNNHGINPAFGHILEVSDQVWDKLFEVNVKAGFQMTKLVHPHIAKEGGGAIIFNASYSAYKSPPGIAAYGVTKTTLVGLTRALAMGLAKDNIRVNGIAPGVIKTKMSQVLWDGGEDAEKELTDIQEIALGRLGVPDDCAGTVAYLASDDSSYITGEMIIIAGGVQARL

SEQ ID NO: 12607 - protein, 357 aa, Caenorhabditis elegans
MGNCESRELVAQAKQNKIINTELDKAKKTDENIIKLLLLGAGESGKSTVLKQMKIIHNSGFSQEEISNKRNVVCANTVQAMGALLDGMKQLQFDFSTRVCNAHEKLIRETLNDKAEYGPFSDAMFNALTELWADKGVQCAYDKREFFYLHDSAKYFFDAIARVHTPNYVPTENDILHTRVPTMGVIEVNFTIKGKFFRVFDVGGQRSQRKKWIHCFDDAKAMIYVASLSEYDQVLLEDNTTNRMHESIQLFKQVINNKYFVNTSVILFLNKIDLFEEKIVTKKRSLGIAFESFSGPSQDLNAAVAFVEKKYRSMAENKEKNIYCHHTCATDTQQVQYVLDAVLDTILSTKLKGCGLY

SEQ ID NO: 12608 - protein, 356 aa, Caenorhabditis elegans
MGLCQSEEEKVGTLKSRAIDKEIKQLQTSEERTVKLLLLGAGECGKSTVLKQMRLLTSKQYTDEELLTQAKLVYTNIVIEMDHLVKAMPAAGLNFSDPMREHDVHMLTLYIKDMQHKNFQQDAADHVEKLWKDPVVKRLYAERKELNIRDIGDNTEYFFENLPRISKEDYHPNATDTLLLRTKTTGIVEVGFEIKKVKFRVFDVGGQRSERKKWIHCFEDVNAIIFIAALSEYNEVLFEDETTNRMIESMRLFESICNSRWFHNTNIILFLNKKDLFEEKIKKENIHKAFPEYRGEQNYAETVAFIKTKFEALSNNPKKTFYVHETCATDTNQVQKILDSVISMIIQSNLHKSGLY

SEQ ID NO: 12609 - protein, 354 aa, Caenorhabditis elegans
MGLCQSAEDKELTLKSKAIDKEMMQNHMSQQKVVKLLLLGAGECGKSTVLKQMRILHDHGFTAEEAEQQKSVVFNNTLQAMTAILKGMEALRMTFDKPIRENDAKFVMESHKMLQEAKVFPEELANAIQALWNDKAVQQVIAKGNEFQMPESAPHFLSSLDRIKLPDYNPTEQDILLSRIKTTGIVEVKFQMKSVDFRVFDVGGQRSERKKWIHCFEDVNAIIFIAAISEYDQVLFEDETTNRMIESMRLFESICNSRWFINTSMILFLNKKDLFAEKIKRTSIKSAFPDYKGAQTYDESCRYIEEKFDGLNANPEKTIYMHQTCATDTDQVQMILDSVIDMIIQANLQGCGLY

SEQ ID NO: 12610 - protein, 356 aa, Caenorhabditis elegans
MGVCQSFVLTDEMKDQIKVNKEIEKQLEKKKNMQLEQTVLLLGPGESGKSTVMKQMRAMTGNYTKTELHERKVLIIQNLCQFSEMLLEYVREYILEMTEDDDKRYTVMCEELKMAVIHDGIMRPELADTLKEFWGNSAIQDAYSKRDTFHLTDSAKYFFDNIDRIKLPGFEPTNQDIVHIRVPTTGVAQVEVIMNNIKLMICDCGGQRSERRKWYHFFDEADAVLFVAAISEFDQKLAEDEETNRMHESIRLFWTVFNGKFFKKAAVILFLNKIDLFEEKVKHVKIKDYFPKFEGANTVSEGTKFFRRQFREGIHPDFKKRMYTHETCAISDQVQIIINTVIDTVIQDNLKDTGMI

SEQ ID NO: 12611 - protein, 127 aa, Caenorhabditis elegans
MSGRGKGGKAKTGGKAKSRSSRAGLQFPVGRLHRILRKGNYAQRVGAGAPVYLAAVLEYLAAEVLELAGNAARDNKKTRIAPRHLQLAVRNDEELNKLLAGVTIAQGGVLPNIQAVLLPKKTAGDKE

SEQ ID NO: 12612 - protein, 537 aa, Caenorhabditis elegans
MPYIVFHLLRSAVRASVQACNGSGLPPGLADFKPKLFGFSCARLFSKIYVLKATNLFQLFINNEFVDAKSGKTFEFVNPANGKLLAKVAEGNRDDVDIAVEAAKKAFKIGSEWRRMDASHRGVLLNRLADLMERDRVILASLESLDNGKPYKEAYNIDLPISIKTFRYYAGYADKNHGKTIPVGGDYFTYTRHEPVGVCGQIIPWNFPLLMQAWKLAPALAMGNTVVMKVAVKTPLSALHVASLIKEAQFPEGVVNIIPGRGTDAGEAIASHMDVDKVAFTGSTEVGKTIMKAAAESNVKKVTLELGGKSPNIVFADADLEEAVRQSHHALFFNQGQCCSAGSRTFVEGKIYDEFVAKAKELVEKTVIGDPFDENTTQGPQIDESQVETIMKYIESGKKEGAQLVTGGVKHGDQGYFVKPTIFANVNDQMKIAQEEIFGPVMIVIRFDSMEELIEKANNTIYGLAAGVVTNDLNKALQVANTIRAGSVWVNCYDVFDPAAPFGGFKQSGIGRELGEYGLAAYTEVKTVTIKVPQKNS

SEQ ID NO: 12613 - protein, 301 aa, Caenorhabditis elegans
MSVFTNVVGGAFKFSDGYEMPKIGLGISRIETQQDLDVSIEAALKSGYRQFDTANLYKNETFLGNSLKKYLPQFGLTREDVFITTKVRTLNENTVEETEKQLANSLATLQTDYVDLLLIHYPRDRDTGNDDDYEINKSRRKIVWQTLEKAKESGRVRSIGVSNYEVYHLVEMFEYAKIRPVLNQYEYQPYLTRPTLKKFCDLNNIVVQSYSSLCWGDKEILQEKPLVDLCQKYNQTPQAILYAFAHCSNTSMIPKSATPSRIHDNLHNTIKIKLTEDELKSLRSLDKGKSFPQIGQTWRCL

SEQ ID NO: 12614 - protein, 733 aa, Caenorhabditis elegans
MSFMDKVKDTANSAYESVENTAVGAKDGVVGAFNTVGEKIGGAYDSTKQYASDKVSAAGDYASEAGKKVGDAEDSMIQGAYDAKDSAKESASNAGNKISNAFTSLKDSITGDNAHKTGEALNDNYESVKESASEAADRLKEPAQNTADNAKDLANQTGEEMSDAFESVKQLTSDTAENAKENAHDAADTAKSYKDKAGEKASGILDSFKAHASDAKDSVENKASDAYNSAKDKAGDAWDSTKDAAGDAKDKTKSFTEKVGDKISGAYDSVKEKASDVADSFKAHSTDSKDNVENKAADAYNTAKDKASDAWDKTKDKAGEAKDKMGDAWDTTKDKAGDAWDTTKDKAGDGKGKAGDAWDTTKDKASDAWDTTKDKAGEAKDKMGEAWDHTKDKAGEAKDKASDAADDAQGKSKSMTEKIGDSISGAWESTKDTAVSAKDKTAEAAGKVGDSISGAYDTVKEKASDIADSFKAHSTDSKDNVENKAADAYNSAKDKASDAWDKTKDKAGDAKDKAADAWDTTKDKAGDAWDSTKDHAADAKDKASDAAGDAKDKSKSLTEKAGDAISGAYDSVKEKASDIADSFKAHSTNSKDNVENKASDAYNSAKDKASDAWDKTKDKAGEAKDKAGDAWDNTKDKAGNAWDSTKDKASDAWDTTKDKASDAKESAGDAADSAKDKSKSITETIGDKISGAYDSVKEKASDVADSFKAHSSDAQDTVEVSHHKYFNVFSSFE

SEQ ID NO: 12615 - protein, 422 aa, Caenorhabditis elegans
MISQFEIIGDNKIGVLPKQVDQLQMCRDIAASKDLQENDSSFMLVDLDKIIERFQLWKRELPMIEPFYAVKCNTDLVLIRILASLGCGFDCASKDEIDIVMGTGVSAERIIYANPCKTRSFIAHAMDRDVKMMTFDNPEELLKIAKLHPNAEMILRIAVSDPTATCPLNLKFGADPIIAAPQLLKTASEEGINVVGISFHVGSGCNDASAYRNALQHAKNLCEIGEGLGFKMDIIDMGGGFPGAEHHNPFEKIAETIRDALDEFFPDTNKRLIAEPGRFFAAGPFSLVANIIHATEVPASKITKDPKDCADHGYMYYINDGVYGSFNCILFDHAHPIGSPLFDTDRNEKFMSTIWGPTCDSLDLVEDKKLMPKMNVGEWLYYPDMGAYTLAAATTFNGFSKPVPMYVMSEEMWESIRDSTHV

SEQ ID NO: 12616 - protein, 356 aa, Caenorhabditis elegans
MGSCQSNENSEGNARNKEIEKQLNADKRAGSSIVKLLLLGAGECGKSTVLKQMQILHSNGFTEEEVNEKRAIVYNNTVSAMCTILRAMDGVLHLPLENGQKEAEKAIVMKVQENGEEGEALTEEVSKAIQSLWADPGVKKAFEMRSEYQLPDSAKYFLDNCQRISEPGYRPNDQDILYSRVATTGVVEVKFKIKELDFRVFDVGGQRSERRKWIHCFDNVESIIFITAISEYDQVLFEDETTNRMIESMQLFNSICNSTWFLSTAMILFMNKKDLFMEKIQRVNITTAFPDYEGGQNYEEAVSFIKQKFAELNLNPDKKTIYMHETCATDTNQVQLVISSVIDTIIQKNLQKAGMM

SEQ ID NO: 12617 - protein, 1192 aa, Caenorhabditis elegans
MSSASVGKKPEHVNTPPGDNQQKSSKENQKSNKDKQSSNQPPGQIPHSTNSGTRKSSGSGLKTANLKHPARPSTESSTSSSHHRRPAQEMNGTSTATATGGGGTSGATTTASSGAPAASSGGSSARYSSSGRSHPTSGSSSSHARSTGQSGMSSRSAARRNDQDVHVGKYKLLKTIGKGNFAKVKLAKHVITGHEVAIKIIDKTALNPSSLQKLFREVKIMKQLDHPNIVKLYQVMETEQTLYLVLEYASGGEVFDYLVAHGRMKEKEARAKFRQIVSAVQYLHSKNIIHRDLKAENLLLDQDMNIKIADFGFSNTFSLGNKLDTFCGSPPYAAPELFSGKKYDGPEVDVWSLGVILYTLVSGSLPFDGQNLKELRERVLRGKYRIPFYMSTDCENLLKKFLVINPQRRSSLDNIMKDRWMNVGYEDDELKPFIEPPKDQIDEQRIEKLIQIFQLGFNKAAILESVEKEKFEDIHATYLLLGERKSDMDASEITMAQSLLSHSSINVSSSLGQHPAGVITREHVTSSSASGSSASPSRYSRSSATATGASITAGSALASAANAQKHQQSSAAPSSGSSSSRRSSQNDAAATAAGGTVVMSGTRHGGVQMRAQPTSRQATISLLQPPSYKPSSNTTQIAQIPPLFNRNSTATSSAAQPSTGITGTRKIADPKGRIPLNSTAVQGHRTATGAVAANNGGIPSHRDHAQQQQYMNQLTSSTMMSKLINKTPAAGGTAATSSSSSSSATSTAPLQKSGSQISHAPTEPVIREDDDENNSENQNGNVPLIGGVGPQTSPAVQVPTEDATSSSDKEQQQQKASSETPKESKPSMIHQSPSMPPSQMMTAMESLKLSESGQTGGPTVATGGPPQRATSQQMSRSATTNSANMGASSGGAAAAASATNQLSGAPSSTGASSQQYHPKAPSSSSSSSTNPPHQHQLTHNASFSVTPSSYQIPTSTAVNVTSTGMPTSSSSSAFPRNTRNRQTFHGKTEKDKGGDDSSDEIGETPGNVSIGATGPSANNAEATIWSKLSKLTRRDHNRESMTQPVSGRAGTIGASQGQQTAAALAAIREQSGPIAPGAGQVAPSLPIHEGDVKPRSLRFTWSMKTTSSLAPDDMMREIRKVLDANGCDYEQRERYMILCVHGDPNTDSLVQWEMEVCKLPRLSLNGVRFKRISGTSIGFKNIASKIAQELNL

SEQ ID NO: 12618 - protein, 279 aa, Caenorhabditis elegans
MTRFSGKVALVTGSSNGIGRATAVLLAQEGAKVTITGRNADRLEETRQEILKSGVPEDHVLSIATDLATEKGQDELVNSTIQKFGRLDILVNNAGAAFNDDQGRVGVDQDVSVYDRIMQINMRSVVTLTQKAKEHLVKAKGEVVNVSSIGAGPQAQPTFMYYAMSKAALDQYTRSAAIDLIQYGVRVNSVSPGAVVTGFGEAMGMPADMHEKYGHFMESRKECIPCGKMGQPIDIANIIAFLADRKLSSYIIGQSIVADGGSTLVMGMQAHNFMDLLKQ

SEQ ID NO: 12619 - protein, 281 aa, Caenorhabditis elegans
MLSRFSGKVALVTGSSNGIGRAAAVLFAKDGAKVTVTGRNAERLEETRQEILKSGVPESHVLSVATDLAAEKGQDELVNSTIQKFGRLDILVNNAGAAFNDDQGRVGVDQDVSVYDKIMQINMRSVVTLTQKAKEHLVKAKGEIVNVSSIAGTAHAQPGVMYYAMSKSALDQFTRCAAIDLIQYGVRVNSVSPGGVTTGFGEAMGMPSGAFEEMMKFMESRKECIPSGAVAKPIDIANIIAFLADRKLSSYIIGQSIVADGGSTLVLGMNAHNWADLMKQS

SEQ ID NO: 12620 - protein, 278 aa, Caenorhabditis elegans
MGRFSDKVAIITGSSSGIGRSTAVLLAQEGAKVTVTGRSSEKIQETVNEIHKNGGSSDNINIVLGDLNESECQDELIKSTLSRFGKIDILINNAGAAFADPSGKIGSEAAIGIFDDMMKLNLRSVVELVKKCRPHLIASKGEIVNVSSIAAGPQPYIYYTYYGICKAGLDQLTRSLALELIPFDVRVNSVSPGLISTNFLGAVGMGDDVVKKTEEYYSTHRDCIPAGRTGKPEEIASLIAFLADRKSSAYIIGQSIVIDGGTTLVLGMPSHDLSKALA

SEQ ID NO: 12621 - protein, 451 aa, Caenorhabditis elegans
MRLLLPLLFCVGAFCLDNGLGRTPPMGWMSWTAFYCEIDCVKHPTGCINEQLYKDMADQLVSGGYDKVGYKSVHIDDCWSEMERDSHGILVANKTRFPSGMKALAKYMHDRGLKFGIYEDYGTKTCGGYPGSYKHEKVDAQTFAAWDVDYLKLDGCNIDQAMMPIGYPLFEKELNETGRPIMYSCSWPAYLIDHPELVNYNLIGKYCNTWRNFDDINSSWKSIISIISYYDKMQDKHIPTHGPGKWHDPDMLVIGNKGITLDMSISQFTVWCIWSAPLIMSNDLRIIGDSFKDVLKNKEAIKINQDPLGIMGRLIKNSTDIGVYVKQITPSKGDKKSFAFAYLNRNEKEGYKRIEIQLASIGLTDPAGYYVHDIWSHVDLGLLRSGDSIVVSIAPAGSVFFRADLASLHQPKGKRRYKFDNSNVVYEFEREQSQLGRFDFGDYLRTNRVQF

SEQ ID NO: 12622 - protein, 576 aa, Caenorhabditis elegans
MSGLNIYFILQICSHTDTYFFIYSLSITLFFFSKYKMGVCISHEYSKPNAEQAEILQDFSKFMKPEERPPMAVEHQMYDYRLVEEEQDDELFAIVCCPHSIGYERDKIALVDLDPTSETFCTILSEVHLTSNGDEPGRMNWAKSAESLGEMNKFVRRNIIVPCMNSGKIYVIAFENEKLWIEKEIRNDELIRKDVSCPYAVRSLPLKGAPVHVSTLGDRFGNGKGDFILIDRRTWEVRKKSEPTFSDYGGDFSLQPRHNLMISSEWGHPRLLRDGFMPSELENVSESFGARLHVWQISPPKLIQSINLDTCDGSLVICVKFLHNADCNHAFAISAIGSSIFHLHMNTLTKEWAADRVAHVPLLKVENWQSDEMPALLTDMIISMDDRWLYVCGFLHGVLWRFDIQDPFRVSLHGKINLGGIFDSFPEVRIKTSNAMEDRWWLPPETRSLPRGTKFRGGPALMQLSKDGCRLYVCNSFYKAWDAQFYPELISDGGQMIRVDIVDDEMQLNEKFLIDMKKPSLIQNYRIFKKSVCLMPPIQKYLLDYNTTYFYTNFIKVYNYQFTCNVSFRDNQTAHL

SEQ ID NO: 12623 - protein, 167 aa, Caenorhabditis elegans
MSDADSQKQIKLTSSDDKTFTVSRKVISQSKTITDIIQNLGIEESGSTSEDTIPLQKVTSTILEKIITWCEHHADDEPKKVDENKKTVDISEWDAEFMKVDQGTLFEIILAANYLDIRGLLDVTTQNVANMMKGKTPSQIRTLFNIENDFSEEEREAMKKENAWCED

SEQ ID NO: 12624 - protein, 159 aa, Caenorhabditis elegans
MSDADSQKQIKLISSDDKTFTVSRKVISQSKTISGFTSEDTIPLPKVTSAILEKIITWCEHHADDEPKKVEKIEKGNKKTVEISEWDAEFMKVDQGTLFEIILAANYLDIRGLLEVTTQNVANMMKGKTPSQVRTLFKIDNFSEEELEAMKKGNAWCED

SEQ ID NO: 12625 - protein, 145 aa, Caenorhabditis elegans
MSSEEQDVKIVTSDDVEFIVSPKIANQSKLLADFVVLNQREPIPLKNVTSEIFKKVIEWCEYHAEDIPKPPDNVEEKRTDDIGEWDVEFLKVDKGTLFELVLAATYLDIKGLFNVTCKSIANSIKGKSPEEIRAVFNLGNETNME

SEQ ID NO: 12626 - protein, 199 aa, Caenorhabditis elegans
MFNILLVNQFRNLCQFAHANLIKLLGRRGKQLGDIVTKTLKLIHSVILLQNRINNEQLGARSQNFNLRWNRVSPRVANESKVLTDFLQTYQPEMDAIPLTKVDAKIFEKIIEYCEHQGTPRPLLNGEIGEWDSEFLKLDQNTLFDLVLAANYLNIENLFDVTTQFIANMMKNNTPSQIRARFGVSNKHSSAEDRSDNWS

SEQ ID NO: 12627 - protein, 194 aa, Caenorhabditis elegans
MSAEAAAVEVQANEAPIVAPIMYKVESSDGQVYEISDEAVKQSNTLSNLISTCVANDVASMDPIPITNVTGNIMKMVIEWCEKHKGETLPVEDDSVPKNITVPEWDTNFLKIDNDVLFDLIVASNFLDVPGLMSYACKMVANMAIGKSPDEMRVLFAIPTDEEDEAAEKAAKEKAEAEKKAITEKDAAEPSTSK

SEQ ID NO: 12628 - protein, 195 aa, Caenorhabditis elegans
MSAEAAAVDVPEAPVAATAPIMYKLVSEDKQEFTISAKAAKKSIVLNDVISRRAPEDSAPMAPIPVEKVTGDILNMVIKWCEQRKEDELPVDDGSIPKKIDKIDVPQWDADFLKISSDVLFDLIVACNELDVPGLMNYGCKMVADMAAGKSPEDMRTIYGIPTDKQDADAAEKAAKEEAEKNATAQRDEAGPSAS

SEQ ID NO: 12629 - protein, 333 aa, Caenorhabditis elegans
MTVDSIPLNTGAQLPLFGLGTWQVKDEAELTVALRAALDAGYRLIDTAHLYQNEHIIGKVLHEYISSGKLKREDIFVTSKLPFTAHAPEDVPKCVESQLKALQLEYIDLYLIHCPFPFKHQEGSFAPLMENGELAVTEIAHIDTWRALEKLYKEGKLKALGVSNFSCNQLQALYDAAEVKPANQQVECHIYWPQQELRALCKKLGVTVTAYAPLGSPGRKAARPDGVWPEGDPLLEPIVKQLAAKYHKTAAQILIRHLTQHGISTIPKSVSPDRIVENISTFDFKLSDEDMHTLNSIETRTRLFIADFAVKHPFFPHDDIDTSKVPKVGIRLH

SEQ ID NO: 12630 - protein, 280 aa, Caenorhabditis elegans
MAQRFTDEVAIVTGSSNGIGRATAILLASEGAKVTITGRNAERLEESRQALLKVGVPSGHINSVVADVTTGAGQDVLIDSTLKKFGKINILINNAGALIVDPEGKTNTSTGVETCLKTFQLNFQSVVEMTQKIRPHLANTHGEIVNVSSVGAGPAAENRFPYYSAAKAALDQYSRNTAIDLIPDGIRVNIVQPGFVATGFTTAASGMSPDASAKMYEGIGANTSCIPAGYCGRPEHLASVIAFLADRKASEYIVGQTIIADGGTTLVRGRNVALATRRAE

SEQ ID NO: 12631 - protein, 495 aa, Caenorhabditis elegans
MIAFSIFIAIFFWLAHCFYFKRRNLPPGPTPLPFLGNSLSMIWENPGYECFRRWTRIYGDVFTFWLGDTPYVVISSLEKMKETFIKDGETYQDKIQFSFTEKFRGGRFGVIETTGHMWSTHRRFAISTFRDLGLGKNLMQEKILAEVEAVFQILDANLGAEQDVPEVIYNAVANVINQMIFGYRFDESNQNEFEKLKDLIDIQEKSFASFKLCVQAFVPIMNKLLPGKSLEDLIAEKRHDYYNFFYAQIQDHRAKINYQAEEYLDYAEAYLKEQKNQEQGGLGSDLFSDQQLANMCFDLWFAGLTTTNTTINWTISYVLNHPEVQDKMQEELDKVVGSDRLVTISDKSSLPYMNAVINESQRCVNLLPCNLFHATTRDTVINGNIIPKGTGVIAQISTVMLDEKIFPDPYKFQPERFIDENGALKKIEQLIPFSVGKRQCLGEGLARMELFLIVANLFNRYFITPSSAGPPSLERTEMVGVFPRKFQAILTRRYE

SEQ ID NO: 12632 - protein, 554 aa, Caenorhabditis elegans
MMSFLTNTLFSLKLNLHHFNFQMTSVRAQIHQQLYKTKTIAPALTITNAVTGGFDELGEFGLDDVENLMISNSRLTTFTNFPFMPKLKTLDVSCNNFHGVIDMSILARNAPRLKVLILDDNQIHIGSISSLNGVRKLANLSTTLTGDASPEHCDRNEKIIARVLPKLKILNDEVVKRDEIIPARPPSPGAQKLHSRLKRSKWLHRKPTKFALKYILYTSVCHTDAYTLDGHDPEGLFPVVLGHEGSGIVESVGKGVTGFAPGDHVVPLYVPQCKECEYCKNPKTNMCQKIRVSQGDGFMPDGTSRFTCNGKQLFHFMGCSTFSEYTVVADISLCKVNPQAPLEKVSLLGCGISTGYGAVLNTCKVEEGSTVAVWGLGAVGLAVIMGAKAAGAKKIVGIDLIESKFEKAKMFGATECINPKSVELPEGKSFQSWLVEQFDGGFDYTFECIGNVHTMRQALEAAHKGWGVSCIIGVAGAGQEIATRPFQLVTGRTWKGTAFGGWKSVESVPRLVDDYMNKKLLIDEFITHRCNIDDINAAFDVLRKGEGLRSRLTF

SEQ ID NO: 12633 - protein, 606 aa, Caenorhabditis elegans
MVAVAAFSSSGQDKPAHTPKLGLFVYILAAASVIGGFLFGYDTSVVSAAMLYMPDAPGLKPMDTVWQEVLVSISPGMAAVGSLMSGTSSDYIGRRKVILGASAIFTIGALVCAASVNKIMLLVGRVLLGIAIGFASMIVPVYLGETAPTHVRGMLVAAFALMISFGQVVANITGGAFSYIDPYNVGWRLMFAFAAVPSIIQFVCFMFLPETPRWLYENGFETETREVLEKVYNGDKEWVEYEMAEIIAFNEDQAKENEKAHASGPVIWRILKTPHVLKACFIGSMLQAFQQLAGINTILYYTADIIRSSGISNNHTTIWISVLLSLCNFIGPFVPMSLIEKVGRRIIFLFSCGLVVLSLVFIGVAFLLVNHDSAATLPANQYGSNFNSSYPDAKGCMAYSNCDYCVTTDACGFCHDANTKQGYCLPAGFDNPEVYSSTGSCTNSNGSIANNFKWEKYYCDTKYTLLPIIACGVYLLTFSSGFTSLPWVLNSEFYPMWARSTCVAISTTSNWVFNLIIALTYLSLTQVIGKYGAFWLYAGLTVIAFIFILFLVPETKGYSIEEVEMLFMNKKQRREAESRRRETVTEVRSRMNSTVSFGQHNEVHKY

SEQ ID NO: 12634 - protein, 613 aa, Caenorhabditis elegans
MVAVEFKVSESGRPRPEKNPKLGFFVYLLGSAAIIGGFLFGYDTSVVSAAMLYVPEAPGLKPMGTVWKEVIVSITPGMAAVGAWFSGAGSDRYGRKPIIIGSTLIFVCGAVICAVAWTKIVMLIGRIFLGVGIGFASMVVPVYLGEASPTHVRGTLVSAFAMMISFGQVVANIMGGVFSYWEPYTIGWRLMFAFAGIPALIQFVCFIFLPETPRWLYENGHTEQAEQVLEKIYGGNTEWIEYELAEIKTYAEERQKQMEEEKKSGPVIWRILKTPHVLKACFIGSMLQAFQQLAGINTILYYTADIIRSAGIENYHTIIWISVILSICNLIGPFAPMFFIEKLGRRKLFLFSCAGVVVSLVLIGVSFLLVGNDSAPNFDRSAYLLAGNYQSNGEAESCLMLSNCDSCVTSEHCGFCEDSETRTGFCLPVDHNDVTLYSSTGLCTNGLDKSNSSFPNATSYVWQKHHCTTSYTILPIVMMGVYLLTFSCGFTSLPWVLNSEFYPMWARSTCVSISTLSNWVFNLIIALTYLSLTHAITKYGAFWLYAIFTIIAFIFIYFLVPETTGYSIDEVEMLFMNKRQRNIAMQARQAKLDAASDKDKNSSTSLSTETITM

SEQ ID NO: 12635 - protein, 896 aa, Caenorhabditis elegans
MATKPTDILRDGKLIFFKYEENWTSRNAVRLHVDPTPYILYWRYKDPKVFNTKELAYEKNYIYLERIYDVRAGKPTDFELVPSERSYEPNFLTIVSGTSITNLKFTHFVCMEKNEKRLHEFAATLFTVVQRVKREEHGLLYHFRKKLAPKMYAAFTRRCIEEDIMKVFDKHRKNSTKIEWTEVGKLLPVNRKSVEIDDQKLIKIIMILTKFEGSRLEAIFRKISEDEPVATKLEFGDWLRKNQHDHRLNDARFNQVSDRKINSILENWQYSSDSAISPQMFTHWMVSDECGVAISAQRMKMDVTSMREPINKYFINSSHNTYCSGNQLVYAIGHCSADVEMYRQALLSGSRCVELDMWDNKDKDGEPVITHGPTAVMGMNEIGLKEVCEAIKECAFKTSPYPVILSIENHLGRKQQEKMVQIFRQVFGELLLTGPLPDYPLYAKEGAGDVVYPPPELLKHKILIKAKKKRFEKQESRSRDSSSIDLQGSSIDLTEDEEMENERFNELTEEQKAAQLSELPEETTCSELSAITNYMQAYETSRGVSTVVNLENATKDIVPCIVSADENTVYNCLRANSIDKVQNLNKSKITRIYPKASRIYSTNYNPMIHWLTGSQMVSLNIQTNCSNMQLNYAMFERNGGCGYVRKPDWLRARNVQLRPFLSIPFTIAYTVEVEIIAAYFLSSMDSGKFRRRSSVSIRLFDVPDQISKDDAASPSVSTAAKFESSCRRRTREEASFVTNYERHVYSFDKIMLNDMSFIQFNVHNESGSVFAQRILHIDTMNNGYRFVTLRTPSNQCAGPACLLVRFDLFMHSDRKNLHDLKQMYNPHAFEKESDKWERRFSNPFADLDKFDDNEFLLVEGTRRGSVEHAPTTPTTPTKPMSFGKEILEKISFWKKK

SEQ ID NO: 12636 - protein, 777 aa, Caenorhabditis elegans
MSGRSGNGGQQKMRIRPFMATIDEQYVTQTWELLKRAIQEIQRKNNSGLSFEELYRNAYTMVLHKHGERLYNGLKDVIQDHMASVRIRIIESMNSGSFLETVAESWADHTVAMVMIRDILMYMDRIYVAQNNHVLPVYNLGLDAYRTEILRQNGIGDRIRDALLELIKLDRKSNQINWHGIKNACDMLISLGIDSRTVYEDEFERPLLKETSDYYRDVCKNWLSGDNDACFYLAQVEIAMHDEASRASRYLDKMTEAKILQVMDDVMVAEHIQTIVYMQNGGVKFMLEHKKIEDLTRIFRIFKRIGDSVTVPGGGLKALLKAVSEYLNETGSNIVKNEDLLKNPVNFVNELLQLKDYFSSLLTTAFADDRDFKNRFQHDFETFLNSNRQSPEFVALYMDDMLRSGLKCVSDAEMDNKLDNVMILFRYLQEKDVFEKYFKQYLAKRLLLDKSCSDDVEKALLAKLKTECGCQFTQKLENMFRDKELWLTLATSFRDWREAQPTKMSIDISLRVLTAGVWPTVQCNPVVLPQELSVAYEMFTQYYTEKHTGRKLTINTLLGNADVKATFYPPPKASMSNEENGPGPSSSGESMKERKPEHKILQVNTHQMIILLQFNHHNRISCQQLMDELKIPERELKRNLQSLALGKASQRILVRKNKGKDAIDMSDEFAVNDNFQSKLTRVKVQMVTGKVESEPEIRETRQKVEDDRKLEVEAAIVRIMKARKKLNHNNLVAEVTQQLRHRFMPSPIIIKQRIETLIEREYLARDEHDHRAYQYIA

SEQ ID NO: 12637 - protein, 348 aa, Caenorhabditis elegans
MSTENGKSADAPVAAPAAKELTSKDYYFDSYAHFGIHEEMLKDEVRTTTYRNSIYHNSHLFKDKVVMDVGSGTGILSMFAAKAGAKKVFAMEFSNMALTSRKIIADNNLDHIVEVIQAKVEDVHELPGGIEKVDIIISEWMGYCLFYESMLNTVLVARDRWLAPNGMLFPDKARLYVCAIEDRQYKEDKIHWWDSVYGFNMSAIKNVAIKEPLVDIVDNAQVNTNNCLLKDVDLYTVKIEDLTFKSDFKLRCTRSDYIQAFVTFFTVEFSKCHKKTGFSTGPDVQYTHWKQTVFYLKDALTVKKGEEITGSFEMAPNKNNERDLDINISFDFKGEVCDLNEQNTYTMH

SEQ ID NO: 12638 - protein, 320 aa, Caenorhabditis elegans
MSSKVPIFTLSNGVLMPSIGLGTWQMTGEEGKTVIRNAVLAGYRHIDTATLYQNEHQIGDALAELFAEGILKREDIFITTKAFCHEVAPDVVEEALRNSLKRLRLDYVDLYLAHIPASTKDDGSFRSDVKVEDIWRGFEKVYGLGLTKAIGVSNFNESQIVRIMNIQKVPIHASQLELHLYLPQKAHRELCKKHNILITAYATLGSPGRMSVVGSNGRPLFESTQNSENEMNDKHVKALAQKYSKTPAQILLRATVEMGIIVIPKTTNPERMKENINIFDFNISNAEVNLLEAHERTKQERLFWWPNVADHPEDPFATQR

SEQ ID NO: 12639 - protein, 110 aa, Caenorhabditis elegans
MAQASDSTAMEVEEATNQTVKKRFEVKKWSAVALWAWDIQVDNCAICRNHIMDLCIECQANQAAGLKDECTVAWGNCNHAFHFHCISRWLKTRQVCPLDNREWEFQKYGH

SEQ ID NO: 12640 - protein, 1077 aa, Caenorhabditis elegans
MSVYYIVLAGFLLFMALVPFNAGQQYIDDDIEVVSSCQNGYVQNAGCDQNSQVNIIITATLDGVVTALDGETGEMIWRYEDAPLLRGTLSTSDPIDIGGTSLQLMPTLDGRLFSYTHNTNLIEPLPITTDSLLESTIRLGQDAVAGGKSVTTKGFDLFTGEQKYECSMESCGPGDTETPKNPIILIRRTTNSIRAMDTLRGIERWNLSTAEIGVTLAGGITSPTLVSDVKILLQPPDGVIVAVDKYNREEWKTNVDGHIVSVWQVYGNQIGEISIFDPSNIFTTQYEVMQREQHNLQTQSSLLYMGTSNGFPFIIQSPKAKNNLKQRMNALPELSTMTELTNPRFCTANEETRSLAYNVKDETLRLVLHNAFRHSQSKAIEDKSLSGSSARRKLQIIASDTEVSAQRIGTENLRSTSVSKSGDYGYLVLESEPQRVKFKVNSPITLMQTIFSYIFNPTAVVSFLAGLIGVTVAVVYNKIAKSSPRMIEHLSSTESAETESASHRTRTTSFAPTDDEIERFVEEGSDLSTTPIGAIHRKPLMPIEKSNIETHTQPQIKPVQRLVKTDIDTDEDSFSNDEKKRLLRNRTISRSSLEGFTSRFANEFEVKKVIGHGGFGVVFRAQSITDMNEYAVKRIAVADNDKARNRVLREARALAMFDHPGIIRYFYAWEERPPKGFQEKEDENLLGKIKAEKLAKLHEIKKAKKHTSEGKRVRSADTASFAESFAMPPVVGNTTDAENSWSTSAKPQEVGAKRTTSESKLGLHGGSDRTTAELKEESVAFSESDEESDTTEDSSSSDESPSSSSGSSIDDEPKKYNSSSGGIEFVDGSDDVDNEAVKETKKEIAVIEELSIHNRAMIVETENQELEVRERNDTGDCAYLYIVMQLCAEKTLEDWIRRSKTMESRPLFTMKNWIKQLASGLEYLHNKGFIHRDLKPGNVFFSLDSTHGHQILKIGDLGLATKTDGAPKITVRQDSDSSAKHTKNVGTRSYMSPEQLKHQQYTEKVDIFALGLVATELIISFSTASERIHTFADFQKGDIPAILDNVPESRDFLLQLTSLEPSERPTAHEVATHKFLQ

SEQ ID NO: 12641 - protein, 525 aa, Caenorhabditis elegans
MNLVDEKDEKPTRWEKCVEFIMFHFRWVFVVPFLLPLSFLFNTVFDFRNRIVHAVNSAPNAHVRKVKHIQEQLKEWNDNGRKSKLVNARPGWLTMSFRFPLYKENATKIATDKLFDILDLDVEKMTVKAEPGVTMGQLSQYLISRGYTLPVLPELDDLTVGGLINGCGVESGSFKYGMFQHICTGYEVVMSDGELKNVYPDSAAKTEQAKQDNSLFFAIPWSQGTICFLVAATIKIIPCKKYVKLTYKKTETLSEMCEQLTEDSDRNSENVDFVEALMFNKEKGCIMLGEFSDGPDTHDEVVNPIGRWYKKWFYTHVEDLINKKHESIEYIPLRDYYHRHSKSIFWELRDIVPFGNNVLFRYLMAWMCPPKIAFLKATTPNVLRKLYDRSHVLQDMLVPLDKLEECIDLFHKEVEIYPMWLCPFYLKSQPGLMKLRNATHKMYVDVGAYGVTSKDGYHHERTTRRLESFVRSVNGFQMTYADIYMTRAEYAEMFDRTLYDWKRASCKCIDAFPDIYDKICRSGRR

SEQ ID NO: 12642 - protein, 1087 aa, Caenorhabditis elegans
MSDYSAKPSGSLARIGDYDLSSDDSDQNDEDETLIASKTIQTGAVQVNDIAVAEASPAETDAKSSASPVSGPEPPTSAVVENRDLDEFKKESGSNDDKQEEINEDKDSNEETVFQQTESGSADVVDKTDVKQKDSDSSADDDHSHSKSGSVHSPQKPQGSTTPCSVQSPASPVGDEQAVKMEEVEEPIVASEEVPDKKPESVKESTDSESSGSEHGFEKMDTAEKVEDECNDDEVAASNGTEEPEPGDKAADTVNPWETPRQEPVDGVVQPRTEPPAGKPTRHTNCLDFVLFTVVKDALKHKHSWPFQLPVDAIKLEIPEYHNIVNTPMDLRTIEKRLRNLYYWCAEDAIKDLNTLFDNCKKFNDRNDDIYIMCENIEGVVQRGLEWMPSEEKPADLADHHRRGMFSASTPSGKTKGPKQRGRKSTRGRKKTSLPRGASTFKDESVDDNNDDESSKVDSINFDDDDDTATEKDAESRAESVQPEVVNEEPKPSTSQPPSKKRKAENGEPAVAVKIATPATPVAAHPQEETPRRKNPNTLIEWKHLVPRWQGKIPEWQKFCSKLLNEIHSVKNKGFAQVFYLPVDPIKLKIYDYLEVITNPMDLQTIKKKLDFKQYAEPEEFVHDINLMVDNCCKYNPKGSPAHSNALELRSFFEQRWKLFPRPGVDPIIADSYINQNLVVNTDLIEDERINSYLSAVKAEEKKCAEKLEQLRSMSEGLYTIAMQRREAKLAGNTAPALAQNQLSQLEGLGISIKSTPMMIPELISPALSVRSSSRAPVPKIIDDIGPSPIKARKISKPRASMASNVSVPYTPTGNPRGRKPKKSGRPKKNIYSPATVSERISQQPPFEVTPYVSIYGRKVVGTNDKIELSERMASIPQMYITPILRIIQIGHHNTGKTITSLRSLCEEEIDFNDVSDDLVIELLDYLEMIQKDKAKAEQVRQELEVKAKFYGFEAYDNKLGTIPKTRNMPPPLQHRMRSDSPSPSASRTGNQSSDSDSASDDSSDDEPSRSNSNVAGPRRALELSGNSSSASTPAGPSKAQPAVVRPSSKSVASKPAYTKRTLSESSSSSDSNGSSSDSSDSDSEPS

SEQ ID NO: 12643 - protein, 248 aa, Caenorhabditis elegans
MSDGKEELVNRAKLAEQAERYDDMAASMKKVTELGAELSNEERNLLSVAYKNVVGARRSSWRVISSIEQKTEGSEKKQQMAKEYREKVEKELRDICQDVLNLLDKFLIPKAGAAESKVFYLKMKGDYYRYLAEVASGDDRNSVVEKSQQSYQEAFDIAKDKMQPTHPIRLGLALNFSVFFYEILNAPDKACQLAKQAFDDAIAELDTLNEDSYKDSTLIMQLLRDNLTLWTSDAATDDTDANETEGGN

SEQ ID NO: 12644 - protein, 304 aa, Caenorhabditis elegans
MSDGKEELVNRAKLAEQAERYDDMAASMKKVTELGAELSNEERNLLSVAYKNVVGARRSSWRVISSIEQKTEGSEKKQQMAKEYREKVEKELRDICQDVLNLLDKFLIPKAGAAESKVFYLKMKGDYYRYLAEVASGDDRNSVVEKSQQSYQEAFDIAKDKMQPTHPIRLGLALNFSVFFYEILNAPDKACQLAKQVSVANIGQTAYAEALEIANKDLSPTNCVRLGLALNYSVFFYEVAASPDRACQLSKQAFDDAIAELDTLNEDSYKDSTLIMQLLRDNLTLWTSDAATDDTDANETEGGN

SEQ ID NO: 12645 - protein, 364 aa, Caenorhabditis elegans
MGAGATGLRGARLSPEERANSSKSRAIDRALSKDHTDDLNRFKILLLGTAESGKSTIFKQMRVLHLDGYAKEDALEYLSIIHSNCMEALTQLVDACTAFGINHDITVQEDVNRFEDFKRKLRDPEGLVIPVVIGRCMDRVWHSPSLQLCYDTRRFRFALLDSAKYFMDNIVRLTEDNYVPSIQDIVHCRISTTGINELAFNYKKMDFKMVDVGGQRSERRKWIHCFDNVDMILFIVSMSDYDQLDPEDNKYNRMKQSYEIFKTIVHSDLFRHASIVLFLNKYDVFVEKLKTSPLRRSFKNYEGDNSEESAREFIKKLFRRCITDRHKFFVFETTATDTGNIDLVFGSAVAHIVNENLRSAGLHE

SEQ ID NO: 12646 - protein, 355 aa, Caenorhabditis elegans
MVCCFGKKDERTKTIEKELHKERKIMRRQINLLLLGSGESGKSTFVKQMHIIHGAGEFTADEVRAYRQQIYQNAISAMRVLLDARNKLGIAWEDPKRQVEVEKVMRFSVGDLLKGIDFTTFVEVAPIISDFWNDAAIRKTYEQRNLFQISDSCQYFFEHIPRIAMPDFYPTNRDILFCRKATRGISEHIFEINKIPFRFIDVGGQRSQRQKWFQCFTDITSILFMVASNEYDQVILEDRRTNRVVESRSVFETIVNNRAFSNVSIILFMNKNDLLQEKVPKSDIRQYFTDFTGDHTLVRDVQFFLVDKFEASRRDRARPFFYHFTTAVDTENIRRVFRDVRESILEQNLKTLMMQ

SEQ ID NO: 12647 - protein, 491 aa, Caenorhabditis elegans
MSVFILAFVIFIIFYVFHFYWKVSKYPKGPLPLPFIGNIHQFPPDNVQKYFDVLSKTYGPCFTIWIPFPAIVLTDYEHIKDAFVNQGDTFTYRAHRSPETLLPVHDHTGILASDGDHWRLQRRTSLKILRDFGLGRNLMEEQVIRSVHEMLIQLENINDKKNVDVFWPIQLCVGNVINETLFGFHYKYEDSEKFKTFVKIVDKHLRHLQGKMPLLVSAFPWLKHVPIVGDIGYHNIKNNISSYHTFIEEEVATQVKKYDGESEPENFVHAYMQQMKQTGNPGLDITNLCATVLDFWLAGMETTSNSLRWHLAFMMKYPEVQDKVRKEILDNVGTARLPSMSDKPNMPYTQAVIHEVQRCSNMIPFLGSHQCKEETEIHGNRVPAGSLVFAQLWSVMRNDTVFEDPETFNPSRYLQSDGKTFDKAVLEKTIPFSIGKRNCVGEGLARMELFLIFSALIQKYEFVATSNIDLTPDWGVVLTAKPYTCNIIPQF

SEQ ID NO: 12648 - protein, 2338 aa, Caenorhabditis elegans
MLRSLGILCLLGAALAAPSRIASKDTDLVNDLPGLSFTPTFKQYSGYLDGSQGNHLHYCFLAFILHLILFWTVSKYTIPMDTKLVESQTNPQTAPIVLWLNGGPGCSSLLGLLSENGPYRIQKDGVTVIENVNSWNKAANVLFLESPRDVGFSYREKSATPDLLYNDDKTATDNALALVQFFQRFPEYQGRDFYITGESYGGVYVPTLTKLVVQMIQNNTTPYINLKGFAVGNGALSRKHLTNSGIDLLYYRGMLGTTQWENLRQCCPDTLNNPLVDCDYSKYVVFDNFGNPSPRNDTNDAQAIACGKMVINLSLNSIWETYNDVYNSYQDCYNFDSSVFGAAEERHAKVHQQTMRKIMRTTLSTTGANDAYNLFSNGFNPFIDQGSLYNKMSTDALNNYPCYIDDATTAWLGRTDVRSALHIPAAAPVWQECSDDINAKYYIQQYPDTTPVFQFLVDSGYPLKVLIYNGDVDLACNYLGDQWFVENLATVSYQMTLTTPRQQWNFTRAGTQNKYIPTLAGYLKSWNYQQFSIDLLTVKGAGHMVPMDRPGPALQIFYNYLYNTNGGYSNQVPYDLTATPLRSQFLAPPQKTWTRKQADRVWNLPGITYGLNFKQYSGYLNGVTGNYLHYWFVESQGNPTTDPLVLWLTGGPGCSGLMAMLTELGPFHPNPDGKTLFENVYSWNKAANVIFLESPRGVGFSVQDPSLNNDTIWDDQRTATDTYLALKDFLTVYPEYINRPFFVTGESYGGVYVPTITSLLIDKIQSGDFAQLNLVGMSIGNGELSAIQQFNSAIMMSYFHGLFSKDDFDSLQPCCNQTKTSSQWFEYCNFAQYIHLGPDGTAIPNDKSFCANKVADLGQQRFWNSLNDVYNIYQDCYQQADRAFGSRMSIKQKKEHMRGFIDQGAKISTSSTDNQGGLACYGTTQAANWINLPDVRSALHVSSAAGAWSACNDTINGLYVQQHNDTTSVFQHILDSKYPLRVLIYNGDVDQACNYLGDQWFIEAFALKNQLPVTKPRADWRYMTQIAGYAKKFDNNAGFSVDLITVKGAGHLVPTDRPGPALQMIANFFRNQDYSNPTVIDTTLHPLKNTYVVAEQLAASLNRSSTGVAHNGNRVHVKVHKVVRAGNFAKTGEQDTVRQPTERDAPPPPPTQTKAQDEVTNLPGLTFTPNFKQYSGYLNASAGNYLHYWLVESQLNATYDPLILWLNGGPGCSSIGGFLEELGPFHVNADGKTLFENTFSWNKAGNVLFLEAPRDVGYSFRSNEFAPDTMYNDTYTASDTVLALASFFNKFPEYQNRPFYITGESYGGIYVPTLTRALINAIQTGTIKNVNLVGVAIGNGELSGIQQINSAVSLLYFRGERDKSDWDAISKCCDTSVPQAYCDYIKYVNIDTSGNVWPKVNDNSLAGQCGQLVTQQGFLDVWTTDNDVYNTFADCYTAPGAGDSKLNELASGIRRVQNRRSKRAADVSPFLPSTLFVDQAKKINYQSTDANGGFTCFSGASSENYMNLPEVRTALHIPTSLPYWTDCNDNMNENYIQQHNDTSSVFTDIFATGYPLRFLIYNGDVDMACQFLGDQWFLEKLAKDNGLAVTRQHGPWNYTQGQFLPRVGGYWKQFTYTNTAKNTKVVFDQLTVKGAGHFVPQDRPGPALQMIYNFVNQLDYNRNLTLDYSRKQLLPQYQPAPVTVPRRKADHIFSLPGVTWNVNFMQHSGYLQATRGNKLFYWFVESQSGNEGDPIILWLQGGPGCASTGGLFSEIGPFFVNPDGETLFENIYSWNKAAHILIIDSPRGVGFSYQDKNVNNDTTWDDDKTALDTYTALEDFFVTYPPHRNSELYITGESYGGVYVPTLTRLLIQKIQAGQSNIQLRGMGIGNGMVSAVNDVRTLPDFLYFHGIYDKPMWEKLRACCPSADSSGDCNYDYYITIDSGVNVIAKQFPNNQTLQDCANLVENLSYDRNWKALYDQYNLYQDCYVTPRDQANPFAMKEKFSRLDVDHKLKTSIPQAITKTAPQDPLSTDATGGYSCWSLGAINNYLSLSHVRDALHIPDSVPRWGFCNKINYANLYNDTTQVFTDILNSGYNLKVLIYNGDVDSVCSMFEAESMINNFAAAQTFVSNQPRGSWMYGGQIGGYVQKFQKNNMTIDLLTVKGAGHMSPTDRPGPVLQMMNNFVHGQGNYNTSIAVSMVRQPLLAQFLEQGIGPVGTSAPVASTSTTNTPSPTNQSPVTQAPPVTLPPPSVATAGPTGPILTVVPVSSAPTSGAVSSTTNTPSPTNQSPVTLPPPSVATAGPTGPILTVVPVSSAPTSGAVSSTATAAPVITTTKTSSVLSVSFSMFIVLITKFLL

SEQ ID NO: 12649 - protein, 835 aa, Caenorhabditis elegans
MGYSESRSESVSSKGKTSYGHELETVPLPEKKIYTTWPDMIRHWPKTTLCIVSNEFCERFSYYGMRTVLTFYLLNVLKFTDSQSTIFFNGFTVLCYTTPLLGSIVADGYIGKFWTIFSVSILYAIGQVVLALASTKNFQSSVHPWMDLSGLLIIAFGTGGIKPCVSAFGGDQFELGQERMLSLFFSMFYFSINAGSMISTFISPIFRSQPCLGQDSCYPMAFGIPAILMIVATLVFMGGSFWYKKNPPKDNVFGEVSRLMFRAVGNKMKSGSTPKEHWLLHYLTTHDCALDAKCLELQAEKRNKNLCQKKKFIDDVRSLLRVLVMFLPVPMFWALYDQQGSVWLIQAIQMDCRLSDTLLLLPDQMQTLNAVLILLFIPLFQVIIYPVAAKCVRLTPLRKMVTGGLLASLAFLITGFVQLQVNTTLPTLPEEGEASISFWNQFETDCTITVMSGIHKRVLPHDKYLHEDKKNKSGIYNLFTTKSPAKGNGDWTLTYDLSYDGACGDTSKLEKTVKVTAKSKKIIYVGVGSFGYYQNTANTDKPTDGTGEFSMGIVTVFNSSYGGNFAMCRQNTSDFDVNHPCNPRHPADFYFWETDYNSHTDDRDQNATITGSLSSQPAVTYKQKSVKPGYWQLYYLLNTPKDVDRQTYNKTATLVAPTNYGFHRVKQGGVFIYALTGTYENPKIHELQIVQSNSVSILWQIPQIVVITAAEILFSITGYEFAYSQSAPSMKALVQALWLLTTAAGDSIIVVITILNLFENMAVEFFVYAAAMFVVIAIFALLSIFYYTYNYYTTDEEDGEIGVDDEEEIEDHNPRYSIDNKGFHPDEKDTFDMHF

SEQ ID NO: 12650 - protein, 298 aa, Caenorhabditis elegans
MASTSATLDVLETSKKCLAGSAAAAISKTTTAPFDRVKLVLQLQRQSEFAMAEYNGIRDCISKIRLEQGAMALWRGNGAGVARCLPNHTLNFAFRDIYRNTLLKNVDRNESFGKFLAGTFVSGGLGGATTLFMLYPFDFARTRLALDVKKDGSRKYKGMVDCLKKIKASEGVASWYKGLSSALQFVIASRAIFFGIFDSIRTSVEDPKSLNFAACWAIAQISITTSGMVCYPLDTVRRSMMMQSGKQIKQYTSTKDCWKTLYKKDGINGFYRGALTNSLRSTGGALIITFYYEFSKYM

SEQ ID NO: 12651 - protein, 914 aa, Caenorhabditis elegans
MFEALKEVLGEINSKLAAVNNELSSKIMSENIVSTRPVAQAQYCGPYKLEKTLGKGQTGLVKTGTHCITGRKVAIKIVNKEKLSESVLQKVEREIAIMKLIEHPHVLHLYDVYENKKYLYLLLEHVSGGELFDYLVRKGRLMSKEARKFFRQIISALDFCHAHNICHRDLKPENLLLDERNNIKVADFGMASLQVEGSMLETSCGSPHYACPEVIRGEKYDGRKADVWSCGVILYALLVGALPFDDDNLRNLLEKVKRGVFHIPHFVPADVQSLLRAMIEVDPGKRYSLADVFKHPWVSGTTKADPELELPMSQVVQTHVIPGEDSIDPDVLRHMNCLGCFKDKQKLINELLSPKHNTEKMVYFLLLDRKRRRPAQEDDTEIVLRGAAQNNDPPKKRTDSSRTSRYPMGSIADGSPINPRKTYGRNQKSGRHSSLGGSPTESPRSSTRDLFGSSSSGSYSARAGEDRDRGRSASRSTNSYHYYTQPVDPQTLAEAARHVRDAQERRESRDSGRGSSRKESKDRSDKSASSSSCKNDASSTSSVPHKYSPPSVMSESVVVSSSTMNSTNSSTNSLIAGNSQTSIGSTSGPWRSKLNNIKNSFLGTPRFHRRKMSNGTAESDSEDSQMIDTTDLVKKSWFGSLASSMSVERDDTHCVPVQGKTLNSIKAELIRAFLQIHELSHSVVGQNCFRVEYKRGPTVGGSVFSRGIKMNVDIIPSPQQVVIAGETPTYVVQFVLLAGPVRRFKRLVEHLSAILQNSTQQRADRQQQAALMVRPRRLSDSSVGSACSDSESNASSINMIARHSDKTETTSATSSDPYGPSPSMRSVGSGTANSYKSPTPHRRNTTAVTASSSSASNRYGPSSSSSGSYSNNADYSYHPEYSQRSNGSSAPKNQYSPGSQRSFAFSMFNKADKV

SEQ ID NO: 12652 - protein, 173 aa, Caenorhabditis elegans
MTTPRSAPLYKLKSEDGQIFNVERGPMKFCAFINQKFIDHGVNDRNCERADPILVPFHSSIVQAVIEWLYHYQDNPLARRDSKIRYHDFSEWDKQFFNVESGVLFALLNASHALGVEDLMNMGCAAAAELIRGKSTEEIRKIYGIRSDEEQMEEALANGGEGTSAMTFTTDSD

SEQ ID NO: 12653 - protein, 432 aa, Caenorhabditis elegans
MKRLRFDDEQGSSWLSMRRMFNCRQEEKVNAIRACAGEIRFNACEYLINWSKNLEMVENSLINMRTKLFLNYNLEEVSITGQILMETAAERAAKVAKEAASHHKLMHLHISKMGRLIDKQVDRHFITPFRGTFDLNDSKLSRQLTIAMIYDFSMCNGLTDTGVALKKMSDVDEKYSITEPDTLQQIVSDLREGDIESSLDYLEAAQPEEDGNIRTYLHTQLITDNIELGSNNYDKAVKDLRRFKSPFVDDRQKFKHLVGALLVGKPSMIDIRYKYLFDFTNREILTLKMASFFIPYEAPLKNLMRFGMHAMIQLGDLFPVGFAPAAIDDNELPIEIGFHATHSSFTCPILKEQCDAENPPMRLICGHVISKDAINRLTTSIRQQRNSSRLSKFKCPYCPREQLLENTRQVDFLKWCESDYTDEEVQLFQFFN

SEQ ID NO: 12654 - protein, 538 aa, Caenorhabditis elegans
MVLGTVKAKAIRWLEDNRGLVIVLFCLPASFLFDLFIQFRIWLDRKLSATTSHQQRVQKIQDQVTEWSKLPDSEQKPLCTARPNWLSLSTTFFDKRKCHQVPIDLHDVLSLDEKNLTVTVEPNITVREICKFLIPKGYTLAVTLEIGDATLGGLAFGVGMTTYSHKVGLYQEAIVSYEVVTADGNVITVTDSNEHSDLFYCLPWSHGTLGFLVGLTLRIVKVKPYVHMEYIPCHSQDEYCKKIMELSGATDKNTKVADYLEVTIYDKNEAVIMVGNFADVDSKSNAKVNDVCWFYKPWFYKHVETFLKKGGEEYIPLESYLLRHNRAIFWVVESMIPFGNHPVFRAFLGWLCPPKPAFLKFTTTQAVREMTFAKQVFQDIVMPLDTLKEQVDTAVKLFDTYPLLVYPCRIYDHKGGAPQGQLRAPPKSRLVPGTNYSMFNDLGVYGTPGQVERREPYNPTHAMRAMEKFTRDVGGYSFLYADIFMSEEEFNEMFDMTLYNQVRLRYHCDGAFPRLYDKVKPEIDVISIGETYAVKKEE

SEQ ID NO: 12655 - protein, 2105 aa, Caenorhabditis elegans
MAAHQILLLCLLLLLAPLRNGQTTPTTRAQADLVNQLPGTIFQVNFKQYAGYLNSDPNKNYNNLHYWLIESQLTPSNDTLLLWINGGPGCSSVFGQIQEIGPFHVSSDSQTVYENVFAWNKVSNLLAIDGPGAGFSWQQNLFQDDSYVTGALLNALMDFYTVYPNMLNSDLYIAGEGYGSFFASSLVESLMVNNTPRPDIVTSPVNIRGLLLANGDLSARLQYNSLIPFYYTHGFAGSKQYDDLKSVCCTNASTQTCDFFNSNTACRTKADNAIATWSNYQANKIVLTRRGCSEINAAVDNYNSTDSFRGYPCFALSATAAYLNRQDVQAALHVSVNASTNFQTCRNLTYGELSTDLQIRISSILTSEKYAQNNMKIMIYNGDLDLWSNFIGAQRFGQEIAAALKLNTTEDRIWRHNYDSAAFVWMDGGVITSYSSNFHIASIRGGGHFAPQNRPSQSLQLYRDFVLGLFFNNCLSRVNKVAAPLLPAYQQLAAPATRRDADKIVNLPGLTYQINFNQYSGYLNASDTHRFHYWFVESQNDPTNSPVLLWLNGGPGSSSLWGMLTENGPFRPNKDGQTLYENVHSWNKFANVLYLESPHQVGYSYSTVANDYTYGDDLTASDNYNALKDFFNNIFPQYKQNPFYITGESYGGVYIPTLSKLLLQMLSAGEININFKARLIFIGIAIGNGELTTKLQVNSAIFQLYTYGLFGENEYNALVARCCKNVTDPTQCDFYTPYVFFDYLGNYKAVDGADPFCSSTGLLNLASSDPFDGFPCWSTDATTTYLNRDDVRNALHIPTTVQQWQSFNQTVNAQLYNRSYFELDAVLNRILSSYYYKQNNMKILIYNGDVDMVCNHLGDQWLIEQVASNAGLKTVSPRQPWNYVMAGENYLPQLAGYVKVFDSNLNLVTVKGSGHLVPQDRPGPALQMIFNFISGVNLNTTFPYALPAAPLLPAYSDLQGCQAPQYPTAQSLPTLPPLPPLPPGVTYPFVAKKDVVEVAEPGTIAADEHGSQIYPTALNDAAKADMILSLPGLTFNVTYRMFSGYLTADETPLNHLFYWFVESQNDPVNDPVVLWLNGGPGCSSLGGFFTELGPFHPNDDGGQTLYENVFSWNKKANVIFLEAPAKVGFSYTEDPNYYWDDDTTAQNNGYAIKSFFQKKFPQYAQNQFFITGESYGGVYCPTLTLNLVQQIDAGILNLNFKGTAVGNGILSEYLQTNSEIVLQYGRGFNGVDDWNNLKTACNLTNSDTIYYDYQGAPEGSACYQAVDDNQKKFYGLDERYGDPYNMYQDCYLYNNKGAWQTPSAQQQTKPKTRRERALRAHMNRRKSFASASIKFDNSNSKNWYGSTDPFRGLNCFAGDALVTYLSRDDVQTAIHSRKQPLWVDCADENPANHFRYHTQEKYYDMQNTISDIMDSKWYTQNSMRLMFYNGDVDTICQFLGDQWLIEKLVTRRNLTVTSPRQPWYYQQGSQYVTTIAGYAKSWTQNLVQLTVKGSGHFVPSDRPAQALQMLTNFLSNQANYSTPAGIDVTPQPLTNVISQTNCTTGQTDRIINLPGLPADMLFKQYSGFLDGLSGHKVHYWLVESENNPSTDPLLLWLNGGPGSSSLMGLFEENGPFRVSKDSQTLSRNPYSWNKFANVLYLESPIGVGYSYAYNNTNIQYDDVTTAQENYAALKSFFAQYPQYTTSDFYTTGESYAGVYLPGLSALLVQGIKSGDININYKGVSIGNGVIDKRTDMNSQLHYQYYHGGISATTYNTALQLCCSGDEFKCRFSDRMTNFNNSIPWGDLSDPCYDFVVATGAQLLLTAFDPYNMYQQCWTIPYNDTTPRTPYGETWTGINYESSDFLNGYPCYDDSAMEGYLNRPVVRKALNIPDSVPYWAANNNIINAYNQQVDSIVPNLQIIMANAPANFKMLLYSGDADTMVNWLGAEIFTANNFAALGLTTSSPRAQWTFQYNSTFQPTVAGYQTSYTSNAINIDVLTVKGSGHFVPLDRPQQALQMIYNFVKSRGYNTPFDLNSNFTTTTTTSTTTTTPGTGPTVTAAQTTTTTPSTPGAGTTGTPGTGPTVTAAPTNGISTTQPIITTTKGAEGRGVLTIMATILSVLLFN

SEQ ID NO: 12656 - protein, 994 aa, Botryotinia fuckeliana
MAETFTGNRSQGLMRRLSNKISRRQSTNTSREQSAGPVMLRRRSDSTSTAPDSRHYLLNSDSDEDVHEDTIEWVDSPLGIEGLVGDYPSSNASFACSSTMTGGNAGLAFGPVIPTVLLQGTTMIKITKKKRKVLTFVLEDEACKVSWDKTRPAKSFLIDNIKEIRLGSDALNYREEFKVDSQDEPRFFSILYVVPDNKSTGRSTKIMHLIAPDEQTFDLWTTTLEAISKHRYENMSSLVAFNEKAVRNYWRGEMTKQFSDTPHAEDEEALDFEGVEQLCKNLHINTSSRFLRERFQQADATKSKKLIFSEFQEFVKLMKRRGDVSEIYRELASDNVKGITLEEFIDFVNVVQGENVEKDRAKWESIFAKFARRSRSRDQPLQEGEAARMSEEALATFFTSVHNVPLETVPETFTLDRPMHEYFISSSHNTYLMGRQVAGESSVEAYISALIKGCRCVEIDCWDGKDGRPIVNHGHTMTRPIMFSDVMYTIAKYAFVKSHFPLWISLEVHCNDAQQAAMAQIIKEACGDLLVTEPLDPSSQVLPSPSQLMDRILIKVKKPRISDESSPKVNGRSRGNSLSSPRVYPAGLDNSTISSGSLLPPPTANPSGSHIKQNIRRTGTDETTSSSSSDSEGNEDRPKDKPKTSKIVKVLGELGIYSAGVKFRGFDDPESKAYNHIFSFMESTFDRNSKTQIDRRAMTRHNMRYLMRVYPNGWRVASTNFDPLKYWRRSVQMVALNWQTHDLGMQMNDAMFAGGTDQSGYVLKPSELREIKMLPSVPEEAGADHVKRERKNVNFSIDIISAQQLMRPKGLPSNRSVDPYIEVEVYHADDKSKETKGVIGEGGLDASAKDGSSGLGAPHKRRTHIVQENGFNPVFNKKFNFALTTKFPELVFVRWTVRCSSDGHSYNDKTLPLATYTAKLSSLKQGYRTLPLYDTNGDQFLFSTLFCRVKIDPATSIYVNAESNESVGVLKSLGRTVFNRTPLSPKPSVDSNHQ

SEQ ID NO: 12657 - protein, 380 aa, Washingtonia robusta
MSSTAGKVIKCRAAVAWEAGKPLVIEEVEVAPPQAMEVRMKILYTALCHTDVFFWEAKGQNPLFPRILGHEAGGIVESVGEGVTDLAPGDHVLPVFTGECRECAHCLSEESNMCELLRINTDRGVMINDGKSRFSINGKPIYHFVGTSTFSEYTVVHSGCVAKINPLAPLNIVCILSCGISTGLGATLNVAKPTKGSTVAVFGLGAVGLAAAEGARLAGASRIIGVDLNPRRFHEAKKFGVNEFVNPKDYNKPVQEVIAEMTNGGVDRSIECVGNIDAMVSAFECVRDGWGVAVLVGVPHKDAMFKSHPVNFLNERTLKGTFFGNYKPRSDLPAVVEMYMNKELELEKFITHEVPFSEINKAFDYMASRGQLRCIIRMDG

SEQ ID NO: 12658 - protein, 306 aa, Washingtonia robusta
  unsure (1)..(306): unsure at all Xaa locations
IVESVGEGGXDLSPGDHVLPVFTGECKECAHCKREESNMCDLLRIDTERGVMISDGQSRFSINGKPIYHFVGTSTFSEYTVIHSGCVAKINPLAPLDKVCVLSCGISTGLGATLNVAKPPMGSTVAIFGLGAVGLAAAEGARIAGASRIIGVDRNPARFDEAKNFGITEFVNPKDYDRPVQEVLAEMTGGGVDRSIECTGNINAMISAFECVHDGWGVAVLVGVPHKEAEFKTHPINFLNERTLKGTFFGNYKPRTDLPLVVEKYMNKELELEKFITHSVPFSEINKAFDYMLKGDGLRXIIHMDG

SEQ ID NO: 12659 - protein, 507 aa, Musa acuminata
MALPPLLLSPLPSLLVVLALLSSLLLAGRKARGGSATWKLPPGPPKLPVIGHLHLLGSSLLHRSLWELSKKHGPLMHLKFGRVPVVVVSSPEMAKEVLKTHDLECCSRPSLLSFSKFSYGLSDVAFIPYGERWRQLRKLCTVELLSTRKINSFRDIRKEEMERVTKLICSHVRASSMVNLSELLLSLSCNMTCRSAFGSGFDDGGDIQLHDMLREAQEELSGLFLSDYLPLLGWVDRLSGMRSRLERAFLKLDSIYQRRIDYHQDRLRQQGKEDGDVLDALLRMQKDEEGLTEDHIKGVLMDIFIAGTDTSSATVEWAMAELIRQPELMKRAQDEVRRCVGSKGEVEESDLHQLHFFKCVIKETMRLHPPAPLLLPRETMQHFKLNGYDILPKTWMYVNAWAIGRDPNSWGRPHVFDPERFMHDSTEASGQDFKLIPFGEGRRICPGKNLGMLMVELVLANLLYSFDWHLPPGMVKEDISMEEAPGVTVHREYALCLMATKYDATTA

SEQ ID NO: 12660 - protein, 437 aa, Caenorhabditis elegans
MILIAIIESFIEYLRKIVWVAHVSSNAILAAAQPFYPPPVQDSQPDRPIGYGAFGVVWSVTDPRSGKRVALKKMPNVFQNLASCKRVFREIKMLSSFRHDNVLSLLDILQPANPSFFQELYVLTELMQSDLHKIIVSPQALTPDHVKVFVYQILRGLKYLHTANILHRDIKPGNLLVNSNCILKICDFGLARTWDQRDRLNMTHEVVTQYYRAPELLMGARRYTGAVDIWSVGCIFAELLQRKILFQAAGPIEQLQMIIDLLGTPSQEAMKYACEGAKNHVLRAGLRAPDTQRLYKIASPDDKNHEAVDLLQKLLHFDPDKRISVEEALQHRYLEEGRLRFHSCMCSCCYTKPNMPSRLFAQDLDPRHESPFDPKWEKDMSRLSMFELREKMYQFVMDRPALYGVALCINPQSAAYKNFASSSVAQASELPPSPQAW

SEQ ID NO: 12661 - protein, 738 aa, Petunia x hybrida
MDCNCFDPQWPADELLMKYQYLSDFFIALAYFSIPVELVYFVQKSAVFPYRWVLVQFGAFIVLCGATHLINLWTSTAHTRTLAIVMTTAKVLTAVVSCATALMLVHIIPDLLSVKTRELFLKNKAAELDREMGLIRTQEETGRYVRMLTHEIRSTLDRHTILKTTLVELGRALGLEECALWMPTRTGLELQLSYTLRHQNPVGFTVPIQLPVINQVFSTNRAVKISPNSPVARLRPAGKYMPGEVVAVRVPLLHLSNFQINDWPELSTKRYALMVLMLPSDSARQWHAHVLELVEVVADQVAVALSHAAILEESMRARDLLMEQNVALDLARREAETAVRARNDFLAVMNHEMRTPMHALIALSSLLQETELTPEQRLMVETILKSSNLLATLINDVLDLSRLEDGSLQLDIGTFNLHALFREVLNLIKPIASVKKLFVTLSLSSDLPEFAIGDEKRIMQVLLNVIGNAVKFSKEGSVSVSAVAAKSESLRDPRAPEFFPVQSENHFYLRVQVKDTGSGISPQDIPKLFNKFAQNQALATKNSGGSGLGLAICKRFVNLMEGHIWIESEGLGKGCTAVFVVKLGIPGRSNESKLPFMPRLPPNHMQMIFQGLKVLVMDDNGFSRMVTKGLLVHLGCDVTTVASGDECLRVLAQEHRVVFMDVSIPGIDCYEVAVRIHEKFNKRHDRPHIVALTANTDRVIKENCMRAGMDGVILKPVSVDKMRSVLSELLEHGVVLQS

SEQ ID NO: 12662 - protein, 738 aa, Petunia x hybrida
MDCNCFDPQWPADELLMKYQYLSDFFIALAYFSIPVELVYFVQKSAVFPYRWVLVQFGAFIVLCGATHLINLWTSTAHTRTLAIVMTTAKVLTAVVSCATALMLVHIIPDLLSVKTRELFLKNKAAELDREMGLIRTQEETGRYVRMLTHEIRSTLDRHTILKTTLVELGRALGLEECALWMPTRTGLELQLSYTLRHQNPVGFTVPIQLPVINQVFSTNRAVKISPNSPVARLRPAGKYMPGEVVAVRVPLLHLSNFQINDWPELSTKRYALMVLMLPSDSARQWHAHELELVEVVADQVAVALSHAAILEESMRARDLLMEQNVALDLARREAEMAVRARNDFLAVMNHEMRTPMHAIIALSSLLQETELTPEQRLMVETILKSSNLLATLINDVLDLSRLEDGSLQLDIGTFNLHALFREVLNLIKPIASVKKLFVTLSLSSDLPEFAIGDEKRIMQVLLNVIGNAVKFSKEGSVSVSAVAAKSESLRDPRAPEFFPVQSENHFYLRVQVKDTGSGISPQDIPKLFNKFAQNQALATNNSGGSGLGLAICKRFANLMEGHIWIESEGLGKGSTAVFVVKLGIPGRSNESKLPFMPRLPPNHMQMTFQGLKVLVMDDNGFSRMVTKGLLVHLGCDVTTVASGDECLRVLAQEQSVVFMDVSIPGIDCYEVAVRIHEKFNKRHDRPLIVALTASTDRVIKENCMRAGMDGVILKPVSVDKMRSVLSELLEHGVVLQS

SEQ ID NO: 12663 - protein, 753 aa, Petunia x hybrida
MGSLLRMNRLLTSIVDSCNCIDPQLPADDLLMKYQYISDFFIALAYFPIPVELIYFVKKSAVFPYRWVLVQFGAFIVLCGATHLINLWTFSMHTRTVAVVMTTAKVLTALVSCITALMLVHIIPDLLSVKTRELFLKKKAAQLDREMGIIRTQEETGRHVRMLTHEIRSTLDRHTILKTTLVELGRTLALEECALWMPTRTGLELQLSYTLRHQNPVGLTVPIQLPVINQVFGTNRAVKISPNAPVARLRPTGKYMPGEVVAVRAPLLHLSNFQINDWPELSTKRYALMVLMLPSDSARQWHVHELELVEVVADQVAVALSHAAILEESMRARDLLMEQNVALDLARREAEMAVRARNDFLAVMNHEMRTPMHAIIALSSLLQETDLTPEQRLMVETILKSSNLLATLINDVLDLSRLEDGSLLLDIGTFNLHALFREVLSLIKPITSVKKLFATLSLSSDLPEYVIGDEKRLMQILLNVVGNAVKFSKEGSVSISAFVAKSESLRDPRAPEFFAVPSENHFYLRVQVKDTGVGINQQDIPNLFSKFAQSEALTTKNSDGSGLGLAICKRFVNLMEGHIWIESDGLGKGCTAIFIIKLGIPGRPNESKLPLMSKLTANELQMTFHGLKVLVMDDNGVSRMVTKGLLAHLGCDVTTVGSRDECLRVVSQEHKVVFMDVSMQGIDCYEVAVLIHERFGKHHGRPLVVELTGNTDSVTKENCMRVGMDGVILKPVSVDKMRSVLSELLEHGVVLQS

SEQ ID NO: 12664 - protein, 354 aa, Petunia x hybrida
MDCNCFDPQWPADELLMKYQYLSDFFIALAYFSIPVELVYFVQKSAVFPYRWVLVQFGAFIVLCGATHLINLWTSTAHTRTLAIVMTTAKVLTAVVSCATALMLVHIIPDLLSVKTRELFLKNKAAELDREMGLIRTQEETGRYVRMLTHEIRSTLDRHTILKTTLVELGRALGLEECALWMPTRTGLELQLSYTLRHQNPVGFTVPIQLPFMPRLPPNHMQMTFQGLKVLVMGDNGFSRMVTKGLLVHLGCDVTTVASGDECLRVLAQEQSVVFMDVSIPGIDCYEVAVRIHEKFNKRHDRPLIVALTASTDRVIKENCMRAGMDGVILKPVSVDKMRSVLSELLEHGVVLQS

SEQ ID NO: 12665 - protein, 279 aa, Saccharum officinarum
DACEKWGFFEILNHGISTELMDEVEKLTKDHYKRVREQRFLEFASKTLKDAQDVKAAENLDWESTFFVRHLPESNIAEIPDLDEDYRRAMRQFTGELEALAERLLDLLCENLGLDRGYLARAFAGPRTGAPTFGTKVSSYPPCPRPDLVSGLRAHTDAGGIILLFQDDALGGLQLLKDGAWVDVPPLRHSIVVNLGDQLEVITNGRYKSVMHRVVAQPDGNRMSIASFYNPGSDAVIFPAPALVKAEEAAAGAYPRFVFEDYMKQYVRHKFEAKEPRFE

SEQ ID NO: 12666 - protein, 4144 aa, Canis familiaris
MFSSSQIPRVFLIPSRRELRLVLQLQESLSAGDRCSAAMASYQLTRGLGQECVLSSDPAVLALQTSLVFSKDFGLLVFVRKSLSIDEFRDCREEVLKFLYIFLEKIGQKITPYSLDIKTTCTSVYTKDKAAKCKIPALDLLIKLLQTLRSSRLMDEFSIGELFNKFYGELALKTKIQDTVLEKIYELLGVLAEVHPSEMINNSEKLFRAFLGELKIQMTSAIREPKLPVLAGCLKGLSSLMCNFTKSMEEDPQTSREIFDFALKAIRPQIDLKRYAVPLAGLCLFTLHASQFSTCLLDNYVSLFEVLSKWCSHTNVEMKKAAHSALESFLKQVSFMVAKDAEMHKSKLQYFMEQFYGIIRNMDSNSKDLSIAIRGYGLFAGPCKVINAKDVDFMYIELIQRCKQLFLTQIDTVDDHVYHMPSFLQSIASVLLYLDRVPEVYTPVLEHLMVAQIDSFPQYSPKMQSVCCKALVKVFLALGGKGPVLWNCISTVVHQGLIRICSKPVILQKGVESEPEEYRASGEVRTGKWKVPTYKDYLDLFRSLLSCDQMMDSLLADEAFLFVNSSLQNLNRLLYDEFVKSVLKIIEKLDLTLEKRNVGEHEDENEATGVWVIPTSDPAANLHPAKPKDFSAFINLVEFCRDILPEKHIEFFEPWVYSFAYELILQSTRLPLISGFYKLLSVAVRNAKKIKYFEGVGMKSQTQAPKDPEKYSCFALFAKFGKEVTVKMKQYKDELLASCLTFILSLPHDIIELDIRAYIPALQMAFKLGLSYTPLAEVGLNALEEWSVCICKHIIQPHYKDILPSLDGYLKTSALSDETKNSWEVSAPSQAAQKGFNQVVLKHLKKTKNISSNEALSLEEIRIRVVQMLGFLGGQINKNLLTATSSDEMMKKCVAWDREKRLSFAVPFIEMKPVIYLDVFLPRVTELALSASDRQTKVAACELLHSMVMFTLGKATQMPECGQGFPPMYQLYKRTFPALLRLACDVDQVTRQLYEPLVMQLIHWFTNNKKFESQDTVALLETILDGIVDPVDSTLRDFCGRCIREFLKWSIKQTTPQQQEKSPVNTKSLFKRLYSFALHPNAFKRLGASLAFNNIYREFREEESLVEQFVFEALVTYLESLALAHTDEKPLGTIRQCCDAIDHLRHIIEKKHVSLNKVKKRRRPRGFPPSASLCLLDMVQWLLAHCGRPQTECRHKSIELFYKFVPLLPGNKSPSLWLKDILKNKDTSFLINTFEGGGGSCDRPSGILVQPTLFHLQGPFSLRAALQWMDMLLAALECYNTFIEEKTLKAPDVLGTETQSSLWKAVAFFLDNIAMHDITAAEKCFGTGAAGHRPSPQEGERYNYSKCTIVVRIMEFTTTLLNTSPDGWKLLEEDLCNNKNFMTLLVKILCQPSSIGFNIGDVLVMNHLPDVCVNLMKALKKSPYKDTLEMCLKEKITVQSIEELCAVDLYGPDAYVDRATLASVVSACKQLHRAGVLHVVLPSQSADQRHSVGIKLLFLVYKSIAPGDEREYFPSLDPSCKRLASGLLELAFAFGGLCEHLVDLLLDTAVLSMPASGESQRNMVSFSHGEYFYSLFSEIINTELLRNLDMTVLKLMKSSVDNPKMVSAILNGMLDQSFRDRASRKQQGLKLASTILHNWKKWDSWWAKDSAPESKTAVLTLLAKILQIDSSVSFNTNHSAFPEVFTTYTSLLADSNLGLHLMGQAVILLPFFTNLTGGNLEDLEHVLEKLIVSNFPMKSEEFPVGTLRYSNYVDCMKKFLDALELSQSPVLLQLMAEILCREQQHVMEELFQSTFKKIARKSSCVTQLALLESVYRMFKRDDLLSNVTRQAFVDRSLLTLLWHCGLNALREFFGKIVVETIDVLKSRFTKLNESTFDTQITKKMGFYKMLDVMYSRLSKDDVHSKESKINQVFHGSCITEGNELTKTLIKLCYDAFTENMAGENQLLERRRLYHCAAYNCAISVICCVFTELKFYQGFLFSEKPEKNLLILENLIDLKRCYTFPIEVEVPMERRKKYIEIRKEAREAVNGDSDGPHYLSSLSYLADSSLSEEMSQFDFSTGVQSYSYGSQDPKSTHGHFRRREHKDPMVQDAVLELEMDELNQHECMATMTALIKHMQRNQILSKDEGSVPRNLPPWMKFLHDKLGNPSVSLNIRLFLAKLVINTEEVFRPYAKYWLSPLLQLVVSENNGGEGIHYMVVEIVVTVLSWTGLATPVGVPKDEVLANRLLHFLMEHVFHQKRAVFRHNLEIIKTLVECWKDCLSVPYRLIFEKFSSKDPNSKDNSVGIQLLGIVMANNLPPYDPKCGIERIKYFEALVSNMSFVKYKEVYAAAAEVLGLTLRYITERENILENVVYELVIKQLKQHQNTMEDKFIVCLNKVVKNFPPLADRFMNAVFFLLPKFHGVMKTLCLEVVLCRAEEITNIYLELKSKDFIQVMRHRDDERQKVCLDIIYKMMAKLKPVELRDLLNSVVEFISHPSPVCREQMYNILMWIHDNYRDPESQADDDSREVFKLAKDVLIQGLIDENAGLQLIIRNFWSHETRLPSNTLDRLLALNSLYSPKIEVHFLSLATDFLLEMTSLSPDYANPVFEHPLSECEFQEYTIDSDWRFRSTVLTPMFIETQASQSTLQTRTQERSLPAQGVMARQIRATQQQYDFTPTQTADGRSSFNWLTGSSIDPLVDYTVSSSDSSSSSLLFAQKRNEKSQRAPLKSVGPDFGEKKLGLPGDKVDNKAKGIDNRTEILRLRRRFIKDQEKLSLIYARKGIAEQKREKEIKSELKMKHDAQVILYRSYRQGDLPDIQIKYSSLVTPLQAVAQRDPVVAKQLFGSLFSGIIKEMDKYKTMSEKNNITQKLLQDFSHFLNSTFSFFPPFVSCIQEISCQHTDLLSLDPGSIRASCLASLQQPVGVRLLEEALLHLGPQEPPAKQFKGRMRVSPDVVRWMELAKLYRSIGEYDILRGIFSSEIGTKQITQSAIFAEARSDYSEAAKQYNEALNKEEWVDGEPTEAEKDFWELASLDCYNQLAEWKSLAYCSIVSVDNENPPDLNKMWSEPFYRETYLPYMIRSKLKLLLQGEADQSLLTFIDEAVNKDLQKALIELHYSQELSLLYILQDDIDRAKYYIENCIQIFMQNYSSIDVLLHRSRLTKLQSVQTMIEIQEFISFISRQGNLSSQAPLKRLLKSWTNRYPDARMDPVHIWDDIITNRCFFLSKIEEKLTLPLGDHSLSMDEERDSSDKMEVQEQGEEVCSLIKNCMFSMKMKMVESARKQHNFSLAMKLLKELRRESKTRDDWQVKWVHTYCRLSHSRIQGQSCLQQILSALKTVSLLAGESTSSYFSKNVLAFHDQNILLGTTYSIIANALRREPACLAEIEESRARRILDLSGSSLENAEKVIAVLYQRAFHHLSEAVRTAEEEAQPSLRGQGPVASLTDAYMTLADFCDQQLRKEEESASVTESVELQTYPGLVVDNMLKALKLHSSEARLKFPRLLQIIELYPEETLSLMTKEISSTPCWQFIGWISHMVALLDQEEAVAVQCTVEEIADNYPQAIVYPFIISSESYSFKDTSTGHKNKEFVARIKTKLDLGGVIQDFISALEQLSNPEMLFKDWTDDMKAELAKNPVSKKNIEKMYERMYAALGDLRAPGLGAFRRRFIQVFGKEFDKHFGKGGSKLPGMKLRDFGSITDSLFYKMCTDSKPPGNLKECSPWMSDFKVEFLRNELEIPGQYDGKGKPLPEYHARIAGFDERIKVMASIRKPKRIIIRGRDEKEYPLLVKGGEDLRQDQRIEQLFEVMNVLLSQDTACSQRNMQLKTYHVIPMTSRLGLIEWIENTLTLKDFLLSNMSREEKAAYTSDPKAPPCEYRDWLAKMSGKYDVGAYMSMFKAASRTETVTSFRRRESRVPADLLKRAFLKMSTGPAAFLALRSHFASSHALMCISHWILGIGDRHLNNFMVSMETGGLIGIDFGHAFGSATQFLPVPELMPFRLTRQFINLMLPMKEAGVVYSIMVHALRAFRSHSDLLTNTMDVFVKEPSFDWKNFEQKMLKKGGSWIQEINVTEKNWYPRQKIHYAKRKLAGANPAVITCDELFLGHEKALAFGDYVAVARGSKDHNIRAQQPENGLSEEAQVKCLIDQATDPNILGRTWIGWEPWM

SEQ ID NO: 12667 - protein, 4106 aa, Equus caballus
AVAGYQLIRGLGQECMLSTGPAVLALQTSLVFSKDFGLLVFVRKSLSIDEFRDCREEILKFLYIFLEKIGQKITPYSLDIKNTCTSVYTKDKAAKCKIPALDLLIKLLQTLRSSRLMDEFRVGELFTKFYGELALKTKIPDTVLEKIYELLGVLGEVHPSEMISNSEQLFRAFLGELKSQMTSTVREPKLPVLAGCLKGLSSLMCNFTKSMEEDPQTSREIFDFALKAIRPQIDLKRYAVPLAGLCLFTLHASQFSTCLLENYVSLFEVLSKWCGHTNIELKKAAHSALESFLKQVSFMVAKDAERHKNKLQYFMEQFYGIIRNMDSNSKDLSIAIRGYGLFAGPCKVINAKDVDFMYVELIQRCKQLFLTQTDTVDDHIYQMPSFLQSIVSVLLYLDTIPEVYTPVLEHLMVVQIDSFPQYSPKMQPVCCRAIVKLFLALAEKGPVLWNCISTVVHQGLIRICSKPVVFQKGAGSESEDYHTSEEARTGKWKMPTYKDYLDLFRYLLSCDQMMDSLLADEAFLFVNSSLHSLNRLLYDEFVKSVLKIVEKLDLTLEKQNVGEQEDETEATGVWVIPTSDPAANLHPAKPKDFSAFINLVEFCREILPEKHVEFFEPWVYSFAYELILQSTRLPLISVFYKLLSVAVRNAKKMKYFEGVGPKSQKQSPEDLEKYSCFALFAKFSKEVSIKMKQYKDELLASCLTFILSLPHDIIELDVRAYVPALQMAFKLGLSYTPLAEVGLNALEEWSGYICKHVIQPYYKDILPSLDGYLKTSVLSDETKNSWQVSALSRAAQKGFNKVVLKHLTKTKSISSNEALSLEEVRIRVVRILGSLGGQINKNLVTAASSDEMMKKCVAWDREKRLRFAVPFMEMKPVIYLDLFLPRVTELALSASDRQTTVAACELLHSMVMFMLGKATQMPEDGQGSPPMYQLYKRTFPVLLRLACDVDQVTRQLYEPLVMQLIHWFTNNKKFESQDTVALLETILDGIVDPVDSTLRDFCGQCIQEFLKWSIKQTTPQQQEKSPVNTKSLFKRLYSFALHPNAFKRLGASLAFNNIYREFREEESLVEQFVFEALVTYMESLALAHTDEKSLGTIQQCCDAIDHLSLIIEKKHVSLNKAKKRRLPRGFPPATSLCLLDVVQWLLANCGRPQTECRHKSIELFYKFVTLLPGNKSPFLWLKDIIKKEDISFLINTFEGGGSGRPSGILAQPTLFHLQGPFSLRAALQWMDMLLAALECYNTFIEEKTLEAPKVLGTETQSSLWKAVAFFLESIAMHDIMAAEKYFGTGATGNRPSPQEGERYNYSKCTIVVRIMEFTTTLLSTSPEGWKLLEKDVCNTNLMKLLVKTLCEPSSIGFNIGDVAVMNYLPSVCTNLMKALKKSPYKDILEMHLKEKITAQSIEELCAVDLYCPDACVDRARLASVVSACKQLHRAGVLCVIIPSQSADQHHSIGTKLLSLVYKSIAPGDEQQCLPSLDPNCKRLASGLLELAFAFGGLCEHLVSLLLDTTVLSMPSRGGSQKNIVSFSHGEYFYSLFSETINTELLKNLDLAVLELMKSSVDNPKMVSNVLNGMLDQSFRDRTSEKHQGLKLATIILQNWKKCDSWWAKDSAPESKMAVLTLLAKIFQIDSSVCFNTNHCMFPEVFTTYVSLLADSKLDLHLKGQAIILLPFFTSLTGGSLEDLKVVLENLIVSNFPMKSEEFPPGTLQYNNYVDCMKKFLDALELSKSPMLLQLMTEILCREQQHVMEELFQSTFKKIARKSSCITQLGLLESVYRMFRRDDLLSNITRQAFVDRSLLTLLWHCSLNALREFFSKIVVEAINVLKSRFIKLNESAFDTQITKKMGYYKMLDVMYSRLPKDDVHSKESKINQVFHGSCITEGSELTKTLIKLCYDAFTENMAGENQLLERRRLYHCAAYNCAISVVCCVFNELKFYQGFLFTEKPEKNLLIFENLIDLKRCYTFPIEVEVPMERKKKYLEIRKEAREAAASGDSDGPRYISSLSYLADSSLSEEMSQFDFSTGVQSYSYSSQDPKSTTAHFRRQKHKESMIQDDILELEMDELNQHECMATMTALIKHMQRNQILPKEEEGSVPRNLPPWMKFLHDKLGNPSISLNIRLFLAKLVINTEEVFRPYARYWLSPLLQLVVSGNNGGEGIHYMVVEIVVIILSWTGLATPIGVPKDEVLANRLLHFLMKHVFHQKRAVFRHNLEIIKTLVECWKDCLSIPYRLIFEKFSSTDPNSKDNSVGIQLLGIVMANNLPPYDPKCGIESIKYFQALVNNMSFVRYREVYAAAAEVLGLVLRYITERENILEESVCELVIKQLKQHQNTMEDKFIVCLNKAVKNFPPLADRFMNTVFFLLPKFHGVMKTLCLEVVLCRAEEITDLYLQLKSKDFIQVMRHRDDERQKVCLDIIYKMMARLKPVELRELLNPVVEFISHPSPVCREQMYNILMWIHDNYRDPEGQTDDDSQEIFKLAKDVLIQGLIDENPGLQLIIRNFWSHETRLPSNTLDRLLALNSLYSPKIEAHFLSLATDFLLEMTSVSPDYSNPMFDHPLSECKFQEYTIDSDWRFRSTVLTPMFIETQASQSALQTRTQEGSLSARGVMTGQIRATQQQYDFTPTQNTDGRSSFNWLTGNSIDPLVDFTVSSSSDSLSSSLLFAHKRSEKSQRGPLKSVGPDFGKKRLGLPGDEVDNKAKGTDNRAEILRLRRRFLKDREKLSLIYARKGVAEQKREKEIKSELKMKHDAQVILYRSYRQGDLPDIQIKYSSLITPLQAVAQRDPIIAKQLFGSLFSGIIKEMDKYKTMSEKNNITQKLLQDFNNFLNTTVSFFPPFISCIQEISCQHADLLSLDPASVSASCLASLQQPVGVRLLEEALLHLLPEEPPAKRVRGRPCLYPDFVRWMELAKLYRSIGEYDILRGIFNSEIGTKQVTQNALLAEARNDYSEAVKQYNEALNKQDWVDGEPMEAEKDFWELASLDCYNQLAEWKSLAYCSTVSVDSANPPDLNKMWNEPFYQETYLPYMIRSKLKLLLQGEGDQSLLTFIDEAVSKELQKVLVELHYSQELSLLYILQDDVDRAKYYIENCIRIFMQSYSSIDVLLERSRLTKLQSLQALIEIQEFISFIRKQGNLSSQIPLKRLLKTWTNRYPDAKMDPMNIWDDIITNRCFFLSKIEEKLTIPPDDHSMNTDGDEDSSDRMKVQEQEEDIYSLIKSGKFSMKMKMIESARKQKNFSLAMKLLKELHKESKTRDDWLVKWVQSYCRLSHSRSQTQNRPEQILTVLKTVSLLDENTSSYLSKNIPVSRDHNILLGTTYRIIANALSSDPTCLAEIGESKARRILELSGSSLENAEEVIAGLYQRVLHHLSEAVRIAEEEAQPFTRGQEPAVGVIDAYMTLVDFCDQQLRKEEESSSVTESVQLQMYPALVVDKMLKALRLDSNEARLKFPRLLQIIERYPEETLSLMTKEISSIPCWQFIGWISHMVALLDKEEAVAVHRTVEEIADNYPQAMVYPFIISSESYSFKDTSTGYKNKEFVERIKIKLDQGGVIQDFINALEQLSHPEMLFKDWTDDIKVELEKNPVNRKNIEKMYEKMYATLGDPQAPGLGAFRRRCIQGFGKEFDKHFGRGGSKLPGMKSREFSDITNSLFSKMCEVSKPPGNLKECSPWMSDFKVEFLRSELEIPGQYDGKGKPVPEYHARIAGFDERIKVMASMRKPKRIIIRGHDEREYPFLVKGGEDLRQDQRIEQLFEVMNVILSQDATCSQRSMQLKTYQVIPMTSRLGLIEWIENTFTLKELLLSNMSQEEKAACTRDPKAPPFEYRDWLTKMSGKCDVGAYMLMYKGASRTETVTSFRKRESKVPADLLKRAFVKMSTSPEAFLTLRSHFAGSHALICISHWIPGIGDRHLNNFLVSMETGGVIGIDFGHAFGSATQFLPVPELMPFRLTRQFINLMLPMKETGVMYSIMVHALRAFRSQSNLLANTMDVFVKEPSFDWKNFEQKMRKKGGSWIQEINVTEKNWYPRQKIHYAKRKLAGANPAVITCDELLLGHEKAAAFGDYVAVARGSEDHNIRAQELESDLSEEAQVKCLIDQATDPNILGRTLVGWEPWM

SEQ ID NO: 12668 - protein, 522 aa, Drosophila melanogaster
MATTTTTTTTTGATNAKDGVTMREKKGGALQKLKKRLSHSFGRLTISREDGDESTHHHHHHHHHRGGHGGHHNHGNKVPYNGYNSEEYLDRLEPNGNIPADKTNCRYGAQESAKNDNNKPQDWRSTDSTDHHDRVQRQLSVSSDSKLLDEDIREEMKYHSHVVMRPKKPPRPKSEVFLNKQETHPRRKRFSAFGGDSPFGKQEAYVKLEPLGEGSYATVYKGFSKLTYQRVALKEIRLQEEEGAPFTAIREASLLKELKHSNIVTLHDIVHTRETLTFVFEYVNTDLSQYMEKHPGGLDHRNVRLFLFQLLRGLSYCHKRRVLHRDVKPQNLLISDCGELKLADFGLARAKSVPSHTYSHEVVTLWYRPPDVLLGSTEYSTSLDMWGVGCIFVEMVTGMPTFPGIRDTYDQLDKIFKLLGTPTEDTWPGVTHFPGYKPHKLGFYRPRKLGHNFPRLYDIIEGETIANGFLQLNPEQRLGADDALQHPYFAQLPKKLYELPDETSIFTVEGVQLYTEPNRQNK

SEQ ID NO: 12669 - protein, 685 aa, Rhizobium etli
MATKVKENEDAEVERDGATDGPLLDLSDDAVKKMIKAAKKRGYVTMDELNAVLPSEEVTSEQIEDTMSMLSDMGINVIEDEEAEEAGASGGGDDDDAGGDEDSEGGELAPSAGTALATAKKKEPTDRTDDPVRMYLREMGSVELLSREGEIAIAKRIEAGRETMIAGLCESPLTFQALIIWRDELNEGTTLLREIIDLETTYSGPEAKAAPQFQSPEKIEADRKAAEEKEKTRRARSGDDDITDVGGEGLPPEEEEEDEDESNLSLAAMEAELRPQVMETLDIIAETYKKLRKLQDQQVEQRLAATGTLSSAQERRYKELKDELIKAVKSLSLNQNRIDALVEQLYDINKRLVQNEGRLLRLAESYAVKRDSFLEQDQGAELDPNWMKSIGNLAARGWKEFAKAENTTIRDIRQEIQNLATETGISISEFRRIVHMVQKGEREARIAKKEMVEANLRLVISIAKKYTNRGLQFLDLIQEGNIGLMKAVDKFEYRRGYKFSTYATWWIRQAITRSIADQARTIRIPVHMIETINKIVRTSRQMLHEIGREPTPEELAEKLAMPLEKVRKVLKIAKEPISLETPVGDEEDSHLGDFIEDKNALLPIDAAIQANLRETTTRVLASLTPREERVLRMRFGIGMNTDHTLEEVGQQFSVTRERIRQIEAKALRKLKHPSRSRKLRSFLDS

SEQ ID NO: 12670 - protein, 376 aa, Microcystis aeruginosa
MKISKLAADDNFNQIIALETNPLELDSVDFGERTDEDLTESLPETLKNTRGSSGTGYDKGSNEDTVGAFFKEMARYPLLSAEEEIELAYSVKFLMEAEEVRQKLQENLHRPPTKTEWAIALELDNERQLENRLYRGRTAKRKMIRSNLRLVVSIAKRYLNRGVPFLDLIQEGAIGLNRAAEKFDPNKGYKFSTYAYWWIRQAITRTIANDARTIRLPIHIVEKLNKLKKAQILKQDLQRNPNERELAERLEITPEQLRQLLQLRRQSLSLNHRVGKGEDTELVDLLEDDDLQLPEDKMNEMMMRQEIFAVLSDVLTEREKDVISLRYGLATSQPYTLEEVGGMFNLSRERVRQIQTKAMRKLRRPQVARRLKGWLH

SEQ ID NO: 12671 - protein, 112 aa, Azorhizobium caulinodans
MKKIEAIIKPFKLDEVKEALQEVGLQGITVTEAKGFGRQKGHTELYRGAEYVVDFLPKVKIEVVLADDMVEKAVEALLRAAQTGRIGDGKIFVSSIEEAIRIRTGETGLDAI

SEQ ID NO: 12672 - protein, 87 aa, Saccharomyces cerevisiae
DLYIPKSSRHSSIDGAYFGTSFPGMFLQAFPDMVPKHPTKRYVPKIFGFELHKQAQLTRWQELQRLKLVEKLESKDVDLTKSGGFKT

SEQ ID NO: 12673 - protein, 365 aa, Synechococcus sp.
MFDTTTTNSLDPVYAQDSHQATELESSNSMVEAEFSETELTNLRGVRSRNEDTVGAFFKEMARYPLLKPDEEIQLAHSVKFLNDAEERRLELQEQLGRSPTNEEWASVLGLETVKQLNSALYKGRVAKRKMIRSNLRLVVSIAKRYLNRGVPFLDLIQEGAIGLNRAAEKFDPNKGYKFSTYAYWWIRQAITRTIANDARTIRLPIHIVEKLNKLKKAQRTLKQTLQRNPTEAELAQELDITADQLHQLLQLRRQSLSLNHRVGKGEDTELVDLLEDDGLQLPEERMSEAMMRQELWDVLGDVLTDREKEVIALRYGLSSEQPHTLEEVGGMFNLSRERVRQIQSKAMRKLRRPQVARRLKSWLY

SEQ ID NO: 12674 - protein, 317 aa, Synechococcus sp.
MKTAKYSADPVRTYLKEIGRVPLLTHEEEVLYSRRVQKMVNLEKLKAELAEKQDQEPSLKEWAQAANLSQRQLKKQLLLGKQAKQKMVEANLRLVVSVAKKYIKRNMDLLDLIQEGTIGMQRGVEKFDPTKGYRFSTYAYWWIRQAITRAIAEQSRTIRLPIHITEKLNKIKKAQRQLAQANGRSASIPELADELGLTTKQVRDYLEKSRQPLSLDLRVGDNNDTELIELEDDGELPDDYATHAALKRDLARMLNDLTAQQQEVLTLRFGLRDGTPHTLAKIGEHLNISRERVRQIEHGSLAKLRKQKRKLGEYLAS

SEQ ID NO: 12675 - protein, 422 aa, Linum usitatissimum [sequence omitted]

SEQ ID NO: 12676 - protein, 158 aa, Escherichia coli
MHCHSAFSFSNFLTSCSLSRFSFLAHRLQYLLRVAEPLPNSDRRGSMKLVTVIIKPFKLEDVREALSSIGIQGLTVTEVKGFGRQKGHAELYRGAEYSVNFLPKVKIDVAIADDQLDEVIDIVSKAAYTGKIGDGKIFVAELQRVIRIRTGEADEAAL

SEQ ID NO: 12677 - protein, 116 aa, Homo sapiens
LSCYRDHQFSGRKFQQEKLLKESSTLNMGNLSFYTTEEKIHELFSRSDIRNIFMGLDKIKKTACGFCFVECHNRADAENAMRFLTGTCLDEWIICTDWDVGFREGQQYGRGKSGGQ

SEQ ID NO: 12678 - protein, 457 aa, Vibrio cholerae non-O1
MHRYKKEASNLIKLATPVLIASVAQTGMGFVDTIMAGGVSAIDMAAVSIAASIWLPSILFGVGLLMALVPVVAQLNGAGRQHKIPFEVHQGLILALLVSIPIIAVLFQTQFIIRFMDVEEAMATKTVGYMHAVIFAVPAYLLFQALRSFTDGMSLTKPAMVIGFIGLLLNIPLNWIFVYGKFGAPELGGVGCGVATAIVYWIMLLLLLFYIVTSKRLAHVKVFETFHKPQPKELIRLFRLGFPVAAALFFEVTLFAVVALLVAPLGSTVVAAHQVALNFSSLVFMFPMSIGAAVSIRVGHKLGEQDTKGAAIAANVGLMTGLATACITALLTVLFREQIALLYTENQVVVALAMQLLLFAAIYQCMDAVQVVAAGSLRGYKDMTAIFHRTFISYWVLGLPTGYILGMTNWLTEQPLGAKGFWLGFIIGLSAAALMLGQRLYWLQKQSDDVQLHLAAK

SEQ ID NO: 12679 - protein, 307 aa, Drosophila melanogaster
MGDEGGGGGHGKGDLKSFLMDFMMGGVSAAIAKTAVAPIERVKLILQVQEVSKQIAADQRYKGIVDCFIRIPKEQGFSSFWRGNLANVIRYFPTQALNFAFKDVYKSVFLGGVDKHKQFWRHFAGNLASGGAAGATSLCFVYPLDFARTRLAADVGKGGNREFNGLIDCLMKVIKSDGPIGLYRGFIVSVQGIVIYRAAYFGFYDTCRDFLPNPKSTPFYVSWAIAQVVTTVAGIASYPFDTVRRRMMMQSGLKKSEMVYKNTAHCWLVIAKQEGIGAFFKGALSNIIRGTGGALVLALYDEMKKYF

SEQ ID NO: 12680 - protein, 481 aa, Drosophila melanogaster
MAFLCAPGLTFFLTYSIFSAVLGMLQFGYNTGVINAPEKNIENFMKDVYKDRYGEDISEEFIQQLYSVAVSIFAIGGMLGGFSGGWMANRFGRKGGLLLNNVLGIAGACLMGFTKVSHSYEMLFLGRFIIGVNCGLNTSLVPMYISEIAPLNLRGGLGTVNQLAVTVGLLLSQVLGIEQILGTNEGWPILLGLAICPAILQLILLPVCPESPRYLLITKQWEEEARKALRRLRASGSVEEDIEEMRAEERAQQSESHISTMELICSPTLRPPLIIGIVMQLSQQFSGINAVFYYSTSLFMSSGLTEESAKFATIGIGAIMVVMTLVSIPLMDRTGRRTLHLYGLGGMFIFSIFITISFLIKEMIDWMSYLSVVATLGFVVFFAVGPGSIPWMITAELFSQGPRPSAMAIAVLVNWMANFVVGIGFPSMKTALENYTFLPFSVFLAIFWIFTYKKVPETKNKTFEEILALFRHNNGRYVSLH

SEQ ID NO: 12681 - protein, 399 aa, Drosophila melanogaster
MKLRLLRCLRQQPAKPAAVMTHKEDQYPVSLDHHVLKDMAKGVRDTTVKILLLGTAESGKTTIIKQMRILHINGFTDDERREKIPEIYQNIHESILQLVGQMGVLGIDFGSCTSERSADYILSLPGSAPEYMNEEYCDHVTTLWNDVGIRACYDRSNEFPLLDSAKYFLDNFVRISDAEYIPSTEDILHSRKITTGISQITFRVPIPKSMGGGEQQFQMYDVGGQRDQRNKWIQVFEGIQAVLFLISCSEFDQNLREDPSQNRLQEALKLFRAVWQNRFLASAGLIVFLNKYDIMERKIRAGKHIVDYFPEYEDFCKRPQQDNCFGESDWTKMFIKQKLVDITQEPFKRHSRNQVDLGTSERECYYHFTVATDTRCIRDVFCDVQKMILSENVSSMGLF

SEQ ID NO: 12682 - protein, 154 aa, Drosophila melanogaster
MFASVELSSYRDQHFKGSRSEQERSLRDSCTLYVGNLSFYTTEEQIHELFSRCGDVRVIVMGLDKYKKTPCGFCFVEYYVRSEAEAAMRFVNGTRLDDRLIRVDWDAGFVEGRQYGRGKTGGQVRDEYRTDYDAGRGGYGKLLSQKIAPNTDNR

SEQ ID NO: 12683 - protein, 141 aa, Drosophila melanogaster
MAGGKAGKDSGKAKAKAVSRSARAGLQFPVGRIHRHLKSRTTSHGRVGATAAVYSAAILEYLTAEVLELAGNASKDLKVKRITPRHLQLAIRGDEELDSLIKATIAGGGVIPHIHKSLIGKKEETVQDPQRKGNVILSQAY

SEQ ID NO: 12684 - protein, 496 aa, Nicotiana tabacum
MVLSKTASESDVSIHSTFASRYVRTSLPRFKMPENSIPKEAAYQIINDELMLDGNPRLNLASFVTTWMEPECNKLMMDSINKNYVDMDEYPVTTELQNRCVNMIAHLFNAPLGDGETAVGVGTVGSSEAIMLAGLAFKRKWQNKMKAQGKPCDKPNIVTGANVQVCWEKFARYFEVELKEVKLSDGYYVMDPEKAVEMVDENTICVAAILGSTLNGEFEDVKRLNDLLIEKNKETGWDTPIHVDAASGEFIAPFLYPELEWDFRLPLVKSINVSGHKYGLVYAGIGWAIWRNKEDLPDELIFHINYLGADQPTFTLNFSKGSSQVIAQYYQLIRLGFEGYKNVMENCQENARVLREGLEKSGRFNIISKEIGVPLVAFSLKDNSQHNEFEISETLRRFGWIIPAYTMPPNAQHVTVLRVVIREDFSRTLAERLVIDIEKVLHELDTLPARVNAKLAVAEANGSGVHKKTDREVQLEITTAWKKFVADKKKKTNGVC

SEQ ID NO: 12685 - protein, 545 aa, Beta vulgaris
MSEGTNKAMSDPPPTTASKVIADFDPLKKPPKRNKFAFACATLASMTSVLLGYDIGVMSGAIIYLKEDWHISDTQIGVLVGILNIYCLFGSFAAGRTSDWIGRRYTIVLAGAIFFVGALLMGFATNYAFLMVGRFVTGIGVGYALMIAPVYTAEVSPASSRGFLTSFPEVFINAGILLGYISNLAFSSLPTHLSWRFMLGIGAIPSIFLAIGVLAMPESPRWLVMQGRLGDAKKVLNRISDSPEEAQLRLSEIKQTAGIPAECDEDIYKVEKTKIKSGNAVWKELFFNPTPAVRRAVIAGIGIHFFQQASGIDAVVLYSPRIFQSAGITNARKQLLATVAVGVVKTLFILVATFQLDKYGRRPLLLTSVGGMIIAILTLAMSLTVIDHSHHKITWAIALCITMVCAVVASFSIGLGPITWVYSSEVFPLRLRAQGTSMGVAVNRVVSGVISIFFLPLSHKITTGGAFFLFGGIAIIAWFFFLTFLPETRGRTLENMHELFEDFRWRESFPGNKSNNDENSTRKQSNGNDKSQVQLGETTTSSVQV

SEQ ID NO: 12686 - protein, 375 aa, Homo sapiens [sequence omitted]

SEQ ID NO: 12687 - protein, 392 aa, Homo sapiens [sequence omitted]

SEQ ID NO: 12688 - protein, 119 aa, Trypanosoma cruzi
GGRSAKAGLIFPVGRVGSLLRRGQYARRIGASGAVYMAAVLEYLTAELLELSVKAASQQAKKPKRLTPRTVTLAVRHDDDLGMLLKDVTLSRGGVMPSLNKALAEKHKSSKKARATPSA

SEQ ID NO: 12689 - protein, 403 aa, Homo sapiens
PGARALDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 12690 - protein, 261 aa, Macaca mulatta
MASQLQNRLRSALALVTGAGSGIGRAVSVRLAGEGATVAACDLDGAAAQETVQLLGGPGNKEGPPRGNHAAFQADVSEARAARRLLEQVQACFSRPPSVVVSCAGITQDEFLLHMSEDDWDKVIAVNLKGTFLVTQAAAQALVSSGCRGSIINISSITGKVGNMGQTNYVASKAGVIGLTQTAARELGRHGIRCNSVLPGFIATPMTQKVPQKVVDKITEMIPMGYLGDPEDVADVVAFLASEDSGYITGASVEVTGGLFM

SEQ ID NO: 12691 - protein, 432 aa, Homo sapiens
MSDKLPYKVADIGLAAWGRKALDIAENEMPGLMRMRERYSASKPLKGARIAGCLHMTVETAVLIETLVTLGAEVQWSSCNIFSTQNHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRHFEQMKDDAIVCNIGHFDVEIDVKWLNENAVEKVNIKPQVDRYRLKNGRRIILLAEGRLVNLGCAMGHPSFVMSNSFTNQVMAQIELWTHPDKYPVGVHFLPKKLDEAVAEAHLGKLNVKLTKLTEKQAQYLGMSCDGPFKPDHYRY

SEQ ID NO: 12692 - protein, 316 aa, Homo sapiens [sequence omitted]

SEQ ID NO: 12693 - protein, 176 aa, Petunia x hybrida
MVALSTKREREEDNFYSITTMANYLMLLSRQANEHFDKKMNNSSTSRVFECKTCNRQFSSFQALGGHRASHKKPRLMGELHNLQLFHELPKRKTHECSICGLEFAIGQALGGHMRRHRAVINDKNLQAPDDQHAPVVKKANGRRILSLDLNLTPLENDLEFDLRKSNTAPMVDCFL

SEQ ID NO: 12694 - protein, 455 aa, Drosophila melanogaster
MDLDRAWDIYYHVFQKISRQLPQLTSLELPYVSPKLMTCKDLELAVPGSYNPGQELIRISIIKTNLQVITSKQRPRKLCIRGSNGKDYMYLLKGHEDLRQDERVMQLFSLVNTLLLDDPDTFRRNLAIQRYAVIPLSTNSGLIGWVPHCDTLHTLIRDYRDKKKVPLNQEHRTMLNFAPDYDHLTLMQKVEVFEHALGQTQGDDLAKLLWLKSPSSELWFERRNNYTRSLAVMSMVGYILGLGDRHPSNLMLDRMSGKILHIDFGDCFEVAMTREKFPEKIPFRLTRMLIKAMEVTGIEGTYRRTCESVMLVLRRNKDSLMAVLEAFVYDPLLNWRLLDVDKKGNDAVAGAGAPGGRGGSGMQDSLSNSVEDSLPMAKSKPYDPTLQQGGLHNNVADETNSKASQVIKRVKCKLTGTDFQTEKSVNEQSQVELLIQQATNNENLCQCYIGWCPFW

SEQ ID NO: 12695 - protein, 520 aa, Drosophila melanogaster
MPSGIRPIDVLLERAGVRGHQRAPSDSKEFHEVTKRDALRLLEHDVDRLLETTEKARQPALKAEMGRFADLFGRFIQEEGPALDWNKIQKLPENAVMNYSNLKSPKNEQNEIRNMLDKLVVIKLNGGLGTSMGCHGPKSVIPVRSDLTFLDLTVQQIEHLNKTYDANVPLVLMNSFNTDEDTEKIVRKYKGFRVQIHTFNQSCFPRISREHYLPVAKDFDVEKDMEAWYPPGHGDFYDTFRNSGLLKKFIEEGREYCFLSNIDNLGATVDLNILNKLVGEERATTPVEFVMEVTDKTRADVKGGTLIQMENKLRLLEIAQVPPEHVDDFKSVKTFKFFNTNNIWANLAAIDRVLRERTLNMEIIVNNKTLENGTRVIQLETAVGAAMKCFDGAIGINVPRSRFLPVKKSSDLLLVMSNLYTLKNGSLVMSPQRMFPTTPLVKLGENHFSKVKEFLGRFANIPDIIELDHLTVSGDVTFGRGVSLRGTVIIIANHGDRIDIPAGAILENKIVSGNMRILDH

SEQ ID NO: 12696 - protein, 352 aa, Drosophila melanogaster
MCFIIMVIYMIYKCIREQRRLRRHRLPKSMLKKLPVLRYTKNNANNKYDTCVICLEDFIEDDKLRVLPCSHPYHTHCIDPWLTENRRVCPICKRKVFTKGEARASRSRQPSLDNVTDTDDDTTPLLQQQQSNGRQVGQVSSASSAGGAAGSSSSVAAAAVAGTTRHGTFRRGHAGRNPFEESQSSDDENALLASTVRPATSSGAHERINPFDRAPNLPAHLAEQLTESRRSVWSRINFASFFRRQPAVISVAAPPYLERVESGTSAMGLPVTGTIAVASPASNNILNPNLSGSFKDEDDMPPHRSIYEPIAISTPAADSATVDDSAFLQTPTQGGIGVAALPHSASDRQFLI

SEQ ID NO: 12697 - protein, 649 aa, Drosophila melanogaster
MRVWVAYSAAALLLLVHAGPESISGQEVPQSKTSSNTTTTDNSSSIHTVSDVFVNSPLGNVTPSISASGNASTTKRGNASTLVTDPPLIDSHAVEQEHNSSLSLFFVICVIMLGILLIHSMLQTGFQYLPESIVVVFLGAFIGLSLNVMSGQNGSWKREEVFSPMGFFLVLLPPIIFESGYNLHKGNFFQNIGSILVFAIFGTTISALVIGAGIYLLGLGEVAFRLSFSESFAFGSLISAVDPVATVAIFHALDVDPILNMLVFGESILNDAISIVLTASITQSANVNAEASTGEAMFSALKTFCAMFFASAGIGVIFALISALLLKHIDLRKHPSLEFAMMLMFTYAPYVLAEGIHLSGIMAILFCGIVMSHYTHFNLSTVTQITMQQTMRTLAFIAETCVFAYLGLAIFSFKHQVELSFVIWAIVLCLIGRACNIFPLAFLVNKFREHKINNKMQFIMWFSGLRGAISYALSLHLNLDSQEKRHVIITTTLIIVLFTTLVLGGSTMPVLKYLKPGKKRRARGSGRNAAEEGGRRNGSGRKRSKSISLSKTREWGQAIDSEHLSELTEEEDVTFTQARDRFGRMDRKYFIPFFTRRFNSQELHECNSQMADLTNKWYQAIRVSPLDSDESDEEIGLAASTSQIHLTRS

SEQ ID NO: 12698 - protein, 681 aa, Drosophila melanogaster
MVKVQKPQPKSLNKSASIEGVVNKKGKPEKTKKLATDATLELASNKKAKNAAPVKKDAIKKEPEVSKKGAEKKQSKAAKRPLILAPPESPAAPAPAAKKSKAKPAASGAPVGKKIEAKKPLILAPPESPVPPKKQEKKTKAAPVKAKKEPAPAKKSVQDPVPSIKKVPAAKKSGQTAALTKKTAKTEKQAAPAKPAKAQPASQLQKKAKAVQKLSKPASPPKSKKALSKSKPGQAKGNAVNKEPAKSKKPVELTFELKAFDEKRFHEIVNENNVTKVCAALKSVVSEEVEKKKNTSIFSDYRYVLQVCSYKIPSCPKRMVKLNLKHSLVGKDDDVALIVPDLQRGAKFDYDPTKQHYEDMLREAGVKQRLTVVPFNQLRNEMGSFEAKRKFLNSYDYLLCDGRLSGQATAFLGKNTQKPRNVLHSLRLSKDNDKLPQEVTRALTRTAFRQLSKGDLIAVPVGNHEITAEQLAENILLVIKQLQEVYPGGLANIRSMYLKIDITGTSALPLYVSMCAPPEDVPYVVGPREQRMLKLKKQANEVLSKFAMTKDAEFIKLTSDQVKRKAQLRKEKAALLAADAAPKDNDGGDAAVPAKKARKESSSEGAKADAESDEEEEVEEAEDSAGESGDEDEEGHDGDDTDEDEDEDDDDDNEDGDDDEDEDDDEEDDDEEDDDDDDDEE

SEQ ID NO: 12699 - protein, 376 aa, Drosophila melanogaster
MLVQLVAQLRTDLQLPKCLQIVGYLRRMQAFGDNELRLKFLQARDAWLTSCLEAIPTADAQQHLSKTIEITRINLFNIITQYRAIFPEDEGTLKTQSSLRPLQGVSCNGDRLFQAWLHNKISDFLQTLERDLQLGVGSVETVLGQCMYFGLSFSRVGADFRALMAPIFVGVIRRRFENSVEQVDEQFERELERFTLINKVALHSHARKQVDPEQESYAPPEALLDFYPLAALCNGYLSALNELRLCAPLALATDVTRCLQHSLQQAAQRVLAFYRQEQQAFAGSEREAFVRLCSCLAYDLVPYIQRCIHGVFPPQSLTVHLGISLLQLEQQQLTYLQQTRILEPLKHLLPTKALVQPQDKVMEAKPSAGVPVTAEG

SEQ ID NO: 12700 - protein, 226 aa, Davidia involucrata
SLPNNATFFLTYVALKFFVGYGLELSRIVPLIIYHLKRKYLCKTQAELKEAWSPGDLGYATRFPGDMLIITIVLCYSVIAPIIVPFGVLYFGLGWLVLRNQVLKVYVPSYESYGRMWPHMHTRILAALLLYQVTMFGYFGVKKFYYVPILIPLPILSLIFAFVCKKKFYHFFQATALEVACREMKETPNMELVFRSFIPPSLSAEKSDDDQFEDAKSQVSRAASFV

SEQ ID NO: 12701 - protein, 85 aa, Drosophila melanogaster
MKVTIKSWTGVATWRWIANDENCGICRMSFESTCPECALPGDDCPLVWGVCSHCFHMHCIVKWLNLQPLNKQCPMCRQSWKFNVH

SEQ ID NO: 12702 - protein, 336 aa, Drosophila melanogaster
MTLPSAARVYTDVNAHKPDEYWDYENYVVDWGNQDDYQLVRKLGRGKYSEVFEAINITTTEKCVVKILKPVKKKKIKREIKILENLRGGTNIITLLAVVKDPVSRTPALIFEHVNNTDFKQLYQTLTDYEIRYYLFELLKALDYCHSMGIMHRDVKPHNVMIDHENRKLRLIDWGLAEFYHPGQEYNVRVASRYFKGPELLVDYQMYDYSLDMWSLGCMLASMIFRKEPFFHGHDNYDQLVRIAKVLGTEELYAYLDKYNIDLDPRFHDILQRHSRKRWERFVHSDNQHLVSPEALDFLDKLLRYDHVDRLTAREAMAHPYFLPIVNGQMNPNNQQ

SEQ ID NO: 12703 - protein, 815 aa, Homo sapiens [sequence omitted]

SEQ ID NO: 12704 - protein, 498 aa, Triticum aestivum
MDTITVVENVFGEVERKVQKSYWEEHSKDLTVESMMLDSRAKDLDKEERPEVLAILPSYAGKTVLELGAGIGRFTGELAKEAGHVIALDFIDSVIKKNEEINGDIYKNITFMCADVTSPELKIEDNSVDIVFSNWLLMYLNDEEVEKLIGRIVKWLKPGGHIFIRESCFHQSGDSKRKVNPTHYREPRFYTKVFKECHSYDQEGNSFELSLVTSKCIGAYVKSKKNQNQICWLWEKVKCTEDKGFQRFLDNVQYKSTGILRYERVFGEGYVSTGGFETTKEFVDKLDLKAGQKVLDVGCGIGGGDFYMAETYDVHVLGIDLSINMVSFAIERAIGRSCSVEFEVADCTTKEYAENTFDVIYSRDTILHIQDKPALFRNFFKWLKPGGKVLISDYCRSPGTPSEEFAAYIKQRGYDLHDVKTYGKMLEDAGFHDVVAEDRTDQFLRVLERELGETEKNKEAFLADFTQEDYDDIVNGWSAKLKRSSAGEQKWGLFIATK

SEQ ID NO: 12705 - protein, 321 aa, Candida boidinii
MSSPLLTLNNGLKMPQIGFGCWKVDNATCAETIYEAIKVGYRLFDGAMDYGNEKEVGEGVNKAIKDGLVKREELFIVSKLWNNFHHPDSVKLAIKKVLSDLNLEYIDLFYMHFPIAQKFVPIEKKYPPNFYCGDGNKWSFEDVPLLTTWRAMEELVEEGLVKSIGISNFVGALIQDLLRGCKIRPAVLEIEHHPYLVQPRLIEYAKTEGIHVTAYSSFGPQSFVELDHPKVKDCTTLFKHETITSIASAHDVPPAKVLLTWATQRGLAVIPKSNKKERLLGNLKINDFDLTEAELEKIEALDIGLRFNDPWTWGYNIPTFI

SEQ ID NO: 12706 - protein, 87 aa, Oryza sativa
IKEYRGKIEAELSKICDGILKLLDSHLVPSSTAAESKVFYLKMKGDYHRYLAEFKTGAERKEAAESTMVAYKAAQDIALADLAPTHP

SEQ ID NO: 12707 - protein, 199 aa, Nannochloropsis gaditana
AGGIAEMSQQPEFVRESTDRLDAAGNVTKAITKGYSIGSASLACFLLFGAFMDEFSQFSGKPFRVVDIAVPEVLIGGIIGTMMVFYFVGLTVAAVGKTAGEVVKEVRRQFRDNPEIMTFKARPDYRSCVALVTHAALKEMVWPGLLATGLPIVVGVVFRGVGAITDRSLLGAEVPGRGYLMFGTVTGDTCMAATTRTMS

SEQ ID NO: 12708 - protein, 347 aa, Comamonas testosteroni
MFIRNCWYVAAWDTEIPAEGLFHRTLLNEPVLLYRDTQGRVVALENRCCHRSAPLHIGRQEGDCVRCLYHGLKFNPSGACVEIPGQEQIPPKTCIKSYPVVERNRLVWIWMGDPARANPDDIVDYFWHDSPEWRMKPGYIHYQANYKLIVDNLLDFTHLAWVHPTTLGTDSAASLKPVIERDTTGTGKLTITRWYLNDDMSNLHKGVAKFEGKADRWQIYQWSPPALLRMDTGSAPTGTGAPEGRRVPEAVQFRHTSIQTPETETTSHYWFCQARNFDLDDEALTEKIYQGVVVAFEEDRTMIEAHEKILSQVPDRPMVPIAADAGLNQGRWLLDRLLKAENGGTAP

SEQ ID NO: 12709 - protein, 252 aa, Comamonas testosteroni
MNLNKQVAIVTGGASGFGAAIARRLSQAGAAVLVADLNAEGAQRMATELNAAGGRALGMACDVSKEADYRAVVDAAIAQLGGLHIVVNNAGTTHRNKPALAVTEDEFDRVYRVNLKSVYWSAQCALPHFAQQGHGVMVNVASTTGVRPGPGLTWYSGSKAAMINLTKGLALEFARSGVRINAVNPMIGETPMMADFMGMEDTPANRERFLSRIPLGRFTRPDDVASAVAFLASDDASFLTGVCLDVDGGRNI

SEQ ID NO: 12710 - protein, 476 aa, Comamonas testosteroni
MSTVLYRCPELLIGGEWRPGRHEQRLVVRNPATGEPLDELRLASADDLQLALQTTQQAFEHWRQVPAHERCARLERGVARLRENTERIAHLLTLEQGKTLAEARMECAMAADLIKWYAEEARRVYGRVIPARLPNSRMEVFKFPVGPVAAFSPWNFPLVLSARKLGGAIAAGCSIVLKAAEETPASVAAMVDCLNQELPPGVVQLLYGVPAEVSQALIASPVVRKVTFTGSVPVGRHLAELSARHLKRITLELGGHAPVIVCGDADIARTVNLMVQHKFRNAGQACLAPTRFFVDRRIYGDFVDAFGATQALRVGAGMAAETQMGPVASARRQAAVQDLIARSVAAGARPVASAVPEAGYFVAPTLLADVPLDAPVMSEEPFGPVACAVPFDSLDQAIAQANHNPYGLAGYLFTDSAKAILAVSERLEVGSLAVNGMGVSVPEAPFGGVKDSGYGSESGTEGMEAFLDTKFMHYVA

SEQ ID NO: 12711 - protein, 178 aa, Aegilops tauschii
GKVYKGVLSGSTPIAVKRLDGARQGEKQFRAEVSSLGLIQHINLVKLIGFCCEGHNRLLVYEHMLNGSLDGHLFKKINDVAHVLNWNTRYQVALGVAKGLSYLHQSCHKCIIHCDIKPGNILLDASFAPKVADFGLAAFVGRDFSRVLTTIRGTAGYLAPEWLNGVAITPKIDVYTFG

SEQ ID NO: 12712 - protein, 176 aa, Aegilops tauschii
FGKVYKGVLSGSTPIAVKRLDGARQGEKQFRAEVSSLGLIQHINLVKLIGFCCEGHNRLLVYEHMLNGSLDGHLFKSNFGVLSWSTRYQIALGVARGLFYLHQSCHKCIIHCDIKPENILLDASFAPKVADFGLATFLGRNFSRILTTFRGTVGYLAPEWLSGVAVTPKIDVYSFG

SEQ ID NO: 12713 - protein, 197 aa, Brassica napus
MGRKKLEIKRIENKSSRQVTFSKRRNGLIEKARQLSVLCDASVALLVVSASGKLYSFSSGDNLVKILDRYGKQHDDDLKALDRQSKALDCGSHHELLELVESKLEESNVDNVSVGSLVQLEEHLENALSVTRARKTELMLKLVENLKEKEKLLEEENHVLASQMEKSNLVRAEADNMDVSPGQISDINLPVTLPLLN

SEQ ID NO: 12714 - protein, 196 aa, Brassica napus
MGRKKLEIKRIENKSSRQVTFSKRRNGLIEKARQLSVLCDASVALLVVSASGKLYNFSAGDNLVKILDRYGKQHADDLKALDLQSKAPKYGSHHELLELVESKLVESNSDVSVDSLVQLEDHLETALSVTRARKTELMLKLVDSLKEKEKLLKEENQGLASQMEKNNLAGAEADKMEMSPGQISDINRPVTLRLLY

SEQ ID NO: 12715 - protein, 197 aa, Brassica napus
MGRKKLEIKRIENKSSRQVTFSKRRSGLIEKARQLSVLCDASVALLVVSSSGKLYSFSAGDNLVRILDRYGKQHADDLKALNLQSKALSYGSHNELLELVDSKLVESNVGGVSVDTLVQLEGVLENALSLTRARKTELMLKLVDSLKEKEKLLKEENQALAGQKEKKNLAGAEADNMEMSPGQISDINLPVTLPLLN

SEQ ID NO: 12716 - protein, 196 aa, Brassica napus
MGRKKLEIKRIENKSSRQVTFSKRRNGLIEKARQLSVLCDASVALLVVSASGKLYNFSAGDDLVKIVDRYGKQHADDRKALDLQSEAPKYGSHHELLELVESKLVESNSDVSVDSLVQLENHLETALSVTRARKTELLLKLVDSLKEKEKLLKEENQGLASQMEKNNLAGAEADKMEVSPGQISDINCPVTLPLLY

SEQ ID NO: 12717 - protein, 196 aa, Brassica napus
MGRKKLEIKRIEKNSSRQVTFCKRRNGLIEKARQLSVLCEASVGLLVVSASDKLYSFSSGDRLEKILDRYGKKHADDLNALDLQSKSLNYSSHHELLELVESKLVESIDDVSVDSLVELEDHLETALSVTRARKAELMLKLVESLKEKENLLKEENQVLASQIEKKNLEGAEADNIEMSSGQISDINLPVTLPLLN

SEQ ID NO: 12718 - protein, 330 aa, Agrobacterium tumefaciens str. C58 (U. Washington)
MTKFDVLTVGNAIVDIISRCDDRFLNDNAITKGAMNLIDAERAELLYSLMGPALEASGGSAGNTAAGVANFGGKAAYFGKVAEDQLGEIFQHDIRAQGVYFETKPEGTFPPTARSMIFVTEDGERSMNTYLGACVDLGPEDVEDDVVAKTKVTYFEGYLWDPPRAKDAIRECARIAHENGREVSMTLSDSFCVGRYRDEFLDLMRSGTVDIVFANKQEALSLYETEDFELALTKIAADCKIAAVTMSEEGAVILRGTERVKVEAYPVHDVVDTTGAGDLFAAGFLFGYTQDRSLEDCGKLGCLAAAAVIQQVGPRPMSPLKALGEKHGLI

SEQ ID NO: 12719 - protein, 746 aa, Agrobacterium tumefaciens str. C58 (U. Washington)
MSELARLRQKVSDGLGLATPAADPADKTTRLANEEHASDVRAVALYVAISLSVGAFAAALIALAVPYAVTVVLACFFGAVLMGALFYALFGKSFPLPGTLPADYSDVRLRQTQNRSLIAEMQESMGDIVVIRNMNRRIVEANRVFREMTGCTSPEGLSCEEIGIAFRPGDRVHAYDVEIATPFGQRIFSWHDVVTRDLASSRLMISSIARDVTEERLALAEREDARLRAEKADAEKARLLATVSHEIRLPLSGMLGMNHLLSQTKLNQEQRNYLDGMKQSGQSLVQLVEDLLDYSTMEAGRFRLNPRAENLRRLIESIVEMLAHRAHEKGIEIASFVTPDVPDYLDFDPARLRQVLFNLIGNAVKFTQVGGVVIRARMVDGELQITVEDTGPGMSEAEQARIFGEFEQAGPLSQRSAGTGLGLAISARIVREFGGNLTVSSRRGEGSTFKLVFRPGRAPAEMPDSGRSHCLQHTNVLLIAPEGVAAAVTMEAIEAFGGKCILIHQPEDLDRLRNEPVSRTADLTDIIVDLRISALFRDALRDWPQQTIRRTLLVSPEERASTTHASFDAWLIRPLREKSLIDVLCGRLRGIERRDAINDNHPDVGFSSRVVERASGVEILVAEDDAVNARIIRAVLEKSGYIVRAVDNFQALQQSVASGASRLPNLIVSDLNMPGGEGLDVLPDLLGKLKDERNIPVIILSGDAGAGTAEILLKAGAGAVLAKPADPRRLVEEIRRLLEAKRVLSS

SEQ ID NO: 12720 - protein, 813 aa, Agrobacterium tumefaciens str. C58 (U. Washington)
MGFADVAALFNLDPDGKIRELLGRRDTWSGKTIYWPVEGTSLMVPIDLAALPTYTRAREFDGFRGFGIVRLADATEDPHATGLTFLNSEETEPAEVLPQQAVEDESHELLAFVDEDTETDDNPHPALPDEPAVDIDIAGDAADGVLTEEQLDDETSPEVESPIEAPAPEPSYSDKVVHLEDRRSRSREGLTAGEQAAFREIGRALAPSDMASEEKHEADAEGISAEPVVQDIQQDIAAETAKDASSDTGNDAETTEPVEEDDLFADYVRGEQPAPVRAPTDEPTSAEKQVVTTDEKPVADIAASMVSPPVRTPSALTAETLDQMPVALLVHAGDRLIHANPDFLRLTGYTSLTELEEVGGLEALLQRQELENMPDNEGGMVVVSAENDIIPVKARLQSIRWEETKALMLSLVPLEEKPAAVMAANENTAENAEAGSNLSLLQGEMEELHSILETATDGVVLLGDDGEIRSLNRSASALFNYDNGEIAGKPFVTLFAHESQRAVLDYLSGLANNGVASVLNDGREVIGREASGGFLPLFMTIGRLKSSHGYCAVIRDITQWKRTEEELRNAKRAAETANAHKTDFLARVSHEIRTPLNAIIGFSDMMATERFGPIGNPRYVEYANDIGRSGRHVLDIVNDLLDISKIEAGQMDVDFIAVPLNETVAEAVSLVQPQANNQRVIIRTALAQSVPQIVADLRSIKQIVLNILSNAIRFTPSGGQIVVSTAYEANGSVSLRIRDTGIGMTRAELEQAMKPFRQVASSGKRVRGDGTGLGLPLTKAMVDANRANFSITSTPNEGTLVEITFPSQRVLAN

SEQ ID NO: 12721 - protein, 473 aa, Agrobacterium tumefaciens str. C58 (U. Washington)
MPGQTNIATRIARDIDLNLPILSSAMDTVTEGRLAIAMAQAGGIGVIHRNLTPIEQAEEVRQVKKFESGMVVNPVTIGPDATLAEAQALMKAHGISGIPVVENGGAGGHKNGRLVGILTNRDVRFASDPQQKIYELMTRENLVTVKESSVDQQEARRLLHKHRIEKLLVVDGKGNCVGLITVKDIEKSQLNPNATKDAQGRLRAAAAISVGADAIERAERLIDAGVDLLVVDTAHGHSQRVLDAVAQVKKMSNSVRIIAGNVATADGTKALIDAGADAVKVGIGPGSICTTRIVAGVGVPQLAAVMAAVEAASLADIPVIADGGIKFSGDLAKAIAAGASAVMIGSLLAGTDESPGEVFLYQGRSFKAYRGMGSVGAMARGSADRYFQAEVRDTLKLVPEGIEGQVPYKGPVSGVLHQLAGGLKAAMGYVGGSNIKEFQERATFVRISSAGLRESHAHDVTITRESPNYPGAV

SEQ ID NO: 12722 - protein, 388 aa, Agrobacterium tumefaciens str. C58 (U. Washington)
MAEVSKNQVEKALETVIYPGSGKNIVALGMVSEIFIADAKAYFSITVPADKASEMEPLRLAAERAAKSVEGIAGAVVALTADRKPGQQQPAPAGPTPARPAAATGRPAAAPGRPTPQPGSSKVGVPGVRAIIAVASGKGGVGKSTTAVNLALGLQALGLKVGMLDADIYGPSLPRLLKISGRPKQQEDRIILPMENYGLKVMSMGFLVDEEAAMIWRGPMVQSALMQMLREVAWGELDVLVLDMPPGTGDAQLTIAQQVPLAGAVIVSTPQDLALLDARKGITMFRKVEVPLLGVIENMSYFIAPDTGARYDIFGHGGAKAEAERIGVPFLGEVPLTISIREMSDAGTPVVVAEPDGPQAAIYREIAEKVWARMGADERKAAPKIVFE

SEQ ID NO: 12723 - protein, 908 aa, Agrobacterium tumefaciens str. C58 (U. Washington)
MKKWVYTFGNGAAEGGAGDVAILGGKGANLAEMASLGLPVPPGLTIIADACALYHKNGRDLPEELKLQVMAGLHGMEIVTGKTFGGSHSPLLISVRSGARASMPGMMDTVLNLGLNDRTVEALGHDAGDARFAWDSYRRFIQMYGDVVMGLDHEMFEEILEDEKGRLGHEYDTDMSAVEWQHVVSLYKKLIEDELGEAFPQDCHVQLWGAIGAVFASWTNHRAVTYRHLHNIPGDWGTAVNVQAMVFGNLGSSSATGVAFTRNPSTGEAELYGEFLVNAQGEDVVAGIRTPQSITEAARLVSGSDKPSMEKLMPEAFSEFLAICKRLETHYRDMQDLEFTIERGKLWMLQTRSGKRTTRAAMKIAVDMVEAGLISQEEAVCRIEPSSLDQLLHPTIDPGISRPIIGSGLPASPGAATGEIVFTSEEAVAAEAEGRRVILVRIETSPEDIHGMHAAEGILTTRGGMTSHAAVVARGMGIPCVTGAGSMRVDMRNKVLIGVGCMLKRGDVITIDGSSGRVLKGEVPMTQPELSGDFGKLMQWADNLRRMTVRTNADTPADARAARAFGAEGIGLCRTEHMFFEGDRIHVMREMILAESEKGRRAALDQLLPMQRSDFTELFQIMHGLPVTIRLLDPPLHEFLPKSDGEIVEVAAAMGMPQTVFRQRLDALHEFNPMLGHRGCRLAISYPEIAEMQARAIFEAAVAAARITGAPVVPEIMVPLVGLRSELDYVKAVIDTVAAEVAEETGMSIEYLTGTMIELPRAALRAHVIAEAAEFFSFGTNDLTQTTFGISRDDAARFINTYQRKGIIERDPFISLDFDGVGELIRIAAERGRQTRPELKLGICGEHGGDPASIHFCEDADLDYVSCSPFRVPIARLAAAQATLAAKAKQGETPSNVAFIPVRGSVGR

SEQ ID NO: 12724 - protein, 275 aa, Agrobacterium tumefaciens str. C58 (U. Washington)
MYDVSANGANIPALGFGTFRIPEDDVRRILPEALKLGFRHVDTAQIYKNEGAVGEVIAQSGISRHDIFLTTKVWVDRYRHDDFLASVDESLAKLKTDYFDLLLLHWPKSDVPLAERMGALNAVRKAGKARNIGISNFNVALTEEAVKLSDTPLATNQIEYHPYLDQTKVISAARKHGMSVTAYYLMADGKVPNDPVLKDIGAKHGKTAAQVTLRWAVQQPDIVALSKTATESRLKENFDIFDFALSEEEMQAIHALAKPNGRIVSPGHLAPDWDD

SEQ ID NO: 12725 - protein, 510 aa, Agrobacterium tumefaciens str. C58 (U. Washington)
MREKAVALVDHAAGRWLARMEEDAERRAGTIARLRRLIAFSAVGLFIVPALFSLVFSPAIALPIGAAVVLALYLAAAALLIAFSRPAGGFSSPSAPSGDEDMIAAAQVPGLVLTLNENGLVERVSGRDRDSFPADLKASKGEIFAEYVYVSDRIELMQAFDLLRQGEDKATAELRFETGAKSRQTQFMHVRIEMTAIRGATGRLRRIVAQLSDVTEMERLRRDVARKAAEAESANDAKSRFLAAVSHELRTPLNAVLGFSDILAGEYFGRLENDRQREYVGLIRQSGAHLLSVVNTMLDMSKLEAGRYELLMESFPISETIASCEAMLGLQAKEKGLTLTSRIQRGIGEISADQRAIRQVLINLAGNAIKFTDAGGVVSIDAAREGGMLKLTVSDTGIGIASDKIELLGQPFMQVQNEYTRRYEGTGLGLSLVKGLVALHGGTFVITSKPAEGTVVTITLPADGSGMVGGGENAETECMVEFPPRIRQLGDMAAKMKKDGDDGPAKAKIA

SEQ ID NO: 12726 - protein, 430 aa, Agrobacterium tumefaciens str. C58 (U. Washington)
MQDKILLIEDSVALSMLLRTRLSDETEAEVVHCASMAEADALMQANNFTLALTGLNLPDAPKGEILTLLSERKVPAIVFTATVDEEARKRYAEKKIIDYIVKDGHRTVDAVVKTVDRIMTNKRFSVLVVDDARTARSGLVEILERQNFKVSEAHSGNRALEILSQDPSIQLVITDYHMPDMDGYELTRRIRDSRSSEDLRVIGISSSTDRLLSASFLKAGASDFVYRPFVPEELQCRIDNNIETLKQLKRLRELAERDHLTGLPNRRSFFERTRALMDVINDNDESGAVAILDIDHFKKINDTLGHDAGDRALKKLAELLQGMCDEQRHIPARLGGEEFAVFLRGLDARAAYAFCEELREQVEKNGRQLSGSSLALTISLGVVEIEKGEPFDNQLNAADQLLYLAKANGRNRVYSDIMIQEGLQKIGLNG

SEQ ID NO: 12727 - protein, 393 aa, Agrobacterium tumefaciens str. C58 (U. Washington)
MGRAAVPSGASTGAHEAVELRDGGKRYLGKGVEKAVEAVNTEIFDAIGGFDAENQIQIDQMMIALDGTPNKSRLGANAILGVSLAIAKAAAEASGLPLYRYVGGPNAHLLPVPMMNIINGGAHADNPIDFQEFMILPVGAENIREAVRMGSEVFHTLKKELSAQGHNTNVGDEGGFAPGLESAPAALDFIMKSIEKAGYRPGEDMYVGLDCASTEFFKDGKYVLEGEGRTLEPGAMAEYLAELVNKYPIISVEDGMAEDDWEGWKTLTDLVGNKCQLVGDDLFVTNSARLRDGIKMGVANSILVKVNQIGSLSETLDAVETAHKAGYTAVMSHRSGETEDSTIADLAVATNCGQIKTGSLARSDRLAKYNQLIRIEEMLGPQAAYAGRSILRG

SEQ ID NO: 12728 - protein, 281 aa, Agrobacterium tumefaciens str. C58 (U. Washington)
MQTRRPFMVARTEARQPEQLAIVDPIWGSLLNEARSAAAQDPLLSAFLYSTILNHRSLEECVIYRICELLDHPDMQAVLLRQTFQDMLEDWPEWGSVLRVDIQAVYDRDPACTRFMEPLLYFKGFQAIQTHRLAHWLLQKGRKDLALYLQSRSSSIFQTDINPAARIGKGIFLDHATGLVVGETAVIGDNVSILHGVTLGGTGKEGADRHPKIANGVMIGAGAKILGNIEIGSCSRIAAGSVVLKPVPPKTTVAGVPARVVGEAGCSEPSRLMDQLIGADI

SEQ ID NO: 12729 - protein, 303 aa, Agrobacterium tumefaciens str. C58 (U. Washington)
MRTAWLRTDRKRKDVDMAQQNAEHIADWRGQSGERWAAYQARLDAMMAPFGQAAIEAAAPTTGERVLDVGCGAGASSRDLAARVGAEGHVLGVDISEPLIERARALAPQDMSVVFRVTDASRAELPDGAFDILFSRFGVMFFNDPTGAFAHMRRALKPGGRAAFVCWRGVTENDWMRLPMGAMKGILPSMTPPGPEAPGPFSFGDQERVERILTKAGFTDIAIEPFDASVSFGEGATRDAALDDAVNMTLEVGPLSRVLADQPDDIRDRASVAVRAALSGCPGERSVMINGATWIVTARNPAS

SEQ ID NO: 12730 - protein, 249 aa, Agrobacterium tumefaciens str. C58 (U. Washington)
MFTQMVSMRLNEMLGVSVEVCRSFEELQACYEHSPEPVTLAISNINLPGAEKGEALEYLIDLSIPTIVFTSTFHEATRETLIAKDVVDYILKDNIFAVDMLTESVCRFLTNHRHHVLIVDDSPTARALLSSRLKRYNFRVSLADSGAKALEILRANPDIGLVVTDYNMPDIDGFELTRRIRTVRGSHELRIIGVSSSTNRLLSARFLKAGGNDFMLRPFIDEEFYCRVNQNLDTLVQIQLAKAGIRPAA

SEQ ID NO: 12731 - protein, 393 aa, Agrobacterium tumefaciens str. C58 (U. Washington)
MRDIVAETGTPCFLYDNSAMRQAYRDLETALSGFADIYYSVKANPLPAIISLFREEGAGAEIASVGEYRAAVKAGVAPDNIIFAGPGKSMAELREVIEGGIGEIHIESAEEIARIEAINRPVKASIRINPVPDAQAGAMRMGGKATAFGFDEEELENVLKLFANVRHIDLVGIHIYGGTQILDADMLVSQWRHAIALAGRMAQMLGKPLETIDLGGGLGIPYFAGETSLDLAKVAAAIPDLKALLKAHPLIADAHVIVEPGRFLAGPGGLYVVEVNSVKTSRGTTFVVTDGGMHHHLAASGNLGQIVKRNYPIVAPAMMQAAHDETATIVGPLCTPLDTLARNATLPKLNAGDLLAILQSGAYGASASPGGFLSHTVAKEVLVEDGAFEVIGR

SEQ ID NO: 12732 - protein, 112 aa, Agrobacterium tumefaciens str. C58 (U. Washington)
MKKIEAIIKPFKLDEVKEALQEVGLQGITVTEAKGFGRQKGHTELYRGAEYVVDFLPKVKVEVVLADENAEAVIEAIRNAAQTGRIGDGKIFVSNIEEVIRIRTGETGVDAI

SEQ ID NO: 12733 - protein, 297 aa, Agrobacterium tumefaciens str. C58 (U. Washington)
MALPHIFLALITVFLWGFNFVAIKVGVADMPPLFLTGVRYLFAAVPLVFFLPKPNVPWRHMIVYGMAMGFFQFGLLYPAIKLGLPAGLASLVMQSQAFFTLALAVVFLGERPLPSQIAGAIVAFGGLAVIGMERMTAAALIPLLMGVGSAIAWACGNIVNRRIGQVNVVSFIAWTSLVPVLPLVLLSLVVEGPDAIVEGLQNATPTMALVVIYMAYGATIVGAGIWSYLLLRYPAGTVAPFSLLVPIVGFISAYLAFAEHITIFEIIGAALVILGLALNVFGRRIGVSRFWVRSPQG

SEQ ID NO: 12734 - protein, 736 aa, Agrobacterium tumefaciens str. C58 (U. Washington)
MSSHTPKLDSCGAEPIHIPGAIQEHGALLVLSAREFSVVQASDNLANYIGVDLPIGAVATEANLPFISVLSAWYSGEESNFRYAWAEKKLDVSAHRSGTLVILEVEKAGVGESAEKLMGELTSLAKYLNSAPSLEDALFRTAQLVSSISGHDRTLIYDFGLDWSGHVVAEAGSGALPSYLGLRFPAGDIPPQARQLYTINRLRMIPDVDYKPVPIRPEVNAETGAVLDMSFSQLRSVSPVHLEYMRNMGTAASMSVSIVVNGALWGLIACHHATPHSVSLAVREACDFAAQLLSMRIAMEQSSQDASRRVELGHIQARLLKGMAAAEKWVDGLLGGEGEREDLLKQVGADGAALVLGDDYELVGNTPSREQVEELILWLGEREIADVFATDNLAGNYPTAAAYASVASGIIAMRVSELHGSWLIWFRPEVIKTVRWGGDPHKTVQESGRIHPRKSFEIWKEQLRNTSFPWSEPELAAARELRGAIIGIVLRKTEEMADLTRELQRTNKELEAFSYSVSHDLRAPFRHIVGFAQLLRERSDALDEKSLHYLQMISEAALGAGRLVDDLLNFSQLGRTQLTLKPVDMQKVVSEVRRSLSHAVSDRQIEWRIGALPVIFGDPTLLRQVWYNLIENAIKYSSREPVSIITISAVETEDDVTYSVEDNGVGFDMAYYNKLFGVFQRLQRVEDFEGTGIGLALVRRIVERHHGLVGAEGTVGEGATFSFTLPVTKVEEEKIA

SEQ ID NO: 12735 - protein, 309 aa, Agrobacterium tumefaciens str. C58 (U. Washington)
MAIQKQMDAREWAMLIALSLLWGGSFFFIGVAVKELPPVTIVTLRVSLAAVALLVVCRIMGLRLPREWAVWRAFFGMGLLNNIIPFCLIVWGQTQIASGLASILNATTPLFTVIVAHFLTADEKMTGNKLAGVLIGFVGVATMIGPAAFGGSSGLWGQIAILGAAISYSFAGIFGRRFKAMGVPPLMTATGQISSSTLMLIPAALLIDKPWTLAMPGLGTWGALIGIALLSTALAYLIFFRILASAGATNLALVTFLIPVSAILLGSLILGEQLEIKHFAGMAMIAAGLAAIDGRLPVKLRSLLRNAPA

SEQ ID NO: 12736 - protein, 1257 aa, Agrobacterium tumefaciens str. C58 (U. Washington)
MFDDLFGPEGAKRDGAEIFKALRDAASERILILDGAMGTQIQGLGFDEDHFRGDRFIGCACHQKGNNDLLILTQPDAIEEIHYRYAMAGADILETNTFSSTRIAQADYEMENAVYDLNREGAAIVRRAAQRAEREDGRRRFVAGAIGPTNRTASISPDVNNPGYRAVSFDDLRIAYGEQIDGLIDGGADIILIETIFDTLNAKAAIFACEERFEAKGIRLPVMISGTITDLSGRTLSGQTPSAFWNSVRHANPFTIGLNCALGADAMRPHLQELSDVADTFVCAYPNAGLPNEFGQYDETPEMMARQVEGFVRDGLVNIVGGCCGSTPEHIRAIAEAVKDYKPREIPEHKPFMSLSGLEPFVLTKDIPFVNVGERTNVTGSARFRKLITAGDYTAALAVARDQVENGAQIIDINMDEGLIDSEKAMVEFLNLIAAEPDIARVPVMIDSSKFEIIEAGLKCVQGKSIVNSISLKEGEEKFLQQARLVHNYGAAVVVMAFDEVGQADTYQRKVEICARAYKLLTEKAGLSPEDIIFDPNVFAVATGIEEHNNYGVDFIEATKTIRETMPLTHISGGVSNLSFSFRGNEPVREAMHAVFLYHAIQVGMDMGIVNAGQLAVYDNIDAELREACEDVVLNRRDDATERLLEVAERFRGTGEKQAKVQDLSWREYPVEKRLEHALVNGITDYIEADTEEARQQAARPLHVIEGPLMAGMNVVGDLFGSGKMFLPQVVKSARVMKQAVAVLLPYMEEEKRLNGGSERSAAGKVLMATVKGDVHDIGKNIVGVVLACNNYEIIDLGVMVPTTKILETAIAEKVDVIGLSGLITPSLDEMVHVAAEMERQGFDIPLLIGGATTSRVHTAVKIHPRYEQGQAIYVTDASRAVGVVSALLSEEQKPAYIDGIRAEYAKVAEAHARNEREKQRLPLSRARENAHKIDWSSYSVVKPQFFGTKVFETYDLEELSRYIDWTPFFQTWELKGRFPAILEDEKQGEAARQLYADAQAMLAKIIEEKWFRPRAVIGFWPANAVGDDIRLFTDEGRKEELATFFTLRQQLSKRDGRPNVALSDFVAPVDSGVADYVGGFVVTAGIEEVAIAERFERANDDYSSILVKALADRFAEAFAERMHERVRKEFWGYAPDEALAGDDLIGEAYAGIRPAPGYPAQPDHTEKKTLFALLDATNAAGVELTESYAMWPGSSVSGLYIGHPESYYFGVAKVERDQVLDYARRKDMPVTEVERWLGPVLNYVPTNGEEKIDSAA

SEQ ID NO: 12737 - protein, 258 aa, Agrobacterium tumefaciens str. C58 (U. Washington)
MHRTVIVTGSTSGIGLGIAQRFAREGANIVLNGFGDDDEIEKLRLLLEAESGGRVLYHPADMTKPDEIADLIQSSHEKLGSVDVLINNAGIQHIAPIEEFPTEKWDWIIAINLTSSFHTMRAAIPLMKKAGKGRIINISSAHGLVASPFKSAYVAAKHGIMGLTKTAALELAQTGVTVNAICPGYVLTPLVEKQIPEMAKVRGISEAAVKNDVMLELQATKQFVTVDDVAAAAIFLASDAASNITGTHISVDGGWTAQ

SEQ ID NO: 12738 - protein, 1231 aa, Agrobacterium tumefaciens str. C58 (U. Washington)
MDCRGVEYRLTEGCGLLEKACRAVAALELPACIKDGELRYVVVNEAYGRVMGRAPSAFEGQTSLSLSGDIRDAEREDRERRSLVFATDEAIACHAALSAQSHMLRCERFIGDDGSLFLFEVFEEMPSAVSRKSAAVGGASDILFSSGVMDFIDAGIVVYDRDNQLVYCNARFAEFYSDLDIELKPGIRLEALMKTLYSSSVYRCAKNDGPSFEDWMQKQLHDFSLPYLERVEQFADGRWVRMVNKRLENGMLVGLRVDVTEFKAHETLLSTQIRETWLLRAALEQLPVGVFLRDQDRRLTYANAAYNTFLGGNLADHIGKTETEMFPQNGPRFRQENERILQTGEAIERTGNMPWRDGGAVPVITRLGRVATPDDEYYLVGSVTDVSLLQDREKALIAAQAEAEALHRQLQAVLRALPVGVLLLNADLVIEYVNPFFYQVWGEIGGEKSLVGKSYREFMEMNFDSGLYDYGDRPFDDVYEERVQRLLKADAFAPREVRSKSGKVTVISKTRLEGGKILSTYADVTDVRMRDAEISKARAELERVGEYMQGATRAMAQGLVLVEQGTIIMSNEAMARMFDVPPHLLEKGRNWAGFFAHCAGRGDFGTAAEAGETLRIWRENIAANRPFSWLVHVAGKSWLNLEATNSSGNYWLIIVTDVTEMKVREEELQRLLSRAEAADRAKSEFLANMSHEIRTPMNGVLGMAELLAKSKLDTRQKTFTDIIVKSGNALLTIINDILDFSKIEAGQMKLRSVPFDPAEAVEDVVSLLSSAALEKDIELIVRIDASVSGKVIGDAGRFRQIVTNIVGNAVKFTETGHVLVELSAQSAEASESIFSLRVEDSGIGIPVDKLETIFDKFSQVDGSATRRHEGTGLGLAITVGLVGLFDGKINVVSEVGRGSAFEVDIPFQVMERRRDVPLLSVAIDDIRVLVIDDNDVNRRILTEQLRSWGIDGHAVENGPSGIAVLQEAASLGFAIDAIILDYHMPVMNGLDVVERIRADKRFDDIAIVFLTSMDVVGDETLFTDLSVQAHLMKPARARLLRSTLFDVVRDVRLKRIRQHPLAQGTGGEKARPESRPAEKKQRAEAPATVPERSRPCLLDVLVAEDNDVNQIVFSQILQQAGLRFLIVGNGKRAVQAWEEYNPALILMDVSMPVMNGHQATQAIRAAEQAAGDSRHVPVIGVTAHTQEADRERCLEAGMDDYLSKPISPESLEDKIAQWLGENVLRRDAPGV

SEQ ID NO: 12739 - protein, 305 aa, Agrobacterium tumefaciens str. C58 (U. Washington)
MRHRRCSMSLDRLAPAIFVFLWSTGWVTAKYAVYYTGPLTFLCLRYLLAGLLLWAICRFSGISWPKQRADVLRAILSGVFLHGIYLGMIWWAIGQGVPAAIGGIIAGLQPLMTAVAARFMIGERISPLQRAGLLLGFAGIAIAVLPKVMATGALGMSVPLYAVAVNVLGMVSVTYGTLYQKKYVHGGNIMAVATLQYVGALLVTVPFALLLEDGHVDWSLGLAATLGWSVGAISIGAVALLLYLIRRGQVSRAASLIYLVPPLAAVEAAVLFGETLTPAMIAGTVLAVTGVYLANRKPAASVAVR

SEQ ID NO: 12740 - protein, 365 aa, Agrobacterium tumefaciens str. C58 (U. Washington)
MKIAFYSPLKSPYHPVPSGDRLMARLLMKAMTMAGHEVFVASELRSFLKQPDDPARPALIDEAGREIEAIAERWRQEGAPDLWFCYHPYYKAPDLLGPELVHRFGIAYVTAEASYSPKRNGMGWQAIQDGLLAALNGAAVNICFTARDREGLVRASPTLQWAILPPFIDAGAFLSNIPRPEPARLITVAMMRAGDKLSSYRTLSEALALLPETLDWTLDIIGDGPERAAVETMFSAFPDHRLGWHGEKSPTEIATLLSKASLYVWPGHGEAYGLAYLEAQAAGLPVVAEKVAGVPEVVKSGTTGLLTPENDTAAYAEAIRTLLGDDRQREELAKAARQFVINERSLENAATTLNQILLQAKARRS

SEQ ID NO: 12741 - protein, 241 aa, Agrobacterium tumefaciens str. C58 (U. Washington)
MSRVALISGGTSGIGAAIARALQAAGYRVAVNYAFTTDRAEAFQKETGIPAFQWDVRDYDACVDGITKVEETFGPVEVLVNNAGITRDAMFHKMSPQQWREVIDTNLTGVFNMTHPVWPGMRERGFGRIVNISSINGQKGQAGQVNYSASKAGDIGFTKALAQEGASRNITVNAICPGYIGTEMVRAIPEKVLAERIVPQIPVGRLGEPEEIARCVLFLVSDEAGFITGSTMTANGGQYFA

SEQ ID NO: 12742 - protein, 527 aa, Agrobacterium tumefaciens str. C58 (U. Washington)
MDGTHLFELVIAMFLAIIVLHYIAHRLGLPPSVALLAGGGTLAFVPGLPTISVNPELVLVIFLPPLLLDGAWSISVDRLKRHVFGIASLAIGAVLFTTVIVAVVVHFLMPSLPWAACAALGAIVSPPDAVSARAVLERIRIPRRLQILLEGESLLNDASGLVLFRFAVAAAAGGVFSTVDALGEFFFLAVGGAAVGAFVGLLWVKTVRHLGDEYLMIAATAVLSWAAYILAEQAQTSGVIATVTAGLIASWHQHTVLSAATRMRGTSFWNVLVFLMEAMVFILIGLSLRDVVERGGGFGSIASSMALPALAVLVTLVAARFVWIFASDLVIRLFHGLKLAHSKPLGPGAVTALGWAGMRGVVTLALALSLPEDFPGRDFILVMAFAVIMGTVLIQGTTLGRIIAWAGLGGIEPERAPMTMSEAEASMAQVQFTTVQGLAYDENGELIHPQLLKRYEHRLAASVKYAESTEKYSPLLHAHFDVVLKAVAAGRKELIRLRREGQIDDETLRELEHDLDLEELTAISAKA

SEQ ID NO: 12743 - protein, 465 aa, Agrobacterium tumefaciens str. C58 (U. Washington)
MRAFLVLCRLSISRGTEEAHHHCLKCGRVIPSNRWQTKPNDALAGHRSHSRLERMLSILRLHRLIRMHISSVLCPPDSAGVGFIGNISMTTARILDFIKTRRPEGPCLVVDLDVVRDNFNAFRHSLPNSAIYYAVKANPAPEILKLLASLGSNFDCASVAEIQMALDAGATSDRISFGNTIKKERDVARAHALGIDLFAVDSHEEVEKVARAAPGARVFCRVLTDGEGAEWPLSRKFGCVPQMAVDVLVYAHQMGLESYGVSFHVGSQMMNLDAWDAALADAKRVFASLAKQGIHLQMVNMGGGFPTKYLRDVPAAEEYGQAIDTALRKHFGNQIPKTIIEPGRGMVGNAGVIKAEVVLVSKKSDNDNHRWVFLDIGKFGGLAETMDEAIRYPIRTERDQDEMQPCVLAGPTCDSADVLYEKNMYPLPVSLTIGDEVLIEGTGAYTTTYSAVAFNGFEPLKAYVI

SEQ ID NO: 12744 - protein, 500 aa, Beta vulgaris
MSMPIPSRQLFIDGEWREPIKKNRIPIINPSNEEIIGDIPAGSSEDIEVAVAAARRALKRNKGREWAATSGAHRARYLRAIAAKVTERKDHFVKLETIDSGKPFDEAVLDIDDVATCFEYFAGQAEAMDAKQKAPVTLPMERFKSHVLRQPIGVVGLITPWNYPLLMATWKIAPALAAGCTAVLKPSELASITCLEFGEVCNEVGLPPGVLNIVTGLGPDAGAPLAAHPDVDKVAFTGSSATGSKVMASAAQLVKPVTLELGGKSPIIVFEDVDIDQVVEWTMFGCFWTNGQICSATSRLLVHESIAAEFIDRLVKWTKNIKISDPFEEGCRLGPVISKGQYDKIMKFISTAKSEGATILCGGSRPEHLKKGYFIEPTIISDISTSMQIWREEVFGPVLCVKTFSSEDEALDLANDTEYGLASAVFSKDLERCERVSKLLESGAVWVNCSQPCFVHAPWGGIKRSGFGRELGEWGIENYLNIKQVTSDISNEPWGWYKSP

SEQ ID NO: 12745 - protein, 621 aa, Agrobacterium tumefaciens str. C58 (U. Washington)
MESFYLLLLVATVLVLVAAFSSLIAFRFGAPLLLLFLVIGLAAGVDGLGIEFTNNPLAYMLGSLILAVILFDSGFGTSLQSFRLSAAPAVALATVGVILTSVFFAGAAALLLGLSWLEGLLLGAIVASTDAAAVFFLLRIGGIHIRDQVRSTLEVESGTNDPMAIFLTVALVEIVAKGQGLAGIDSGFLLLFIEEMGLGVIFGLLGGLMIATVVNRFAADRGLAPIFVLALALLVFSFTGAIGGSGFLAVYVAGIVAGNRRIFAKETIRRFHEGLTWLAQIIMFLMLGLLATPSQFPAIAIPAVLLALFLIFVARPLAVWLSLMPFNYTQQETSFVAWVGLRGAVSILLAIMPILGGLDDAQIYFNAAFIIVLVSLLVQGWTIKPVATRLGLIVPPRMGEVDKLEVDLPGTANHELISYRVAKGSAIMQGERIPRWAMPSLVVRDGKSIRYQYAGRLRENDLVYLFIAPNYTRLIDRLFASALPVADDDADFFGIFTISPSRPAKEMEAAYGPGLISPAEHAMTIAELIETRLAGKAGYADRVRLGPLVLIVRALDEQEAITGVGISLEPVEPAIGLPIFISFSDILRRARTHLAQRRQLRSADAGEGVSAPAKTVTENEA

SEQ ID NO: 12746 - protein, 485 aa, Agrobacterium tumefaciens str. C58 (U. Washington)
MTSPLQHLQQSGRLKKFYIDGKWVLPSGSDKVAVINPATELEFAEIALGNDEDVALAVAAARGAFAGWARTGPADRSELLNRVHQLMQQRLELLAQALTMEMGAAINYARSVQVPLAAEHIKVARDNAASYSFLSQRGHTAILREPIGVCGLITPWNWPLYQITAKVGPALAAGCTVVLKPSELSPLSALLFAEIIEDAGFPPGVFNLVNGEGTIVGAGLSAHPDVDMISITGSTRAGILVAQAAAPTVKRVAQELGGKSPNIILADADMTRAVPLGVAAAFRNLGQSCSAPTRMIVPRSHQKHIEELAAAAALEIVVGDPLSEHTTHGPVANHAQFDRIQRMISIGMDEGAKLVVGGTGRPDGLDTGFYVRPTIFSDVDPKMQIAQQEIFGPVLSIISYDTLEEAIEIANDTVYGLGAHVQGTDLQTVRIVAEQIRSGQVHLNYPAWDPNAPFGGYKQSGNGREYGTEGMEEYLEIKSILGFYP

SEQ ID NO: 12747 - protein, 505 aa, Agrobacterium tumefaciens str. C58 (U. Washington)
MHEPLTAAEYKAIASDLQFPANAFIDGAFRPAGSGKTFKTINPATGETLADISACDVSDVDYAVGKARAAFDDGRWRLLPPGERKAILLTFAKLLEQHRHELAVMESLDSGKPVSECQTVDIPDTIHTIRWHAELIDKLYDNTAPVGSNALALVVREPVGVVGCVLPWNFPLLMLAWKIGPALASGCSVIVKPAEETTLTTLRVAELAHEAGIPAGVFNVVPGGGKEVGEPIGMHMDVDMVAFTGSTPTGRRFLRYAADSNLKRIVLECGGKNPAVVLDDAEDLDLVAEQVVNGAFWNMGENCSASSRLIVHAKIKDELLQRIGAYMREWRMGDPLDPQNRVGALVSKAHFDKVHSFLEDVKAENLTIVHGGKTEKGIFIEPTVVDAVPPASRLFREEIFGPILSVTTFNTLAEAVALANDTNYGLAASVYTGSLRKAIKLSREIRAGVVTVNCFGEGDATTPFGGYKESGFGGRDKSIFAHDNYCELKTIWIDVSDRSVDETVR

SEQ ID NO: 12748 - protein, 241 aa, Agrobacterium tumefaciens str. C58 (U. Washington)
MQFSGKSVIITGAGKGIGRACAQLMAARGAEVVAISRTQSDLDSLKSEIGGRSIRVDLADIAATRAAMAEAGPCDFLINSAGINVLESVLDMSDAGYEAVLGINLRAALVTCQEFARGRVANGGGGAIVNITSIAGHRGFQDHLCYAASKAGLEGATRVLAKELGPHGIRVNAVAPTITLTELAAEAWNDPEKSQPMMVRHPLNRFAEAEEVAQSIALLLSDDSKMISGAVLPVDGGFLAV

SEQ ID NO: 12749 - protein, 243 aa, Agrobacterium tumefaciens str. C58 (U. Washington)
MVQDFNGRTVVITAAGQGIGRATAERFISLGARVIATDINEQALSTLKGAETRVLNVLDGDGVEDFAADIGHADVLFNCAGFVHSGTILDCEEKDWDFSFDLNAKAMYRTCRAFLPGMLEKGKGAIVNMSSVASSVKGVPNRFAYTASKAAVVGLTKAIAADFVTKGIRCNAICPGTVDSPSLHDRLRATGNYEQALADFIARQPMGRIATPEEIAALVTYLASDEAGFTTGQIHVIDGGWTG

SEQ ID NO: 12750 - protein, 249 aa, Agrobacterium tumefaciens str. C58 (U. Washington)
MSTHYDLDGRVAVVTGATGGFGVAISQRLRDCGATVIHWDLPAAVKDGALGDLPHAGVDISDAKSIETAAIDLKQRFGRLDILVNNAGIVGNVAPLWEIPIEEFRRIIDINLFGSFLVCRALVPLMIETARTSRFGRIVNVASIQAKEGMHQAAAYSASKAGLVAMTKSLGKELATADILVNAITPAASMTAMSIDAPKERLDDILSRIPMRRFLEPAEVANMVAWLSSSECSFSTGAVFDLSGGRATY

SEQ ID NO: 12751 - protein, 788 aa, Agrobacterium tumefaciens str. C58 (U. Washington)
MEYGPSPEANGDVKQWLDAHGRSFGHYINGRFVSPDGRKTIAVSNPANGDKLAEIVCGNEEDVDQAIKAARAAFGKWSKLSGHARARYLYAIARHIQKRERFLSVLETMDNGKPVRETRDIDIPLVARHFYHHAGWAEMVEDEFHGFSPVGVCGQVIPWNFPLLMLAWKIAPALAAGNTVVLKPADLTPLTAIAFAEICHEVGLPAGVVNIVQGDGSTGAAICGHDGVDKVAFTGSTKVGRVIREQIAGSGKKLSLELGGKSPFIVFEDADLDAAVEGVVDAIWFNQGEVCCAGSRLLVQEGIAEKFYARLKKRLETLRVGDPLDKSTDVGAIVSATQVKRITDLVRKGVEEGGELWQSSNPLPPTGNYVAPGFFTDVDQASTVCQVEIFGPIAAATTFRTPDEAVSLANNTRYGLAASIWSENINVALDLAARVKAGVVWINCTNMLDAGAGFGGYRESGFGREGAREGLYEYLAADWEKNLSVSKPAEAFAPSALPNADSKKAIDGLDRTMKNYIGGKQARPDGGYSYSVTGKGNAVIGMAGIGNRKDIRNAVEAASKAGSWSSATAHNRAQVLYYLAENLNARRDEFVARIIDSTGVSEKKARDEFDASLRRISYYAAQADKFDGAIHSTKSRHVTLAMNEPWGIVGIVCPDEAPLLSLVSLVLPAIAMGNRVVVIPSSRHPLIAGDFYQVLDTSDVPGGVINIVTGERDMLAKTLAEHDDVAAIWYFGSAVGSAMVERASAGNLKAAWVNNGRQPDWLDRTQWQGRDYLRRAIQVKNIWVPYGA

SEQ ID NO: 12752 - protein, 256 aa, Agrobacterium tumefaciens str. C58 (U. Washington); identical to SEQ ID NO: 680

SEQ ID NO: 12753 - protein, 372 aa, Agrobacterium tumefaciens str. C58 (U. Washington)
MTQPATAAVLEEKNGRFILREVKLEAPRPDEVLIRMVATGICATDAHVRQQLMPTPLPAILGHEGAGIVERVGSTVSHLKPGDHVVLSYHSCGHCKPCMSSHAAYCDHVWETNFAGARLDGTIGVAAPDGNTLHAHFFGQSSFSTYALAHQRNAVKVPDDVPLELLGPLGCGFQTGAGSVLNALKVPVGASIAIFGVGAVGLSAIMAAKVADAAVIIAIDVNTERLKLASELGATHCVNPREQADVASAIRDIAPRGVEYVLDTSGRKENLDGGIGALAPMGQFGFVAFNDHSGAVVDASRLTVGQSLIGIIQGDAISGLMIPELVGLYRSGRFPFDRLLTFYDFADINEAFDDVAAGRVIKAVLRFPPQAA

SEQ ID NO: 12754 - protein, 548 aa, Homo sapiens
SDCEPARALRRSRRSAKFPEPRSRRGFALVLALVPGVGGRCARSLPNPVPAPRHAGLSGHHSHVLVSVRRYRLFTSAEETFSHCKSEHQFNIDSMVHKHGLEFYGYIKLINFIRLKNPTVEYMNSIYNPVPWEKEEYLKPVLEDDLLLQFDVEDLYEPVSVPFSYPNGLSENTSVVEKLKHMEARALSAEAALARAREDLQKMKQFAQDFVMHTDVRTCSSSTSVIADLQEDEDGVYFSSYGHYGIHEEMLKDKIRTESYRDFIYQNPHIFKDKVVLDVGCGTGILSMFAAKAGAKKVLGVDQSEILYQAMDIIRLNKLEDTITLIKGKIEEVHLPVEKVDVIISEWMGYFLLFESMLDSVLYAKNKYLAKGGSVYPDICTISLVAVSDVNKHADRIAFWDDVYGFKMSCMKKAVIPEAVVEVLDPKTLISEPCGIKHIDCHTTSISDLEFSSDFTLKITRTSMCTAIAGYFDIYFEKNCHNRVVFSTGPQSTKTHWKQTVFLLEKPFSVKAGEALKGKVTVHKNKKDPRSLTVTLTLNNSTQTYGLQ

SEQ ID NO: 12755 - protein, 873 aa, Clostridium symbiosum
AKWVYKFEEGNASMRNLLGGAGCNLAEMTILGMPIPQGFTVTTEACTEYYNSGKQITQEIQDQIFEAITWLEELNGKKFGDTEDPLLVSVRSGARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 12756 - protein, 503 aa, Coprinopsis cinerea
AIVNSVDTMTLTNANVSPDGFTRAGILVNGVHGPLIRGGKNDNFELNVVNDLDNPTMLRPTSIHWHGLFQRGTNWADGADGVNQCPISPGHAFLYKFTPAGHAGTFWYHSHFGTQYCDGLRGPMVIYDDNDPHAALYDEDDENTIITLADWYHIPAPSIQGAAQPDATLINGKGRYVGGPAAELSIVNVEQGKKYRMRLISLSCDPNWQFSIDGHELTIIEVDGELTEPHTVDRLQIFTGQRYSFVLDANQPVDNYWIRAQPNKGRNGLAGTFANGVNSAILRYAGAANADPTTSANPNPAQLNEADLHALIDPAAPGIPTPGAADVNLRFQLGFSGGRFTINGTAYESPSVPTLLQIMSGAQSANDLLPAGSVYELPRNQVVELVVPAGVLGGPHPFHLHGHAFSVVRSAGSSTYNFVNPVKRDVVSLGVTGDEVTIRFVTDNPGPWFFHCHIEFHLMNGLAIVFAEDMANTVDANNPPVEWAQLCEIYDDLPPEATSIQTV

SEQ ID NO: 12757 - protein, 299 aa, Drosophila melanogaster
MGFVKVVKNKQYFKRYQVKFRRRREGKTDYYARKRLTFQDKNKYNTPKYRLIVRLSNKDITVQIAYARIEGDRVVCAAYSHELPKYGIQVGLTNYAAAYCTGLLVARRVLNKLGLDSLYAGCTEVTGEEFNVEPVDDGPGAFRCFLDVGLARTTTGARVFGAMKGAVDGGLNIPHSVKRFPGYSAETKSFNADVHRAHIFGQHVADYMRSLEEEDEESFKRQFSRYIKLGIRADDLEDIYKKAHQAIRNDPTHKVTAKKSSAVTKKRWNAKKLTNEQRKTKIAAHKAAYVAKLQSETEA

SEQ ID NO: 12758 - protein, 959 aa, Drosophila melanogaster
MSVSHNYDQMSQPTNTTTTQTKASKRPSRFNSKMPVVNSRLAELARITVLLTALLVSYASGLQTVGESADDNTICLYREYNTTYRKEIGAVWFASKDPCLVYSCAAGVAKDPQAHIVATQVDCNEFYCEVGSELRSVEGSCCGECVRTHCQHNHTLYAVGESWHNDADCTLIECGRLDNGQIVMNTYKRNCPALTEDCPASRLEERNCCPYCRPLQTARIEELQDNVAESTDDIWTAEWYRNHPCNRDCQVGAEPMTCRYKFVVEWYQTFSKACYDCPRNLTDCSRPHCVMGDGLERSITVVNRMMPGPAIEVCEGDEIVVDVKNHLLGESTSIHWHGLHQKKTPYMDGVPHITQCPITPHATFRYSFPADLSGTHFWHSHTGMQRGDGVFSALIIRKPKTAEPHGGLYDFDLSEHVMIVQDWIHDTGASIFSYHHHSRGDNKPHNLLVNGKGRYYNRIWAEAKQAHRRAEERTTQPVEPLPKSQVDFVQTLPRQARLAKTNTTKLFPVNSRQKRGNLNEIPLELVPHQIYTVRRGFRYRFRIINAEYLNCPIVVSIDGHNLTAINSDGFDIEAMDVGSIVTYSGERFDFVLNANLEVGNYWIRLKGLMDCSEVFTSAFQVAILRYEGAPDEEPTAELSYGHKAEGIELNVMNRGPGYPDTKTVAEMRALPIYDHVSGIDHDTLKPEADYKFFIYYDFYTKNNPDFHDKDLYAMDMEMTQQNRLYTPQLNHITLNFPSLALLPSRSQLKDSDFCNETSLMDQGIDCRQEFCKCHHVLQVPLGAVVEMIIVDEGFQYYANHPFHLHGNAFRVMGLERLGENVTVEMIKQLDQFNLLKRNLDNPPVKDTVTIPDGGYTIIRFEASNPGYWLFHCHIEFHAEIGMALVFKVGNDDQMVPVPENFPTCGDYNPDLRSDGGTTEDSGSSKPITATPPNTGGGGSGLEPTWITLMISSMLVKLYR

SEQ ID NO: 12759 - protein, 242 aa, Drosophila melanogaster
MWTDLAGKVILVTGAGAGIGQALVKQLASAGATVIAVARKPEQLQQLVAFDPVHIQPLQLDLSGWQAVREGLAKVPLLDGLVNNAGVAIIKPFEELTEQDFDTHFDVNIKAVFNVTQSLLPRLKDGASIVNVSSIASSRSFGGHTAYSATKAALDSLTKSLALELGPRKIRVNSINPTVVLTKMGADNWSDPAKSGPLLAHIPLNRFCEVQEVVDATGYLLSSKSSFVNGHHILLEGGYSVS

SEQ ID NO: 12760 - protein, 520 aa, Monkeypox virus
MANIINLWNGIVPTVQDVNVASITAFKSMIDETWDKKIEANTCISRKHRNIIHEVIRDFMKAYPKMDENRKSPLGAPMQWLTQYYILKNEYHKTMLAYDDGSLNTKFKTLNIYMITNVGQYILYIVFCIISGKNHDGTPYIYDSEITSNDKNLINDRIKYACKQILHGQLTMALRIRNKFMFIGSPMYLWFNVNGSHVYHEIYDRNVGFHNKEIGRLLYAFMYYLSISGRFLNDLALLKFTYLGESWTFSLSVPEYILYGLGYSVFDTIEKFSNDAILVYIRTNNRNGYDYAEFNKKGIVKVTEDKPDNDKRIHAIRLINYSSDVQHIHFGFRNTLIIDNECTSIQSSAENATDTGHHQDSKINIEDDDDDIIDDDDDDDDDDDDDDDDDDDDDDDYNPKPTPIPDPHPRPPFPRHDYHKRPKLLPVEEPDPVKKDADRIRLDNHILNTLDHNLNSIGHYCCDTVAVDRLEHHIETLGQYTVILARKINMQTLLFPWPLPTVHPHAIDGSIPPHGRSTIL

SEQ ID NO: 12761 - protein, 345 aa, Mus musculus
MPRIDADLKLDFKDVLLRPKRSSLKSRSEVDLERTFTFRNSKQTYSGIPIIVANMDTVGTFEMAVVMSQHAMFTAVHKHYSLDDWKCFAETHPECLQHVAVSSGSGQNDLERMSRILEAVPQVKFICLDVANGYSEHFVEFVKLVRSKFPEHTIMAGNVVTGEMVEELILSGADIIKVGVGPGSVCTTRTKTGVGYPQLSAVIECADSAHGLKGHIISDGGCTCPGDVAKAFGAGADFVMLGGMFSGHTECAGEVIERNGQKLKLFYGMSSDTAMKKHAGGVAEYRASEGKTVEVPYKGDVENTILDILGGLRSTCTYVGAAKLKELSRRATFIRVTQQHNTVFG

SEQ ID NO: 12762 - protein, 405 aa, Drosophila melanogaster
MPLFGKKDSGKKAKAKDLKELNKQVSIEEKYNLHGLLGTGAFSEVRLAESKDSPGEHFAVKIIDKKALKGKEESLENEIRVLRRFSANHFDGKCLNGTRLTHPNIVQLLETYEDKSKVYLVMELVTGGELFDRIVEKGSYTEKDASHLIRQILEAVDYMHEQGVVHRDLKPENLLYYSPDDDSKIMISDFGLSKMEDSGIMATACGTPGYVAPEVLAQKPYGKAVDVWSIGVISYILLCGYPPFYDENDANLFAQILKGDFEFDSPYWDEISESAKHFIKNLMCVTVEKRYTCKQALGHAWISGNEASSRNIHGTVSEQLKKNFAKSRWKQAYYAATVIRQMQRMALNSNSNANFDSSNSSNQDSTTPTAATGAWTSNVLSSQQSVQSHAQEMNKSGGSTNAASQ

SEQ ID NO: 12763 - protein, 372 aa, Caenorhabditis elegans
MEPSSIHVPENYYSVTIGEAQMVVLKRYQNLRLIGSGAQGIVCSAFDTVRNEQVAIKKLSRPFQNVTHAKRAYRELKLMSLVNHKNIIGILNCFTPQKKLDEFNDLYIVMELMDANLCQVIQMDLDHERLSYLLYQMLCGIRHLHSAGIIHRDLKPSNIVVRSDCTLKILDFGLARTAIEAFMMTPYVVTRYYRAPEVILGMGYKENVDVWSIGCIFGELIRGRVLFPGGDHIDQWTRIIEQLGTPDRSFLERLQPTVRNYVENRPRYQATPFEVLFSDNMFPMTADSSRLTGAQARDLLSRMLVIDPERRISVDDALRHPYVNVWFDEIEVYAPPPLPYDHNMDVEQNVDSWREHIFRELTDYARTHDIYS

SEQ ID NO: 12764 - protein, 302 aa, Pinus pinaster
MERFANDVDEHSLKETELRLGLPGVCESDTGPGQTRNGKRGFSEVMDSTKASSFNDNKWIFPSVKCQPATSAITETAEACKGSQPGLFSATPSQKIMMQGGCGAPQSWAGDNGLSRSTAPKDELHPKTPRDGPTEKTNGASQSQAATDPAMAPAPKAQVVGWPPIRSFRKNTLAANSKPNDEGSSSNALYVKVSMDGAPYLRKVDLKMYSTYHELSSALEKMFSCFNMGQCGAPGLSESKLIDLLNGSEYVPTYEDKDGDWMLVGDVPWEMFVDSCKRLRITKASEAIGLAPRAMEKSRSKN

SEQ ID NO: 12765 - protein, 376 aa, Drosophila melanogaster
MEEFNSSGSVVNGTGSTEVPQSNAEVIRGQIFEVGPRYIKLAYIGEGAYGMVVSADDTLTNQRVAIKKISPFEHQTYCQRTLREITILTRFKHENIIDIRDILRVDSIDQMRDVYIVQCLMETDLYKLLKTQRLSNDHICYFLYQILRGLKYIHSANVLHRDLKPSNLLLNKTCDLKICDFGLARIADPEHDHTGFLTEYVATRWYRAPEIMLNSKGYTKSIDIWSVGCILAEMLSNRPIFPGKHYLDQLNHILGVLGSPSRDDLECIINEKARNYLESLPFKPNVPWAKLFPNADALALDLLGKMLTFNPHKRIPVEEALAHPYLEQYYDPGDEPVAEVPFRINMENDDISRDALKSLIFEETLKFKERQPDNAP

SEQ ID NO: 12766 - protein, 414 aa, Sinapis alba
MAFRPIGYTISSLRKASAANDLRFSFLSIYSSFPAKKNLLLSFLRGFSSLHRRQQQQSRVNKSETLAQKIGKSIRRAGAPSKARVYADVNVIKPKDYWDYESLAVQWGAQDDYEVVRKVGRGKYSEVFEGIHATDNEKCVIKILKPVKKKKIKREIKILQNLCGGPNIVKLLDIVRDQQSKTPSLIFEHVNNKDFKVLYPTLSDYDVRYYIYELLKALDFCHSRGIMHRDVKPHNVMIDHEQRKLRLIDWGLAEFYHPGKEYNVRVASRYFKGPELLVDLMDYDYSLDLWSLGCMFAGMIFRKEPFFYGHDNYDQLVKIAKVLGTDELNTYLNRYRIELDPNLASLVGRHSRKPWSKFINSENQHLAVPEAVDFVDKLLKYDHQERPTAKEAMAHPYFNPIRNAESSRSTPRAQ

SEQ ID NO: 12767 - protein, 333 aa, Beta vulgaris
MSKSRVYADVNVLRPREYWDYEALTVQWGDQDDYEVVRKIGRGKYSEVFEGLNVNSNERCVIKILKPVKKKKIKREIKILQNLCGGPNVIKLLDIVRDQHSKTPSLVFEFVNSTDFKVLYPTLSDYDIRYYIYELLKALDFCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDELNAYLNKYHLELDPQLDALVGRHSRKPWSRFVNPDNQHLVSPEAIDFLDKLLRYDHQDRLTAKEAMAHPYFSQVRAAESSRMRTQ

SEQ ID NO: 12768 - protein, 577 aa, Streptococcus thermophilus
MTKMLKGIAASDGVAVAKAYLLVQPDLSFETVTVEDISAEEARLDAALAASQDELSVIREKAVESLGEEAAAVFDAHLMVLADPEMTGQIKETIRAKQVNAEAALTEVTNMFIAIFEGMDDNPYMQERAADIRDVTKRVLANLLGKKLPNPATIDEESIIVAHDLTPSDTAQLNKKFVKAFVTDIGGRTSHSAIMARTLEIAAVLGINNITELVKDGDILAVSGITGEVVINPTEEQIAEFKAAGEAYAKQKAEWAQLKDAPTVTADGKHFELAANIGTPKDVEGVNDNGAEAVGLYRTEFLYMDSQDFPTEEDQYEAYKAVLEGMNGKPVVVRTMDIGGDKGLPYFDLPKEMNPFLGYRALRISISETGNQMFRTQLRALLRASVHGKLRIMFPMVALLTEFRTAKGILEEEKAKLVAEGVAVADDIEVGIMIEIPAAAMLADQFAKEVDFFSIGTNDLIQYTMAADRMNEQVSYLYQPYNPSILRLINNVIKAAHAEGKWAGMCGEMAGDQTAVPLLVGMGLDEFSMSATSILRTRSLMKKLDTAKMEEYANRALTECSTMEEVLELSKKYVNVD

SEQ ID NO: 12769 - protein, 418 aa, Colletotrichum lagenarium
MGDLQGRKVFKVFNQDFIVDERYTVTKELGQGAYGIVCAAVNNQTQEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYVRNLPFMPKKPFPQLFAQANPDALDLLDRMLAFDPSSRISVEQALEHPYLHIWHDASDEPDCPTTFNFDFEVVEDVGDMRKMILEEVYRFRQLVRTVPGSTQAGAQAAGQAGAGQVPIPSGNPGWTSSDPRPQEYVGQGGGLEADLAGGLDHRR

SEQ ID NO: 12770 - protein, 509 aa, Sesamum indicum
MALPLLILSFLTIFIAYKLFQRLRYKLPPGPRPLPVVGNLYDIKPLLVRCFTEWSQVYGPIFSVYLGSHLSVVVNSAELAKEVLKDNDQQLANRNRTRQIAKFSKNGADLIWSDYGPHYVKVRKLCTLELFSMKRLEGLRPIREDEVTAMVESIFKDCNKPENKGKALVLREYLGMMAFLHIARLTFGKRFMDSNGVVDGQGEELKAILHNGIKLGTKKSWAEFLPWFRFLFKTENQLLAEHDALADSFTKKIMQEHTLARQKTGNTKNHFVDALLTLQKEYDLSDDTVIGLLWDMISAGMVTTTITVEWAMAELVRNPRVQQKVQEELDRVVGSDRVMTEADIPNLPYLQCVTKECFRMHPPTPLMLPHKASTNVKIGGYDIPKGATVSVNVWALARDPAVWKNPLEFRPERFQEEDIDMKGTDYRLLPFGSGRRICPGAQLAIYLVTSMLGHMLHHFTWTPPAGTKPEDMDMMEQPGTVTYMRTPLQAVPTPRLPADLFKRVASGNV

SEQ ID NO: 12771 - protein, 612 aa, Arabidopsis thaliana
MPEAPKIAALEVSDESLAEKNKNKLQFIEDVTTNADDVQRRVLEEILSRNADVEYLKRHGLEGRTDRETFKHIMPVVTYEDIQPEINRIANGDKSQVLCSNPISEFLTSSGTSGGERKLMPTIEEELDRRSLLYSLLMPVMDQFVPGLDKGKGMYFLFIKSESKTPGGLPARPVLTSYYKSSHFKNRPYDPYTNYTSPNQTILCSDSYQSMYSQMLCGLCQHKEVLRVGAVFASGFIRAIKFLEKHWPELARDIRTGTLSSEITDSSVREAVGEILKPDPKLADFVESECRKTSWQGIITRLWPNTKYVDVIVTGTMSQYIPTLDYYSNGLPLVCTMYASSECYFGVNLRPLCKPSEVSYTLIPNMAYFEFLPVHRNSGVTSSISLPKALTEKEQQELVDLVDVKLGQEYELVVTTYAGLYRYRVGDVLSVAGFKNNAPQFSFICRKNVVLSIDSDKTDEVELQNAVKNAVTHLVPFDASLSEYTSYADTSSIPGHYVLFWELCLNGNTPIPPSVFEDCCLTIEESLNSVYRQGRVSDKSIGPLEIKMVESGTFDKLMDYAISLGASINQYKTPRCVKFAPIIELLNSRVVDSYFSPKCPKWSHGHKQWGSN

SEQ ID NO: 12772 - protein, 173 aa, Arabidopsis thaliana
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREMEGDTKGSAKGGDPNAKKDGQSSQNGQFSQLAHQGPYGNSQAQQHMMVPMPGTD

SEQ ID NO: 12773 - protein, 272 aa, Lactococcus lactis subsp. cremoris
MKLNNQIEIPELGLGVFQIPNEETAEVVKNGIINGYRLIDTAKIYENEEGTGQGIKEGLASTGLTREDLFVTSKLWGDNHSYKETIQSFEESLKKLDLDYLDLYLIHWPGTNYAYKEAWKAMEDLYKAGKVKAIGVSNFQKHHLEELLSYAEINPVLNQIELHPKLSQKELREFLKLHDIKVQAWSPLMQGQLLDNEMLKKIADKHGKSVAQIILRWDIQQEILVNVKSIKSERMIANRQIFDFALDQEDMEALNSLNEALRVGPNPDTFNF

SEQ ID NO: 12774 - protein, 816 aa, Bambusa oldhamii
MGETAGDRVLSRLHSVRERIGDSLSAHPNELVAVFTRLVNLGKGMLQPHQIIAEYNNAIPEAERDKLKDGAFEDVLRAAQEAIVIPPWVALAIRPRPGVWEYVRVNVSELAVEELRVPEYLQFKEQLVEGSTNNNFVLELDFEPFNASFPRPSLSKSIGNGVQFLNRHLSSKLFHDKESMYPLLNFLRAHNYKGMTMMLNDRIRSLSALQGALRKAEEHLSGLSADTPYSDFHHRFQELGLEKGWGDCAKRAQETIHLLLDLLEAPDPSTLEKFLGTIPMVFNVVILSPHGYFAQANVLGYPDTGGQVVYILDQVRAMENEMLLRIKQQGLNITPRILIVTRLLPDATGTTCGQRLEKVLGTEHTHILRVPFRTENGIVRKWISRFEVWPYLETFTDDVAHEIAGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGLYRVVHGIDVFDPKFNIVSPGADMSIYFPYSESHKRLTSLHPEIEELLYSDVDNNEHKFVLKDRNKPIIFSMARLDRVKNLIGLVELYGRNPRLQELVNLVVVCGDHGNPSKDKEEQAEFKKMFDHIEQYNLNGHIRWISAQMNRVRNGELYRYICDTRGAFVQPAFYEAFGLTVVESMSCGLPTFATAYGGPAEIIVHGVSGFHIDPYQGDKASALLVEFFEKCQQDPAHWTKISQGGLQRIEEKYTWKLYSERLMTLTGVYGFWKYVSNLERRETRRYLEMLYALKYRKMASTVPLAVEGEPSNK

SEQ ID NO: 12775 - protein, 808 aa, Bambusa oldhamii
MAAKLTRLHSLRERLSATFSSHPNELIALFSRYVHQGKGMLQRHQLLAEFDALIAADKEKYAPFEDILRAAQEAIVLPPWVALAIRPRPGVWDYIRVNVSELAVEELSVSEYLEFKEQLVDGHTNSNFVLELDFEPFNASFPRPSMSKSIGNGVQFLNRHLSSKLFQDKESLYPLLNFLKAHNHKGTTMMLNDRIQSLRGLQSALRKAEEYLMSFPQDTPYSEFNHRFQELGLEKGWGDTAKRVLDTIHLLLDLLEAPDPANLEKFLGTIPMTFNVVILSPHGYFAQSNVLGYPDTGGQVVYILDQVRALENEMLLRIKQQGLDITPKILIVTRLLPDAVGTTCGQRLEKVIGTEHTDILRVPFRTENGILRKWISRFDVWPFLETYTEDVANEIMREMQAKPDLIIGNYSDGNLVATLLAHKLGVTQCTIAHALEKTKYPNSDIYLDKFDSQYHFSCQFTADLIAMNHTDFIITSTFQEIAGSKDTVGQYESHIAFTLPGLYRVVHGIDVFDPKFNIVSPGADMSVYFPYTETDKRLTAFHPEIEELIYSDVENSEHKFVLKDKNKPIIFSMARLDRVKNMTGLVEMYGKNAHLRDLANLVIVAGDHGKESKDREEQAEFKRMYSLIDEYKLKGHIRWISAQMNRVRNGELYRYICDTKGVFVQPAFYEAFGLTVIESMTCGLPTIATCHGGPAEIIVDGVSGLHIDPYHSNKAADILVNFFEKCKEDPTYWDKISQGGLKRIYEKYTWKLYSERLMTLTGVYGFWKYVSNLERRETRRYLEMFYALKYRSLASAVPLAVDGDSAAN

SEQ ID NO: 12776 - protein, 808 aa, Bambusa oldhamii
MAAKLTRLHSLRERLGATFSSHPNELIALFSRYVNQGKGMLQRHQLLAEFDALMDADKEKYAPFEDILRAAQEAIVLPPWVALAIRPRPGVWDYIRVNVSELAVEELSVSEYLAFKEQLVDGHTNSNFVLELDFEPFNASFPRPSMSKSIGNGVQFLNRHLSSKLFQDKESLYPLLNFLKAHNHKGKTMMLNDRIQSLRGLQSALRKAEEYLISIPQDTPCSEFNHRFQELGLEKGWGDTAKRVLDTIHLLLDLLEAPDPANLEKFLGTIPMTFNVVILSPHGYFAQSNVLGYPDTGGQGVYILDQVRALENEMLLRIKQQGLDITPKILIVTRLLPDAVGTTCGQRLEKVLGTEHTDILRVPFRTENGILRKWISRFDVWPFLETYTEDVANEIMREMQAKPDLIIGNYSDGNLVATLLAHKLGVTQCTIAHALEKTKYPNSDIYLDKFDSQYHFSCQFTADLIAMNHTDFIITSTFQEIAGSKDTVGQYESHIAFTLSGLYRVVHGIDVFDPKFNIVSPGADMSVYFPYTETDKRLTAFHPEIEELIYSDVENSEHQFVLKDKNKPIIFSMARLDRVKNMTGLVEMYGKNAHLRDLANLVVVAGDHGKESKDREEQAEFKRMYSLIEEYKLKGHIRWISAQMNRVRNGELYRYICDTRGVFVQPAFYEAFGLTVIESMTCGLPTIATCHGGPAEIIVDGVSGLHIDPYHSDKAADILVNFFEKCKEDPTYWDKISLGGLKRIYEKYTWKLYSERLMTLTGVYGFWKYVSNLERRETRRYLEMFYALKYRSLASAVPLAVDGDSVAK

SEQ ID NO: 12777 - protein, 394 aa, Zea mays subsp. mays
LGAERRARLPPGQMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNCGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 12778 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12779 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 12780 - protein, 394 aa, Zea mays subsp. mays
  unsure (1)..(394): unsure at all Xaa locations
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELIYGVRAMAINLPGFAYRGALRARRRLXGALXGVLYXSPAARAKGVSGGGVDMMDRLIEAQDERGRHLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 12781 - protein, 394 aa, Zea mays subsp. mays
LGAERRARLPLGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 12782 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 12783 - protein, 394 aa, Zea mays subsp. mays
  unsure (1)..(394): unsure at all Xaa locations
LGAARRARLPPGEMGWPLVGGMWAFLRAFKSGKPDAFIASFVRRFGRTGVYRSFMFSSPTVLVTTAEGCKQVLMDDDAFVTGWPKXTVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12784 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGISGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12785 - protein, 394 aa, Zea mays subsp. mays
LGSARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFINRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 12786 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 12787 - protein, 394 aa, Zea mays subsp. mays
  unsure (1)..(394): unsure at all Xaa locations
LGAERRARLPPXDMGWPLVGGMWAYLRAXKSGKPDXFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12788 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVNMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12789 - protein, 394 aa, Zea mays subsp. mays
LGAARRARLPPGEMGWPLVGGMWAFLRAFKSGKPDAFIASFVWRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12790 - protein, 394 aa, Zea mays subsp. mays
LGSARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12791 - protein, 394 aa, Zea mays subsp. mays
  unsure (1)..(394): unsure at all Xaa locations
LGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFINRTVTSSLRAWADHGGSVEFLTELRRMTFKIIVQIFLGGADQATTRALERSYTELNYGMRAMAINLPGFAYRGALRARRRLVAVLQGVLDERRAARAKXVSGGGXDMMDWLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12792 - protein, 394 aa, Zea mays subsp. mays
LGSARRARLPPGEMGWPLVGGMWAFLRAFKSGKPDAFIASFVRRFGRTGVYRSFMFSSPTVLVTTGEGCKQVLMDDDAFVTGWPKATVALVGPRSFVAMPYDEHRRIRKLTAAPINGFDALTGYLPFINRTVTSSLRAWADHGGSVEFLTELRRMTFKIIVQIFLGGADQATTRALERSYTELNYGMRAMAINLPGFAYRGALRARRRLVAVLQGVLDERRAARAKGISGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12793 - protein, 394 aa, Zea mays subsp. mays
LGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12794 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGALDERRAARAKGVSGGGVDMMDRLIEAQDERGRHLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12795 - protein, 394 aa, Zea mays subsp. mays
  unsure (1)..(394): unsure at all Xaa locations
XGAXRRARLPPGEMGWPLVGGMWDFLRAXKSGXPDXFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12796 - protein, 394 aa, Zea mays subsp. mays
  unsure (1)..(394): unsure at all Xaa locations
LGAARRARLPPGEMGWPLVGGMWAFLRAFKSDKPDAFIASFVRRFGRTGVYRSFIFSSPTVLLTTPEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPSFAYRGALRARRRLVAVLQGVLDERRXARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12797 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGISGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12798 - protein, 394 aa, Zea mays subsp. mays
  unsure (1)..(394): unsure at all Xaa locations
XGXARRARLPPXEMGWPLVGGMWDFLRAYKSGMPDTFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12799 - protein, 394 aa, Zea mays subsp. mays
LGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12800 - protein, 394 aa, Zea mays subsp. mays
LGAERRARLPPGEMGWPLVGGMWDFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRPMAINLPGIAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 12801 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 12802 - protein, 394 aa, Zea mays subsp. mays
LGSARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12803 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 12804 - protein, 394 aa, Zea mays subsp. mays
  unsure (1)..(394): unsure at all Xaa locations
LGAERRARLPPGEMGWPLVGGMWDFLRAXKSGKPDXFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12805 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTSL

SEQ ID NO: 12806 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFMKMEYLSQVIDETLRLVNISFVSFRQATRDVFVNGYLIPKGWKVQLWYRSVHMDPQVYPDPTKFDPSRWEGHSPRAGTFL

SEQ ID NO: 12807 - protein, 394 aa, Zea mays subsp. mays
LGAERRARLPPGEMGWPLVGGMWDFLRAYKSGKPDTFIDSFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 12808 - protein, 394 aa, Zea mays subsp. mays
LGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERCSARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12809 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLTPKGWKVQLWYRSVHMDPQVYPDPTKFDPLRWEGHSPRAGTFL

SEQ ID NO: 12810 - protein, 394 aa, Zea mays subsp. mays
  unsure (1)..(394): unsure at all Xaa locations
LGAERRARLPPGEMGWPLVGGMWDFLRAXKSGKPDXFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVNMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAXTFL

SEQ ID NO: 12811 - protein, 394 aa, Zea mays subsp. mays
LGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLSLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12812 - protein, 394 aa, Zea mays subsp. mays
LGAERRARLPPGEMGWPLVGGMWAFLRAFKSGKPDAFIASFVRRFGRTGVYRSFMFSSPTVLVTTAEGYKQVLMDDDAFVTGWPKATVALVGPRSFVAMPHDERRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQDVLDERRAARAKGVSGGGVDMMDRLIEAQDERGRHLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 12813 - protein, 394 aa, Zea mays subsp. mays
LGSARRARLPPGEMGWPLVGGMWAFLRAFKSGKPDAFIASFVRRFGRTGVYRSFTFSSPTVLVTTAEGCNQVLMDDDAFVTGWPKATVALVGPRSFVPIPHDEHRRIRKLTAAPINGFDALTGYLPFIDRTVTSSLRAWADHGGSVEFLTELRRMTFKIVVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12814 - protein, 394 aa, Zea mays subsp. mays
LGAERRARLPPGEMGWPLVGGMWAFLRAFKSGKPDAFIASFVRRFGRTGVYRSFMFSSPTVLVTTAEGRKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 12815 - protein, 394 aa, Zea mays subsp. mays
LGAERRARLPPGEMWWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGISGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12816 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYHGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 12817 - protein, 394 aa, Zea mays subsp. mays
  unsure (1)..(394): unsure at all Xaa locations
LGSARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDRTVTSSLRAWADHGASVEFLTEIRRMTFKIIVQIFLXGADQATTRALERSYTELNYRMRTMAIHMTDFAYRGALRARRRIVTVMQGVLDERRAARAKGVSGGGVDMMDRLIEAQDERGRRLDDDEIIDVLVMYLNAGHESSGHITMWATVFLQENPDMFARAKAEQEAIMRSILSSQRGLTLRDFSKMEYLSQVIDETLRLVNISFVSFRQATRDVFVHGYLIPKGWKVQLWYRSVHMDPQVYPDPTKLYPSRWEGHSPRPGTFL

SEQ ID NO: 12818 - protein, 745 aa, Pseudomonas fluorescens
MNPQDKEAFEELLANCADEPIRFPGAIQPHGLLLTLSEPDLSIIQISANVETLLARPAQELIGQPLQSLIGDAHAAQVREALQQAALSDAPPLHFRLNGTAFEGLLHRHQDVLILELEIHVENFQPRNVAGTETHLGRMLARLQKAQSLQALYDISVKEIQAMTGYDRVLIYRFEEEGHGQVIAEASDPSMEVFNGLFFPASDIPEQARELYRTNWLRIIPNADYQPVPLVPKLRPDTQTPLDLSFATLRSVSPIHCQYMKNMGVLSSMSISLLKGDKLWGLISCGNRQPLHVPHELRTACQTIGQVLSLQISAMEALEVSRQREEKLEALALLNQAMIDSPQNVFDGLANQPQVLMALANAGGIAIIEDKQLHRYGNCPEPEEIRALHKWLQERGEPVFASHHLASVYPPAAHYQQVASGVLAMSLPKPVDNGVLWFRPEVKENINWSGDPRKPLDLENSDAGLRLRPRTSFEIWKVEMAGISTKWSHGDLFAANDLRRSALENDLARQVRREQEAVRARDELVAVVSHDLRNPMTVISMLCGMMQKAFSSDGPHTSRRISTAIDTMQQAAGRMNTLLEDLLDTSKIDAGRYTIAPQKLDVAQMFEEAQSLLAPLALDKDISISFEADPDLSIHADPERLFQVLSNLVGNAIKFTPRLGTVDVYAKSVGDDIVFTVRDSGEGIPKDHLPHVFDRYWTVKEGNPTGTGLGLYITQGIVEAHGGQIVAESEPGQGSEFRFTVPRLD

SEQ ID NO: 12819 - protein, 748 aa, Pseudomonas putida
MTADNSLADAMERCAQEPIQVPGSIQPHGFLLVLDATDLRVLQASENVEHWLGLPARELIGCHFADLVHEGFDLHAHLTRLPEDEVFPFHIGDVRLRQGAPISALLHMLVHCHDQVLIAEFEPPRLPADLVGQGDYYPLVRSFVASLQVASSIEDLLQQTVLQLKRITGFGRVKAYRFDAEGNGQVLAEVVDPGYPSYAGLCFPAADIPRQARELYRVNRIRVIEDANYQPSPLLPATNPRTGKPLDMSFAALRSVSPVHLQYMRNMGTLASMSLSIVVDGQLWGLISCHHQQPRPVDLRTRTACELLASVLSLQIESRESHASTRKLLTLRQHIVRMISSMADHDSVSDGLRDLPEVLLAFADAQGAAVISAERCDLIGQTPPEAQVTALVHWLGQRDEDKVFHSDNLRRDITELPELANHAGGVLAVAISQIHSHYLLWFRPEQIRTVNWAGQPTKQVGPQGNLDPRHSFERWQEEQRGYSQAWDPLVIEGVIELRAAVLGIVLRKAEELAQLAGELRRSNKELEAFSYSVSHDLRAPLRHIAGYTELLGEIEGQGLSERGKRFLQHIGEAAHFAGSLVDNLLNFSQMGRSALRLSDVDLNALVEAIRSELAPDYEGRAIVWDIAPLPKVIGDPAFINMALHNLIANAIKYTRGRTPARIEISAVQHPEETEVCIRDNGVGFDMAYANKLFGVFQRLHRMEDFEGTGIGLASVRRIIERHDGRVWATGQVDQGASFHFTLPRNTAT

SEQ ID NO: 12820 - protein, 271 aa, Arabidopsis thaliana
MDYDPNTNPFDLHFSGKLPKREVSASASKVVEKKWLVKDEKRNMLQDEINRVNSENKKLTEMLARVCEKYYALNNLMEELQSRKSPESVNFQNKQLTGKRKQELDEFVSSPIGLSLGPIENITNDKATVSTAYFAAEKSDTSLTVKDGYQWRKYGQKITRDNPSPRAYFRCSFSPSCLVKKKVQRSAEDPSFLVATYEGTHNHTGPHASVSRTVKLDLVQGGLEPVEEKKERGTIQEVLVQQMASSLTKDSKFTAALATAISGRLIEHSRT

SEQ ID NO: 12821 - protein, 497 aa, Emericella nidulans
MKPTQVLRLAVAAPDVNPQTRKARSIPVLNPFDLYGRVFFFSWIGFLVAFLSWYAFPPLLSVTIKKDLHMSQDDVANSNIVALLGTFVMRFIAGPLCDRFGPRLVFVGLLICGAVPTAMAGLVTTPQGLIALRFFVGILGATFVPCQVWCTGFFDKNIVGTANSLAGGFGNAGGGITYFVMPAIYDSFVHDRGLTPHKAWRVSYIVPFIIIVSIALAMLFTCPDTPTGKWADREKTSGQSIVDLSSTPNASSANSINISSDEKKAVHPEVTDSEAQVHVRAGQIESSDAVIEAPTIKRYLSIALDPSALAVAVPYACSFGAELAINSILGAYYLLNFPLLGQTQSGRWASMFGLVNVVFRPMGGFIADLIYARTNSVWAKKMWLVVLGLAMSGMAILIGFLDPHRESVMFGLVVLMAFFIAASNGANFAIVPHVHPSANGIVSGIVGGMGNFGGIIFAIVFRYNGTQYHRSLWIIGFIILGCTLFFSWVRPVPKQNH

SEQ ID NO: 12822 - protein, 246 aa, Brassica oleracea
MESFSSFFDSQPGSRSWSYESLKNLHQISPSVQNHLKRVYLTLCCALVASAFGAYLHVLWNIGGILTTIACCGTMIWLLSCPPYEQQKRLSLLFLSAVLEGASVGPLIKVAVDFDPSILITAFVGTAIAFICFSGAAMLARRREYLYLGGLLSSGLSMLMWLQFASSIFGGSASIFKFELYFGLLIFVGYMVVDTQEIIEKAHLGDMDYVKHALTLFTDFVAVFVRVLIIMLKNSADKEEKKKRRN

SEQ ID NO: 12823 - protein, 193 aa, Brassica oleracea
MQDQLVCHGCRNTLMYPRGATNVRCALCHIVNMVPLHPHPPPPPPPHHAHAGMDMAHIVCGGCRTMLMYTRGASSVRCSCCQTVNLVPGPPPSNQVAHINCGNCRTTLMYPYGASSVKCAVCQFVTNVNMSNGRVPLASNRPNGTAAPGTMPSTSTSTPPSQTQTVVVENPMSVNESGKLVSNVVVGVTTGQK

SEQ ID NO: 12824 - protein, 193 aa, Brassica oleracea
MQDQLMCHGCRNTLLYPRGATNVRCALCNTINMVPLHPPPPPPHHAHAGMDMAHIVCGGCRTMLMYTRGASSVRCSCCQTVNLVPATPPTNQPAHVNCGNCRTTLMYPYGAPSVRCAVCQFVTNVNMGNGRVPFPTNQPNGTASSPGPMPSTSTQSTPPSQTQTVVVENPMSVNESGKLVSNVVVGVTTDKKK

SEQ ID NO: 12825 - protein, 270 aa, Pyrus caucasica
AHYKSEADVGEAFAEAFKTGLIKREELFITTKIWNSDHGHVVEACKNSLEKLQLDYLDLYLVHYPMPTRHNAIGKTASLLGEDKVLDIDVTISLQQTWEGMEKTVTLGLVRSIGLSNYDLFLTRDCLAYSKIKPAVSQFETHPYFQRDSLVKFCIKHGVLPTAHTPLGGAAANKDMFGSVSPLDDPILNDVAKKYGKSVAQICLRWGIQRKTAVIPKSSKIQRLKENLVVLEFQLSDEDMQLIYSIDRKYRTSLPSKTWGLRRVCKGEFV

SEQ ID NO: 12826 - protein, 433 aa, Rattus norvegicus
MLELIEVNGTPGSQLSTPRSGKSPSPSPTSPGSLRKQRISQHGGSSTSLSSTKVCSSMDENDGPGEEESDEGFQIPATITERYKVGRTIGDGNFAVVKECIERSTAREYALKIIKKSKCRGKEHMIQNEVSILRRVKHPNIVLLIEEMDVPTELYLVMELVKGGDLFDAITSTSKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELINMMLLVNVDQRFSAVQVLEHPWVNDDGLPENEHQLSVAGKIKKHFNTGPKPSSTAAGVSVIATTALDKERQVFRRRRNQDVRGRYKAQPAPPELNSESEDYSPSSSETVRSPNSPF

SEQ ID NO: 12827 - protein, 506 aa, Brucella melitensis 16M
MVMSTIVKPQPLTGLEVREFSMLIDGKWVGSDSGKSIERVAPGHGVTVSRYPAGNKANVERAVSAARKAFDDGRWSSKTASQRSLVLLKAADLIEARAEELAYLDAIEAGKPISQVRGEISGSVDIWRYAAALARDLHGESYNTLGDGTLGVVLREAIGVVSIITPWNFPFLIVGQKLPFALAAGCTAVVKPSELTSGSTLLLGEILAEAGVPDGVVNIVTGTGADVGQHMSTHPHVDMVSFTGSTGVGKLTMANAAQTLKKVSLELGGKNPQILFPDADMDAFIDAAVFGAWFNAGECCNAGSRLIVHRSVVDAIVGRVADLSKKVIVGDPLDASTQVGAIITPQHLTKVGAYVDQARKAGAAIAHGGEVLDLGLGQYMGPTILAGVKADMAVAREEVFGPVLSVLSFDTVEEAISIANAVDYGLSAGVWSRDFDTCMTIGRKVRAGTVWMNTFMDGTPELPFGGYRQSGLGRELGRHAVEDYTETKTLNMHIGARTGWWMPQAK

SEQ ID NO: 12828 - protein, 254 aa, Brucella melitensis 16M
MGEFAVVTGGSTGIGRHLVSAFADAGYAVAFSYRHDDDAAQSLVEAIEEAGGQALGLGCDVGRRAEVEAFFDEACDWFGDAPDVLVNNAGIQTWAPLLELSEEGWDDVIRTNLKGCFLNTQAAAKRMVEADKGGAIVNIGSGCNKLAFPKLVSYTASKGGIEQLTKASAVELGPHGIRVNCVAPGAILNERTAQEQPDYAQSWAPITPLRRVGVPEDISGPVLFLVSDEARFVTGQTLWVDGGLFSQANWPYDG

SEQ ID NO: 12829 - protein, 421 aa, Brucella melitensis 16M
MNHFEYRNGVLHAENVSLPEIAKAVGTPFYVYSRATIERHFRVFHDAFADMDTLVTYALKANSNQAVLTALAKLGAGADTVSQGEIRRALAAGIPANRIVFSGVGKTPREMDFALEAGIYCFNVESEPELEILSARAVAAGKVAPVSLRINPDVDAKTHAKISTGKSENKFGIPRDKARAAYARAASLPGLNVVGIDMHIGSQIIDLEPFDNAFALMAELVKELQADGHNIRHVDVGGGLGIPYRTPNTPPPPPVAYAQIVAKHIKPLGLKTVFEPGRLIVGNAGLLVTEVIFVKEGDAKNFVIVDAAMNDLIRPTLYDAFHDIRPVIMPNDNAPRIRADFVGPVCETGDYLGLDREVAKPAPGDLIAICTTGAYGAVLSSTYNSRLLIPEVLGDGERYHVVRPRRTYEELLALDSVPDWL

SEQ ID NO: 12830 - protein, 319 aa, Brucella melitensis 16M
MSPEQENQMKPSSMSSSSTVPANRMPMAVRSFPAAAASSQSMIRSAMSAPYLEREEERALAIRWKETKDQDALHRITSAHMRLVISMAGRFRKFKLPMSDLIQEGYVGLLEEAARFDPDRDVRFSTYASWWIRASMQDYILRNWSIVRGGTSSAQKVLFFNLRRLRSKLAQTDDNMTKAEIYREISDQLGVSTSDVEFMDSRLSGPDSSLSASMNGEETGASRRMDFLVDDHPLQDEIAESSIDMERRNRWLTRALDTLNERELHIIRERRLDDDGVTLEALGEKLGISKQRVRQIESRAMEKLKIALLSQHELAAYQA

SEQ ID NO: 12831 - protein, 303 aa, Brucella melitensis 16M
MAQMKLPSITSGDGGLTRYLEEIRRFPMLEPQEEYMLAKRYHEHADPKAAHKLVTSHLRLVAKIAMGYRGYGLPIGEVISEGNVGLMQAVKRFEPERGFRLATYAMWWIKASIQEYILRSWSLVKMGTTANQKRLFFNLRKMKSKIQALDDGDLNPDQVKQIATKLNVSEDEVVSMNRRLSGDASLNAPLRASEGESGEWQDWLVDDSNSQEQVLIEQDELESRRSMLEQAMETLNDRERHIFEARRLAEEPMTLEDLSGEFGISRERVRQIEVRAFEKVQAAVKAAAHKQQKALNHIEEAHV

SEQ ID NO: 12832 - protein, 487 aa, Brucella melitensis 16M
MLALKDPSLLKSQCLVNGRWIDAADGTTIKVTNPADGSVIGTVPSLSVATIKEAIDASAKALSGWAAKTAKERAGILRKWFDLIIANADDIALIMTSEQGKPLAEARGEVLYAASFIEWFAEEAKRVYGDTIPAPQNGQRLTVIRQPVGVTAAITPWNFPAAMITRKAAPALAAGCTMIVRPADLTPLTALALGILAEKAGIPAGVLQIVTGKAREIGAELTSNDTVRKLSFTGSTEVGRLLMAQCAPTIKRISLELGGNAPFIVFDDADLDAAVDGAMVSKYRNAGQTCVCANRIYVQRGVYDKFAEKLAAKVKELKVGNGTEPGVVIGPMIEEKAITKVKAHIEDAVSKGAKLITGGKELGGLFFEPGILTGVTSDMLVAKEETFGPLAPLFAFDTEEEVIAQANDTIFGLAAYFYTENFSRAIRVSEALEYGMVGHNTGLISNEVAPFGGVKQSGLGREGSKYGIEEYLETKYICSAYKRGAKK

SEQ ID NO: 12833 - protein, 264 aa, Brucella melitensis 16M
MAYDAFAEFRMTGHNVIITGGAQNIGAGIAKTLSGAGAKVMIADLNGDKARQTAAAIQKETGNECHGMKCDVTSLSDIEQVVRETVSAFGGISTLVNNVGWGGRHEDPTAITEEDFIAAYKLNTISAYRMSMACLPHLLKSQNATITNSGSFSSAVPAYDILAYGTAKAALNQMMVSLAHMLAKKVRINSVLIGTVMTEGYGSAGIDEEMQEKLRHPDNLTGRAGRPEDIANTMLWLCSPASGWVSGQTINVHGGGGVTRLFGR

SEQ ID NO: 12834 - protein, 304 aa, Brucella melitensis 16M
MGADPVYGLPGFGDHEGRTPFKRLQVSDIVAIRTPVRITPDRKAFWRKYMSYESPFHLNDAVAIVTGAAAGIGRAIAGTFAKAGASVVVTDLKSEGAEAVAAAIRQAGGKAIGLECNVTDEQHREAVIKAALDQFGKITVLVNNAGGGGPKPFDMPMSDFEWAFKLNLFSLFRLSQLAAPHMQKAGGGAILNISSMAGENTNVRMASYGSSKAAVNHLTRNIAFDVGPMGIRVNAIAPGAIKTDALATVLTPEIERAMLKHTPLGRLGEAQDIANAALFLCSPAAAWISGQVLTVSGGGVQELD

SEQ ID NO: 12835 - protein, 813 aa, Brucella melitensis 16M
MPLPDNAEAVLEEILPEQGDAPAQQAQKTHAEQPRPKTFAFDHDAPPARFIWKVGPDGTFSEISPDLAAVVGPNSADIVGRRFSDVANVFGFDTDGSIAALLLERDTWSGKRLLWPVEGTRLRVPVELAALPVYSRDREFLGFRGFGIVRPAEAEADPEEIGLALAGGIPQNRKPRKEPAETARMVGEDDVLALSEEVANDDHPAAVLPKPPLDITPTPGRRDSDKVISLLNSCAQEKVAANQAKFLKEKERATRPEGGLTKTERNAFREIAERLRKQGLANTRAESETPVSETSSIEPVEPTPPVKTRSEPIQPDETALLANLPVPVIIHSGDAIHYVNQALLDITGYESLDDIRSAGGVDVLFNSESDDGETRQSMVLRHADGSEEPVDAHLNAIAWRGGRALMLSLMPVTAADLPAPAELPAANDEEKQALEAHVEELKTILDTATDGVVLIDPEGRIRSMNHSASALFGYERDEAEGKFFSMLFAIESQRAAMDYLHGLSGNGVLSVLNDGREVIGREAKGGFIPLFMTIGKLPHTRGFCAVLRDITQWKRTEEELTNARKEAERASNQKTEFLARISHEIRTPLNAIIGFSELMADEKFGPIGNDRYRDYLRDINRSGNHVLALVNDLLDISKIEAGALDMQFEAVSLNDAIGEAIALMQPQANRERVIIRSSFQSNLPDIVADSRSIKQVALNLLSNAVRFTAPGGQVIVSTSYELNGDVVMRVRDTGIGMSKSEVEQALKPFRQINALERRKAESAKDWRNEGTGLGLPLTKAMVEANRAQFAIDSNPGQGTVVEIVFPPTRVLAD

SEQ ID NO: 12836 - protein, 672 aa, Brucella melitensis 16M
MATKVKENEEAEVEREGAADGPLLDLSDDAVKKMIKLAKKRGYVTMDELNAVLPSEEVTSEQIEDTMSMLSDMGINVVEDDEQDNDREEGNDDEAEEGGDLVEAGGTAVATTTTKKEPTDRTDDPVRMYLREMGSVELLSREGEIAIAKRIEAGRETMIAGLCESPLSFQAIIIWRDQLNESNILLREIIDLETTYAGPEAKQAPVIERVEEEKPRDERPQRRSRDDDDITNVGGDMPVEDDDDDEDEANLSLAAMEAELRPQVMETLDFIADTYKKLRKLQDQQVEGRLAATGELSSSQERRYKELKDQLIKAVKSLSLNQNRIEQLVEQLYDINKRLVQNEGKLLRLAESFGVRREDFLKEYQGHELDPNWVERVATLPSRGWKEFAAKEADSIGRLRSEIQNLATETAISIGEFRRIVNQVQKGEREATIAKKEMVEANLRLVISIAKKYTNRGLQFLDLIQEGNIGLMKAVDKFEYRRGYKFSTYATWWIRQAITRSIADQARTIRIPVHMIETINKIVRTSRQMLHEIGREPTPEELAEKLAMPLEKVRKVLKIAKEPISLETPVGDEEDSHLGDFIEDKNALLPIDAAIQANLRDTTTRVLASLTPREERVLRMRFGIGMNTDHTLEEVGQQFSVTRERIRQIEAKALRKLKHPSRSRKLRSFLDS

SEQ ID NO: 12837 - protein, 328 aa, Brucella melitensis 16M
MAKTAEQHPHGLDRILTLELVRVAERAAVAAARLRGRGDEMAADQAAVDAMRQELNRLPITGTVVIGEGERDEAPMLYIGEEVGTKQGAAVDIALDPLEGTTICAKNLPNSLAVIAIAEKGNLLYAPDVYMEKIAVGPGYPKGVVDLDATPTDNIMSIAKAKGVKPNEITACIMDRPRHARLIEEVRATGAAIRLIGDGDVAGVMHTTDPDETGIDIYIGIGGAPEGVLAAAALRCIGGQMQGRLQLNTEEKVARAAKMGISDPKKIYTLEEMAKGDVLFAATGVTDGNMLSGVKFARDYIQTHTIVMRSSSQTVREIKARHQDLSKF

SEQ ID NO: 12838 - protein, 296 aa, Brucella melitensis 16M
MRCDWRKFDFCRTCTMQNWSMDMSVRMSSKVNAGLDQVDPIWHSIRAEAEEATRNDPVLGAFLYATILNQPSLEEAVMHRIAERLGHPDVSADILRQTFDTMLEANPEWSHVLRVDIQAVYDRDPAYSRFMDPVLYLKGFHAIQTHRLAHWLYKQGRKDFAYYLQSRSSSIFQTDIHPAARLGSGLFLDHATGLVVGETAVVEDNVSILHGVTLGGTGKSSGDRHPKIRQGVLIGAGAKILGNIQVGQCSKIAAGSVVLKSVPHNVTVAGVPARIIGETGCTEPSRVMDQMLGDGI

SEQ ID NO: 12839 - protein, 425 aa, Brucella melitensis 16M
MTAIIDIVGREILDSRGNPTVEVDVVLEDGSFGRAAVPSGASTGAHEAVELRDGGSRYLGKGVEKAVEVVNGKIFDAIAGMDAESQLLIDQTLIDLDGSANKGNLGANAILGVSLAVAKAAAQASGLPLYRYVGGTNAHVLPVPMMNIINGGAHADNPIDFQEFMILPVGATSIREAVRYGSEVFHTLKKRLKDAGHNTNVGDEGGFAPNLKNAQAALDFIMESIEKAGFKPGEDIALGLDCAATEFFKDGNYVYEGERKTRDPKAQAKYLAKLASDYPIVTIEDGMAEDDWEGWKYLTDLIGNKCQLVGDDLFVTNSARLRDGIRLGVANSILVKVNQIGSLSETLDAVETAHKAGYTAVMSHRSGETEDSTIADLAVATNCGQIKTGSLARSDRTAKYNQLIRIEEELDKQARYAGRSALKLL

SEQ ID NO: 12840 - protein, 461 aa, Brucella melitensis 16M
MPIEILMPALSPTMEEGKLSKWLKKEGDKVTSGDVIAEIETDKATMEVEAVDEGTIGKLLVDEGTEGVKVNTPIAVLLGDGESAADIGSAPAAKAEAAKEEPKAEENKADAVPAAPKAPAVEVASDPDIPAGTEMVSLTVREALRDAMAEEMRRDPDVFIMGEEVAQYQGAYKITQGLLDEFGPKRVVDTPITEHGFAGVGVGAAFAGLKPIVEFMTFNFAMQAIDQIVNSAAKTLYMSGGQMGAPMVFRGPSGAAARVAAQHSQCYAAWYSHIPGLKVVMPYTAADAKGLLKAAIRDPNPVIFLENEILYGHHFDVPKLDDFVLPIGKARIHKQGKDATIVSFGIGMTYAVKAAEELAGQGIDVEIIDLRTIRPMDIATVVESVKKTGRLVTVEEGFPQSSVGTEIATRVMQQAFDYLDAPILTIAGKDVPMPYAANLEKLALPSVAEVVEAVKAVTYTA

SEQ ID NO: 12841 - protein, 112 aa, Brucella melitensis 16M
MKKIEAIIKPFKLDEVKEALQEVGLQGITVIEAKGFGRQKGHTELYRGAEYVVDFLPKVKVEVIVADETVDSAIEAIRKAAQTGRIGDGKIFVSNIEEVIRIRTGESGVDAI

SEQ ID NO: 12842 - protein, 783 aa, Brucella melitensis 16M
MASTDAYGAPAGTHCESGRKKRKGRLSGHVSLLAGPAYSKFIVIEPILRRLVPTLIIIFLIILGVARVFSLLAWRDDIELQHKAALSGATAHLAQMIERVANGIETGAQLSAKDLQDAMTELRSRGLTSSGMTIAIVDAQSMIKAASGPAGIAGSQIDTILGDAQPLFLFAERAGVLRVVLQGEAAFGALAKPMTAPYSIIAVEPESTIFAEWKRAVSLNVTLFAGTIGVMFAILYAYFSQAARAREADDLSGQIQRRIDMALARGRCGLWDWDMARGRIYWSRSMYEMLGYEAQDAVLPFGDVAAIINEEDGDLYSIAEQAAAGDISHVDRVFRMRHADGSWVWMRVRAEIASEGDLHLVGIAFDVSEQHRFAQQTAEADMRIREAIENISEAFVLWDANNRLVMANSKFSEYAGLPVWTLKPGVPRNEVDAHTRPFTFERRMANEHNRAGGQTFERQLSDGRWLQVNERRTQDGGMVSIGTDITQLKLHQERLVDSERRLMATVHDLSIARKGERDRVRELSELARKYSLEKERAEAANRAKSEFLANMSHELRTPLNAIIGFSEMIQAGTFGPLGSDRYEEYINDIHTSGNFLLNVINDILDMSKIEAGHFSLDREEIDLCPLINETVRIISLQAEEKNIAVETRIEDAMELYADRRAIKQVLINLLSNAVKFTSYGGRITVRARKTGAALFMTIQDTGVGIPKSALRKIGQPFEQVENQFTKTHTGSGLGLAISRSLAELHGGWLRIRSTERVGTVVSVCIPDRNPAPNAGHDARTHAA

SEQ ID NO: 12843 - protein, 435 aa, Brucella melitensis 16M
MLYAASLVLRGVAVARKPVQISVAAPQVAVAAGDMQFGLDIEGIVSSVDGETAKLLGVQPKMLEGTALIDRVHVADRVQYLSLLADLRAGMATRKVDVRLRSIENGNPVFRAYRFEGAGSDRAITLIGRSLEGEQKLLDEIAMLKAELESERIGKGRLLATVSHELRTPLNSIIGFSDMLTHEIGGKLASDRQREYAGLIHQSGHYLLELVNAVLDNSRLETGTYSIAPQSFVFRDAVEMCTAVMLPQAEKKGVDFCHRVGNGVGELVADRRAVQQILLNLATNAVKFTQSGGCVTIDAARVMADGCPMLEFSVSDTGIGIEPEDLQRIGTPFVRAGNSYTQAQEGSGLGLSVVKGLVERHQGSMQLKSRPGEGTVVMIRLPLAGPQYRAGEEQQELGTVIDMYRHQGERRNDWQKDEIRDQSPEQPHAQTRKTA

SEQ ID NO: 12844 - protein, 500 aa, Brucella melitensis 16M
MPYCPIALHKETTMKAQPKASHFIGGAFVEDKAGKPLPVIYPATGEEIASLYSATPGIIEAAYAAALKAQGEWAALKPVERGRILRRTAEILREKNRKLSKLETLDTGKALQETLVADAASAADALEFFGGIISGFNGEFVELGGSFAYTRREALGICVGIGAWNYPIQIAAWKSAPALAMGNAFIFKPSENTPLSALALAEAYKEAGLPDGLFNVVQGYGDVGAALVNHRLTAKVSLTGSVPTGRRIMAQAGEQLKHVTMELGGKSPLIVFDDADLESAIGGAMLGNFYSTGQVCSNGTRVFVHKNIRERFIERLVERTRKIRIGDPFDEATQMGPLISAAQRDKVLSYIKKGKAEGATLACGGGVPKLQGFDKGFFIEPTVFADVTDTMTIAREEIFGPVMSVLEFSDEDEVIARANDSEFGLAAGVFTADLSRGHHVIGQIKAGTCWINAYNLTPVEVPFGGYKQSGIGRENGIAALAHYSQIKTVYVEMGKVDSPY

SEQ ID NO: 12845 - protein, 372 aa, Brucella melitensis 16M
MRIGVDARNLVNNITGISRYVMENCRELYERGHELVLYTPEKPRVQLSSSEGFDFRVSNFQGPAGRLFWSQTVLPLQLRKDRIDVFWGPAHRLPALKGAIPSVVSIHDLVWYYASSTMRLQGWLADRFLMKGALRNADQIVAVSYATSSAISSVFPQYTSKIQMVYPGVSHFNRIGTSNILKEHRINKSYGLFIGTLEPRKNLIRLLEAYANLPECVRNNFLLVVAGGKGWNLGDIGKTINRLGIAEYTRLTGYVTDSDLNDLYRNARTLLMPSLYEGFGLPIIEAQAYGVPVITSNCSSMPEVAGDAAILVDPLNVAEISNALYRIATDNKLWQRKSLLALQNIERFNWHNSIEKLESVFIKARESKLMTY

SEQ ID NO: 12846 - protein, 930 aa, Brucella melitensis 16M
MSRPDFFGWPSASDRISNASRFRECLQQLQVFREPCPVSREAGMAKWVYTFGDGKAEGAASDRNLLGGKGANLAEMSSLGLPVPPGFTITTEVCTYYYNNDRVYPSELDAQVQAALAHIATLTGRNFGDAEKPLLVSVRSGARASMPGMMDTVLNLGLNDETVQAIARESGDERFAYDSYRRFIQMYSDVVLGVDHGFFEEILEDTKADLGVEVDTALSADDWKNVIGLYKAKVEEELGQPFPQDPREQLWGAIGAVFSSWMNARAITYRRLHNIPAAWGTAVNVQAMVFGNMGETSATGVAFTRNPSTGENKLYGEFLVNAQGEDVVAGIRTPQNITEEARIAAGSDKPSLEKVMPEAFAEFLKVANRLEQHYRDMQDLEFTIERGKLWMLQTRSGKRTARAALKMAVEMAAEGLISEEEAVLRIDPAALDQLLHPTIDPRAERQVVGMGLPASPGAATGEIVFSSEEAEQAKAEGRNVILVRIETSPEDIHGMHAAEGILTTRGGMTSHAAVVARGMGKPCVSGAGSLRVDYRNGTMLAAGQTFRKGDVITIDGASGQVLKGSVAMLQPELSGDFGKLMEWADRARRMKVRANAETPADARTARSFGAEGIGLCRTEHMFFDGSRIVAMREMILSDTEEGRRLALGKLLPMQRSDFAELFEIMKGLPVTIRLLDPPLHEFLPHTDEEVDEVARSMGVDAAKLRDRADALHEFNPMLGHRGCRLAVSYPEIAEMQARAIFEAAVEAGKKTGEPVVPEVMVPLVSLKAELDFVKARIDAVAKEVMSEAGIKIDYMVGTMIELPRAALRAAEIAESAEFFSFGTNDLTQTTFGISRDDAAGFLTTYQNRVVIEQDPFVSLDVDGVGELVQIAAERGRKTREKIKLGICGEHGGDPASIAFCEKTGLDYVSCSPFRVPIARLAAAQAAVRKV

SEQ ID NO: 12847 - protein, 245 aa, Brucella melitensis 16M
MFDLTGRKALVTGATGGLGEAIARALHAQGAIVGLHGTREEKLKELAAELGERIFVFPANLSDREAVKALGQKAEEEMGGVDILVNNAGITRDGLFVRMSDEDWDAVLTVNLTSVFNLTRELTHPMMRRRNGRIINITSIVGVTGNPGQANYCASKAGLIGFSKSLAQEIASRNVTVNCIAPGFIESAMTGKLNEKQKDAIMGNIPMKRMGVGADIAAAVVYLASDEAAYVTGQTLHVNGGMAMI

SEQ ID NO: 12848 - protein, 643 aa, Brucella melitensis 16M
MSRPSTPLLDKAPTPDRLRALPEQDLPQLAEELRTELIDAVSTTGGHLGAGLGVVELTVALHHVFNTPYDRIIWDVGHQAYPHKILTGRRDRIRTLRQAGGLSGFTKRAESEYDPFGAAHSSTSISAGLGMAVASELSGEKRNVIAVIGDGSMSAGMAYEAMNNAGALDARLIVILNDNDMSIAPPTGAMSAYLARLVSGRTYRSVREAAKQVAQKLPKFLQDKARKSEEYARAFFTGGTLFEELGFYYVGPIDGHNLDHLLPVLKNVRDTQKGPVLIHVVTQKGKGYAPAEAAADKYHGVNKFDVITGKQAKPPANAPSYTKIFGTSLIEEARHDDKIVAVTAAMPTGTGLDLFGEAFPKRVFDVGIAEQHAVTFAAGLASEGYKPFCAIYSTFLQRGYDQVVHDVSIQNLPVRFPIDRAGLVGADGPTHAGSFDTGFLAALPGFVVMAASDEAELRHMVRTAAEYDEGPISFRYPRGDGVGVDLPERGSVLEIGKGRIVREGTKVALLSFGTRLQECLAAAEELGAAGLSTTVADARFAKPLDHDLIRRLAREHEVLVMVEEGAVGGFGSHVLQFLATDGLLDRGFKVRALTLPDIYQDHGKPDAMYAEAGLDRTGIVRTVFAALHRDELGHEALPTPFRA

SEQ ID NO: 12849 - protein, 315 aa, Brucella melitensis 16M
MFLERWECVHEFFPCADPVLGDKTSVDSIETLVIPRTSDIGGLEVRRALPTARRRLVGPFIFFDRMGPAILRDGEALDVRPHPHIGLSTVTYLFDGHIRHRDSLGTEMVIRPGDVNLMTAGRGIVHSERSPEEERAGPMPVSGVQTWLALPDAMEEIDPAFHHINAPDLPLMDDAAFSGRLIIGSLHGLSSPVIQHAETLYADIRIHQGGRFQIPPTTEERAIYTLEGNVGIGGEVFPPDRLLAFRPGDDIVVQAGPKGAHIMLFGGAPLGSRRYIWWNFVASSKERIEQAKEEWRTGRFDIVPGDEQDFIPLPE

SEQ ID NO: 12850 - protein, 471 aa, Brucella melitensis 16M
MDGTFDAGFREPTISKANRWGREMVVALKLGWPLIFTNLSQAALTATDVIFIGRLGADTLASALLATSFYHTLMIFSMGLVSAVMPMIAIALGKNRHSVRDVRRTVRQGFWSAIMIVIPLWVVLWHCEEIFLFLGQRPDIAARSTDFMHTLQWALLPYLFYIVLRSFFAAMEKPMWTLLVAALAIGFNALAGWTLIFGHFGFAPMGLHGAGMATTASSTMMFLGLAFITLRHPRFRRYHLFGRFWRPDWPRLIELWRIGLPMALTFVFETSIFYAAVVMMGRIGPTAMAAHAVAIQIASLSFMVPLGFGQVATVRVGRAYGRGDPKAIAYAGWSAYALGVGFMALMGILMVLMPRVFIGIFLNLNDPQNLPVMELAVTFLALAALFQIVDGAQAVAAGMLRGLRDTRIPMLLALFGYWGVGLPLGAVLAFQFGMGGVGIWLGLAAGLGMVAVLMTIRWRRHLAHVSAVAAA

SEQ ID NO: 12851 - protein, 477 aa, Brucella melitensis 16M
MTFHQNLIAGEWVGGDDIANINPSDTNDVVGTYARATAEDTKAAIAAAKAAFPAWSRSGILERHAILRKTADEILARKEELGRLLSREEGKTLVEGIGETIRASQIFDFFAGECLRLAGEVLPSARPGIGVEVTREPVGVVGIITPWNFPIAIPAWKIAPALCYGNTIVFKPAELVPGCSWAIADILHRAGLPKGVLNLVMGKGSVVGQTILDSADVNAATFTGSTGTGKRVAAASIEHNRRFQLEMGGKNPVVVLDDADLNVAVESVVNSAFFSTGQRCTASSRIIVTEGIHDKFVAAAIEKLKTVVVDNALKPGTHIGPVVDETQLQQDMDYIELGRKEGAKLAFGGERLNRETPGFYLQPALFTEATNQMRISREEIFGPVASVIRVKDYEEALATANDTSFGLSSGICTTSLKYATHFKRNSEAGMVMVNLPTAGVDFHVPFGGRKGSSFGPREQGRYAAEFYTTVKTAYTLA

SEQ ID NO: 12852 - protein, 505 aa, Brucella melitensis 16M
MNKVEFSRTVKPAFAKRYGNFIGGKWVEPRSGRYFENTSPVNGQVLCEVARSDAADVEAALDAAHAARELWGRTSVAERALILNRIADRIEENLPALAAAETWDNGKPIRETTNADLPLAVDHFRYFAGVIRAQEGGISEIDHDTVAYHFHEPLGVVGQIIPWNFPLLMATWKLAPALAAGNCVVLKPAEQTPASILVLMELIADILPPGVVNIVNGFGLEAGKPLASSPRIAKIAFTGETTTGRLIMQYASQNLIPVTLELGGKSPNIFFKDVAAEDDDFLDKAIEGFVMFALNQGEVCTCPSRALIQESIYDRFMEKALKRVEAIVQGDPLDPATMIGAQASSEQLEKILSYLDIGRQEGAEVLAGNERNMLPGDLAGGYYVKPTVFKGHNKMRIFQEEIFGPVVSVATFKDDAEALSIANDTLYGLGAGIWTRDGTRAYRFGRAIKAGRVWTNCYHAYPAHAAFGGYKQSGIGRENHLKMLDHYQNTKNMLVSYSPKKLGFF

SEQ ID NO: 12853 - protein, 1261 aa, Brucella melitensis 16M
MASSLDDLFGATAAKPDGSEVLAALTQAARERILILDGAMGTQIQGLGFHEEHFRGDRFATCDCQLQGNNDLLTLTQPKAIEEIHYAYAMAGADILETNTFSSTSIAQADYGMEAMVYDLNRDGARLARRAALRAEQKDGRRRFVAGALGPTNRTASLSPDVNNPGFRAVTFDDVRIAYSEQIRGLIDGGSDIILIETIFDTLNAKAAVFATEEVFAEKGVRLPVMISGTITDLSGRTLSGQTPTAFWYSLRHARPFTIGLNCALGANAMRAHLDELSGIADTFICAYPNAGLPNEFGQYDETPEAMAAQIEGFARDGLVNVVGGCCGSTPDHIRAIAQAVAKYEPRKPAKVPPLMRLSGLEPFTLTKDIPFVNIGERTNVTGSARFRKLVKAGDFAAALDVARDQVANGAQIIDINMDEGLIDSEKAMVEFLNLIAAEPDIARVPIMLDSSKWEVIEAGLKCVQGKAVVNSISLKEGEEAFLHHARLVRAYGAAVVIMAFDETGQADTQARKIEICTRAYKILTEQVGFPPEDIIFDPNIFAVATGIEEHNNYGVDFIEATREIVRTLPHVHISGGVSNLSFSFRGNEPVREAMHAVFLYHAIQAGMDMGIVNAGQLAVYDTIDAELREACEDVVLNRPTKTGESATERLLEIAERFRDSGSREARTQDLSWREWPVEKRLEHALVNGITEYIEADTEEARLAAERPLHVIEGPLMAGMNVVGDLFGSGKMFLPQVVKSARVMKQAVAVLLPFMEEEKRLNGGEGRQSAGKVLMATVKGDVHDIGKNIVGVVLACNNYEIIDLGVMVPSQKILQVARDEKVDIIGLSGLITPSLDEMAHVAAEMEREGFDIPLLIGGATTSRVHTAVKIHSRYERGQAVYVVDASRAVGVVSNLLSPEGKQAYIDGLRNEYAKVAAAHARNEAEKQRLPIARARANPHQLDWENYEPVKPTFTGTKVFETYDLAEIARYIDWTPFFQTWELRGRYPAILEDEKQGEAARQLWADAQAMLRKIIDEKWFTPRAVVGFWPANAVGDDIRLFTDESRKEELATLFTLRQQLTKRDGRPNVAMADFVAPVESGKQDYVGGFVVTAGIGEIAIAERFERANDDYSAILVKALADRFAEAFAELMHERVRKEFWAYAPDEAFTPEELISEPYKGIRPAPGYPAQPDHTEKTTLFRLLDATANTGVELTESYAMWPGSSVSGLYIGHPESYYFGVAKVERDQVEDYARRKDMDVEAVERWLTPILNYVPGASKDEAA

SEQ ID NO: 12854 - protein, 330 aa, Brucella melitensis 16M
MATFDVLCIGNAIVDILARTDDVFLETNGIIKGAMNLIDAERAELLYSRMGPATEMSGGSAGNTAAGIASLGGRSAYFGKVATDHLGRVFAHDIRAQGVAFDTRPLEKGSPTARSMIFVTPDGERSMNTYLGACVELGPEDVETSKVADARVTYFEGYLWDPPRAKEAIVMASKIAHESGRQMAMTLSDPFCVDRYRDEFLQLMRSRTVDIVFANEDEAKALYKTKSLETAIAAMRMDCRLSVITRSEKGAVVVTPDQTLTVPAIEIDDLVDTTGAGDLYAAGFLYGYTKDRSLEDCARLGSLAAGLIIQQMGPRPQISLEAAASQAGLI

SEQ ID NO: 12855 - protein, 370 aa, Brucella melitensis 16M
MKSRAAVAWEAKKPLTIETVEIGGPKAGEVLVEIMATGVCHTDAYTLSGLDSEGKFPAILGHEGAGIVREVGADVTSVKPGDHVIPLYTPECRQCKTCLSQRSNLCTAIRATQGQGLMPDKTSRFSCDGGEVFHYMGCSTFSNFTVLPEIAVAKVREDAPFDKICYIGCGVTTGIGAVIYTAKVRPGSNVVVFGLGGIGLNVIQGARMVGADKIIGVDINPAKVEMARKFGMTDFINPREIGNDKVVQAIQDLTDGGADYSFDATGNTDVMRQALECCHRGWGESIIIGVAEAGKEIATRPFQLVTGRVWKGTAFGGARGRTDVPKIVDWYMEGKINIDDLITHTMPLDEINTAFDLMHEGKSIRSVVIY

SEQ ID NO: 12856 - protein, 279 aa, Brucella melitensis 16M
MVYSRFESEVVMSPDSNTDNSRPGVSSSEIPRTDTERKTLVLTGASRGIGHATVKRFSLAGWRVITCSRQDFSENCPWPAGPEDHIKVDLSDPEDIGKAIAEIRRRLEANGSKLHALVNNAGISPKAEGGRRMNSIETPMAVWRDVFQVNFMAPIMLARGLFKELEAAQGSVVNVTSIAGSRVHPFAGTAYATSKAALAALTREMASDFGPYGIRVNAIAPGEIDTAILSPGTDKLVEQLPMRRLGKTSEVAETIYFLCTEASSYVTGSEIHINGGQHV

SEQ ID NO: 12857 - protein, 394 aa, Brucella melitensis 16M
MRPWLYEMAGVTREQVLERLKTVTGPDFKSDVVSLGLVSDIFIADGKVFFSITVPAERAEALEPMRLAAEKVVKDIPGITGALVTLTAEKKGGRTSDDAPPPPRPQARPAAASQHRHPPQPRPAAKPGVPGVGAIIAVASGKGGVGKSTTAVNLALGLAANGLKAGILDADIYGPSMPRLLGLSGRPETVEGRILKPMENYGIKVMSMGFMVDEETPMIWRGPMVMSALTQMLREVAWGELDVLVVDMPPGTGDAQLTMAQQVPLAGAVVVSTPQDLALIDARKGLNMFRKVDVPLLGIVENMSYFIAPDTGTRYDIFGHGGARREAERLNVPFLGEVPLHMDVRAYSDNGTPITVKEPDSEHAKIYRDIARKVWENMKSGKGAGKPAPEIVFD

SEQ ID NO: 12858 - protein, 768 aa, Brucella melitensis 16M
MGAALLSAGWLIRDRSKIANENNELRSKFADLNLIAQRNEALLNMKDQRIVVWDGHNVRADVVGQLPDACGAPQDRPAFLAFGRWLRPQSVTALERAISTLREQARAFDLTVETVNGSLLDVHGRTSGGFAVACFQSLQGVQAERASLEAQNRELADRIELMRRLLDRIEQPAWLRDGNGRIEWVNLAYAQAVDMANASQVISEGRELFGAQARQRLERDRFAEPVVQEQLTAVVHGDRRVFDVIDVSAESGSVGLGFDLTEVQAVRDELSRTLKSHAETLDQLSTAVAIFDPEMKLQFFNQAFVKLWGLDVAWLETRPSNTLIFDRLRAEGKLPEQPEWRKWKDSLLSAYRAVEPEEHMWHLPDTRTMRVVANPHPQGGVTWFFENMTEKFELEGRYNTLIKVQGETLDHLAEAVAVFGSDGRLRLSNPSFAALWSLPSEMVREGTHISIIAKLCNQRGGDGLWEDFVSTVTGFLDQRDGRMGQVELSDGAILSFAVVPLPKGQTMLTFIDVTDTVRVERALKEKNEALELADQIKNDFVQHVSYELRSPLTNIIGFTELLQTPAFGSLNERQLEYLDHISTSSSVLLTIVNDILDLATVDAGIMELEIGDVSVVEAISAAASRVSERLRDHNIGLDVDIADDVDVFKADANRVRQVLFNLLSNAVNYAPEGSNIVLQVARDGADVVFAVHDDGHGMPSEVLDTVFKRFQSYPNGGRRRGAGLGLAIVKSFVELHGGRVEIDTGEERGTTVICRFPSEARSFRAAAE

SEQ ID NO: 12859 - protein, 481 aa, Brucella melitensis 16M
MQFCLQANCPGLEHAMTASQDFVVKDISLADWGRRELDIAETEMPGLMAAREEFGKSQPLKGARISGSLHMTIQTAVLIETLKVLGAEVRWASCNIFSTQDHAAAAIAATGTPVFAVKGETLEEYWTYTDQIFQWPDGEPSNMILDDGGDATMYILIGARAEAGEDVLSNPQSEEEEVLFAQIKKRMAATPGFFTKQRAAIKGVTEETTTGVNRLYQLQKKGLLPFPAINVNDSVTKSKFDNKYGCKESLVDGIRRGTDVMMAGKVAVVCGYGDVGKGSAQSLAGAGARVKVTEVDPICALQAAMDGFEVVTLDDAASTADIVVTTTGNKDVITIDHMRKMKDMCIVGNIGHFDNEIQVAALRNLKWTNVKPQVDLIEFPDGKRLILLSEGRLLNLGNATGHPSFVMSASFTNQVLGQIELFTRTDAYKNEVYVLPKHLDEKVARLHLDKLGAKLTVLSEEQAAYIGVTPQGPFKSEHYRY

SEQ ID NO: 12860 - protein, 245 aa, Brucella melitensis 16M
MKFEFENRTLVLTGANGGIGRAIAELFHASGANLVLTDLDREGLDAFAASLGSPERIATIKADASSADDAEKTVALAMERFGGIDFLVPSVGIYQAKPFAEMSDADWHRTISINLDGVFYLCKRALPALKEDSSIVTLASLAAYRGAYVNAHYGATKGAMVSMTRALSRELAPKTRVNGVAPGIIETPMTSELLKTRMDETMTQTPLKRLGKPSEIASVIAFLCSPAASFVTGETIQVNGGIYMA

SEQ ID NO: 12861 - protein, 504 aa, Brucella melitensis 16M
MSKLDDNVAKAKTYLARFEKGVLNRIGGEDVAAADGATFETISPVDLKPLATVALGKAADIDRAARAAKAAFPEWAAMSGDARKKLLHKIADAIVARAEEIAFVEFMDTGQSLKFMAKAALRGAENFRFFADRAPEARDGKTLRGPGQVNMTTRVPIGPVGVITPWNTPFMLSTWKIAPALAAGCTVVHKPAEFSPLTARLLVEIAEEAGLPKGVWNLVNGFGEDAGKALTEHPDIKAIGFVGESRTGSLIMKQGADTLKRVHFELGGKNPVVVFADADLERAVDAAVFMIYSLNGERCTSSSRLLVEASIYEKFTALVAEKAKRIKVGHPLDPETVVGPLIHPVHEKKVLEYIEIGRSEGATVAAGGAKFAGPGGGCYVSPTLFTAAHNGMRIAQEEIFGPVLTAIPFKDEAEALALANDVKYGLTGYLWTNDVTRAFRFTDALEAGMIWVNSENVRHLPTPFGGVKNSGIGRDGGDWSFDFYMETKNIAFANAAHAIAKLGG

SEQ ID NO: 12862 - protein, 473 aa, Brucella melitensis 16M
MRIGKMEMQTRYPDVKLFIDGTWRDGSRGETIEIFNPATDEVIGHIARATTADLDDALAAVDRGFEAWSKVSAFDRYKIMRRAADIFRSRGEEVARLLTMEQGKPLAEARIEAAAACDLIDWFAEEARRSYGRIVPPRQAYVMQAEVKEPVGPVAAFTPWNFPINQAVRKISAALAAGCSILLKAAEDTPAAPAELVRAFAEAGLPDGAINLVYGDPAEISAYLIPHPVIRKVSFTGSTQVGKQLAALAGLHMKRVTMELGGHAPVIIAADADVEQAIKVVSGSKFRNAGQVCISPTRFLIENSVYDQVVEGMAAYATSLKVGDGLEAGTTMGPLVNAKRVNAMERLVQDAREHKARVVTGGERIGNRGNFFEPTILADVPRDAAIMNEEPFGPVALLNRFDALDEALSEANRLNYGLAAYAFTGSSAKAARISSTVRSGMITINQLRSGPAGSALRRDQRFRLWNGRRCRRA

SEQ ID NO: 12863 - protein, 404 aa, Brucella melitensis 16M
MLDGKRILLIIGGGIAAYKTPDLIRRLRERGAHVRPLMTAAAQQFVTPLTIGAVSADHVFTDLFSREDEQDVGHIRLAREADLIVVAPATADLMAKMANGLADDLASAVLLARKVPLLIAPAMNPAMWDNPATRRNRLTLEKDGVRFIGPEKGEMAESGEAGTGRMSEPLAIVAAIENLLSPQAKPLAGKTIVMTSGPTYEPIDPVRYIANRSSGKQGHAIAAALARLGATVHLVSGPVNIPDPEGVDVIHVETAREMQAAVERHLPADAAVMVAAVADWRSANEAGQKIKKKPGEGAPVLAMVENPDILAGIGHSKKRPGLVVGFAAETQDVAENARAKLEKKGADWIVANDVSHGPGKDGVMGGDRNRVRILSHSGIEEWPEMSKEDVAERLAEKIAASLLG

SEQ ID NO: 12864 - protein, 536 aa, Brucella melitensis 16M
MQPLSKPLPPAMARKPNGWRGRISAQPRQGWRRNGLIGRMTMTQENKMGKHENKAGGASLLHYGNFIAGQWQDAVGGEHITLKNPSDGSDLALIARGAKADIDLAVVAARSALSGDWGKLTATERGRILHRISEEVLKNIDLLTDLESKDVGKPVTQARVDVVALARYLEFYGASADKVHGDTLPYQNGFTVLSIYEPHGVTGHIIPWNYPMQILGRSLGAALAMGNAAVVKPAEEACLTILEFARIAEKAGLPKGALNVVTGFGAEAGAALCEHPDVNHISFTGSVRTGEVVQAAAAKNTVPVTLELGGKSPQIVFADADLDRALPFLVNAGIQNAGQTCSASSRILVERSIYEEVIARMSERYRALKVGPASADLSVGPVVSQRQKAIVDGYLDLAKESGLAIAAQGVLAEGAPEGGAYVLPTLIRDVPADHRLAQEEIFGPVQVILPFDTEEEAIANGTHYGLVCGIWTNDGGRQFRLAHAIHSGQVFINNYGAGGGIELPFGGVKKSGHGREKGFEALYGFASLKTISVYHG

SEQ ID NO: 12865 - protein, 249 aa, Brucella melitensis 16M
MTDDQLFSVRGKVIAVTGGSSGLGLRMVHVLAGHGARVISISRTHAGESLCPSGGEVLEIMADVTRPEEIARAFDEGESRFGPISALFNNAGVAHMARALDTTRDMLEHIFEVNVAGAFFTAQEVARRMIAQGQGGSIINVTSILGERPQKGAAAYSMSKACVSQMTRALALEWAAHDIRVNAISPGWFPTRINEEQLQGPAAGYLKGRNPMRRLGDPNDLDGVVLLLASDASRYMTGSIITVDGGHQL

SEQ ID NO: 12866 - protein, 340 aa, Brucella melitensis 16M
MTLVGNFSPLVLVGDSDRVEAETVGAYLDGWAGHDKVRLATANAIKAILSGAGRLVGRIARGYLPGDPGKLVGVNSDQDQQKSIDVGSHNLFVELLIAAGVASILSEEADLPVAGKADGLVAVAIDPLDGSGNVGLGAPLGTIFSIFPADVEEPFLQPGNRQIAAGYVSYGNSVDLGFSVGEGVIFATLDPVSGQFHITRRNVKLPERTSDLAFNASVQRHLSAGMQAYVNDAFLGKDGPRGRNFNMRWLGAAVGDMHRIMQRGGLFFYVNDSRPGYEKGRLRLVYEANPIAFLAREAGGKATDGSRPILDIVPQTYHERSALVFGVAEEVDILGEYFVK

SEQ ID NO: 12867 - protein, 429 aa, Brucella melitensis 16M
MQPRAGPSLPGAKRLPKERIAYIRRIAEIYESRLDEMAKTISMEMGAPIKLARESQAAAGLSHTKAFIAACENFEVEEVLSPKYPNQTVVHEPIGVCGLITPWNWPMNQITLKVIPAIAVGCTVVLKPSEIAPMSAMLFAEFVDQAGLPKGVFNLVNGEGPVVGEALSQHPEVDMMSFTGSTRAGTAVSRAAAATVKRVSLELGGKSPNIVFADSDLEKAISRSLAHCFENTGQSCNAPTRMLVERSVYDKAVELAKKAAESTKVGDPAQEGDHIGPLSSSIQFEKVQALIQKGIDEGARLVAGGTGRPEGFTEGDYVKPTVFADVNNNMTIAREEIFGPVLAMIPFDTEEEAIAIANDTPYGLAAYIQTGSPERAKRVARKLRAGMIQINGTSRAPGSPFGGYKQSGNGREGGKWGLEDFMEVKLISG

SEQ ID NO: 12868 - protein, 489 aa, Brucella melitensis 16M
MAIDLRPFIPFGRGALSQATDPFRAAVEFTLMPMLITNPHLPDNPIVFANPAFLKLTGYEADEVMGRNCRFLQGHGTDPAHVRAIKSAIAAEKPIDIDIINYKKSGEAFWNRLHISPVHNANGRLQHFVSSQLDVTLELSRLVELEKERKTLSIETARSKDQLDYIVEVANIGFWTREFYSGKMTCSAECRRIYGFTPDEPVHFDTILDLVVLEDRMTVVQKAHQAVTGEPYSIEYRIVTRLGETRWLETRAKALTGENPLVLGIVQDVTERKKAEANKALVSREIAHRFKNSMAMVQSIANQTLRNTYDPEQANRLFSERLRALSQAHDMLLKENWAGATIQQICATALAPFNSTFANRIHMSGPHLLVSDRVTVALSLAFYELATNAVKYGALSNEKGVINITWAIMEDKGEKKFHMRWAESRGPEVMQPARRGFGQRLLHSVLAEELKAKCDVEFAASGLLIDVLAPITPEVFPGMGHNVPEQRIA

SEQ ID NO: 12869 - protein, 375 aa, Brucella melitensis 16M
MKFKAAVLDRHGVERPYNQTKPLVIREVELREPKADEVLVKLAASGLCHSDLSVINGDRSRQIPMVLGHEAAGVVEKIGEGVTDLVPGDHVVCVFVPNCGHCQPCAEGRPALCEPGAAANGKGEMLSGGLRLFCDDGDVYHHCGVSAYAEYAVMSRYSIIRIEKDIPLHIAALMGCAVLTGTGSIFNTGLVKPGSRVAIAGLGGVGLAAVMGAVAAGATEIIALDMFDDKLALAEQLGATKTFNVQSEGVVEAVKEYTKGGVDAAFEYAGSGAALAMCYALTKRGGEVVTAGLPNPKNMLSIPAVSLVAEEKSIRGSYLGSGVPTRDIPLFLDLYRKGKLPVEKLLTHRIKLEEINEGFERLAAGKAIRQVVEFN

SEQ ID NO: 12870 - protein, 483 aa, Brucella melitensis 16M
MDMQEELMYPNLTLIVGGEERNKGSAGTLCLTDPADGRELTIAPRAGRAEALQAAAAEKGFAEWSALSALERSKIMRRAADIMRERADAAARIMSMEQGKPLSEARGEWLGSADLLDWFAEEGRRVYGRIVPSRAPNIQIQVLKHPIGPVAAFTPWNFPAWNTMQKVAPALGAGCSVVIKPASDTPGTAWLIGKCLLEAGLPPKAVSVIWGTTSELSDALIKAPEIRKVSLTGSTRVGRIVAAQAGEYLKKVTMELGGHGPVIVAADADLDHLIPLAVQWKFRNCGQVCVSPTRFIVEASIHDEFIRRFSEKARELKVGKGVEEGAQMGPLTSQNQLETVLSMVEDALTKGAKIETGGNRIGDTGNFYEPTILSGMTAEMLAMNEEPFGPLALVMRVHSLDEAIAESNRLPVGLGAYLFTSSMTTAHRVQNHLQAGMLGVNHFALALPETPFGGVRDSGFGSEGGLEGIEAYLTTMTVTTMMV

SEQ ID NO: 12871 - protein, 499 aa, Brucella melitensis 16M
MAMAKIVESPTGALALTFDDVLLQPGHSEVMPGQVDLRTRIAKDIELNLPLLSAAMDTVTESRLAIAMAQAGGIGVIHRNLSPERQAEEVRQVKKFESGMVVNPVTIGPDATLADAQALMKAHGISGIPVVENATKGPGRLVGILTNRDVRFASDPKQKIYELMTRENLITVHENVNQDEAKRLLHSHRIEKLLVVDDKDRCVGLVTVKDIEKSQLNPNAAKDAQGRLRAAAATSVGADGFERAERLIDAGVDLLVVDTAHGHSQRVLDAVARIKKAYPNVAVLAGNVATTAGTQALIDVGADAVKVGIGPGSICTTRIVAGVGVPQLSAIMSAVEAAQKQNIPVIADGGIKFSGDFAKALAAGAVAAMAGSLLAGTEESPGEVYLHQGRSFKAYRGMGSVGAMARGSADRYFQAEVRDELKLVPEGIEGQVAYKGPISAVLHQLAGGLRASMGYVGAKTLEEFREKATFVRISNAGLRESHSHGVAITRESPNYPGGM

SEQ ID NO: 12872 - protein, 304 aa, Brucella melitensis 16M
MCWHKFARYWDVEIREIPMEPGRLFMGPEQMLEAVDENTIGVVPTFGVTYTGNYEFPEPLQDALDKLQKTKGLDIDIHVDAASGGFLAPFCAPDIPWDFRLPRVKSISASGHKYGLAPLGCGWVVWRDKEALPEELIFNVDYLGGQVGTFAINFSRPAGQVISQYYEFMRLGREGYTKVQQAAYRVAQYIAREIEPLGPYEFICAGEEKGGIPAVCFRIREGEDPGYSLYDLSERLRLTGWQVPAFALSGKASDITVMRVMCRRGFEMDLAALFIRDFKAGIEFFKSHPSPKITPSMGTGFHHT

SEQ ID NO: 12873 - protein, 167 aa, Brucella melitensis 16M
MKITLEVIMTGSNYPARDLIASVFGTEALQEIAASRGFREKEMQANAVYQIIHDELFLDGNARQNLATFCQTWDDDYVHKLMDLSINKNWIDKEEYPQSAAIDLRCVNMVADLWNAPKFADNATGTNTIGSSEACMLGGMAMKWRWRKKMQEMGKPTDKPNFVCGPV

SEQ ID NO: 12874 - protein, 951 aa, Brucella melitensis 16M
MQHVAGENPRAQTTALAMSATAFTVCFAVWTIFAIIGIEIRSELGLTETQFGLLVSTPILTGSLIRVILGIWVDRYGGRAIFTLTMLVSAVATYLLTYATTYPQMLLAALGVGVAGGSFSVGVAYVSRWYPPEKQGVALGIFGAGNVGAAVTKFFAPMVMVAFGWHTVAEVWAAAMVVMALVFYFTTNDDPVLVERRRKGEKPTSTLMELEPLKNIQVWRFSLYYFFVFGAFVALSLWLPQYLIHVYGVDIRFAGIIAAFFSIPASLFRAYGGHLSDVYGARRVMYWTFAVSLVATFILSYPPTDYVIQSDNGPLAFHAEMGVIGFTVTVFILGFFMALGKAAVFKHIPVYYPGNVGAVGGLVGMIGGLGGFILPILFGVLLDQTGLWTSCFMLLFVIVVVSFVWMHVSIRQMEHAAEGKATEELPAFAELQGLKKAEVKPATGESVLTDWRPDDPAFWEQKGRRIAKRNLWLSIPALLLSFAIWQVWSVVVAKLPLVGYQFTTDQLFWLAALPGISGATLRIFYSFMVPIFGGRLWTTLTTWSLVIPAIGIGYAVQNPDTPYFIFLLLALFCGFGGGNFASSMSNISFFFPKTEKGNAAALNAGLGNLGVSVVQFVVPLVITAGIFGKLGGNPAMVATAAGEAPLWLQNAGFIFVPFIIVTAFANWFGMNDIASAKASFADQAVIFRRRHNWIMCWLYTGTFGSFIGYSAGFPLLTNILFPEVNALQFAFLGPLVGALSRSGSGWLADKYGGGRVTIWAFILMMVGVAGVLYFVGIKDEPNAFWGFFAAFILLFFATGIGNASTFQMIPAIMAKDMERLMPMASAEERRRQADKESAAITGFTSAIAAFGAFFIPKGYGTSISLTGGPEMALWAFLIFYVTCLIITWGVYTRKGGLLDCSTTSSAASSRPQPPLEEKLRGYNHESTPRPPELPGTQECRHLLGRARRHHQ

SEQ ID NO: 12875 - protein, 204 aa, Brucella melitensis 16M
MHAKGYSQQERRIIPFANRFRFRELCSNKSLHGLRAKFPEQYTKWDPMRKAASITKANSATPMDIALEEAHAAGERGEVPIGAVIVRDGEIIARAGNRTREFNDVTAHAEILTIRQAGEMLGSERLIDCDLYVTLEPCAMCAAAISFARIRRLYYGASDPKGGGIEHGGRFYTQPTCHHAPEIYPGFCEADARKILKDFFREKR

SEQ ID NO: 12876 - protein, 294 aa, Brucella melitensis 16M
MWWPAPRKTAQKISGKGYIMTVPTVKLNDGNHIPQLGYGVWQISNDEAVSAVSEALKAGYRHIDTATIYGNEEGVGKAINGSGIARADIFLTTKLWNSDQGYESTLKAFDTSLKKLGTDYVDLYLIHWPMPSKDLFMETWRAFIKLKEEGRVKSIGVSNFRTADLERLIKESGVTPVLNQIELHPQFQQDELRLFHGKHDIATEAWSPLGQGKLLEDPTLKSIAEKHAKSVAQIILRWHIETGNIVIPKSITPARIKENFDIFDFTLNGTDHDAITKLDMADGRIGPNPSVFSA

SEQ ID NO: 12877 - protein, 377 aa, Brucella melitensis 16M
MATQRIIDFLNTRRPEGPCLVVDTDVVRENYQGFEKALPYSRIFYAVKANPAPEILRLLASLGSSFDTASVAEIEMALEAGATPDRISYGNTIKKERDIARAFDLGIRLYAVDCVEEVEKIARVAPGSRVFCRVLTDGEGAKWPLSRKFGCVPAMAKDVLRRAKALGLDAYGVSFHVGSQQTDLTAWDRALADAAAVFRTLADEGIILRMVNMGGGFPTRYLKDVPTAQAYGMAIFDALSRHFGNRIPETIIEPGRGMVGNAGVIKTEVVLVSRKADNDNVRWVYLDIGKFGGLAETMDEAIRYQIVTPHDGSETEPCVLAGPTCDSADVLYEKTPYPLPVSLTIGDEILIEGTGAYTTTYSAVAFNGFEPLRSYVI

SEQ ID NO: 12878 - protein, 309 aa, Trypanosoma cruzi
MSGEANYEKPDTSNWKLADFEMGDTLGTGSFGRVRIAKLKGTNDYYAVKCLKKREILKMKQVQHISQEKQILMELSHPFIVNMMCSFQDDRRVYFVLEFVVGGEMFTHLRSAGRFPNDVAKFYHAEIVLAFEYLHSKDIIYRDLKPENLLLDSKGHVKVTDFGFAKKVPERTFTLCGTPEYLAPEVIQSKGHGKAVDWWTMGVLLYEFIAGYPPFYDDTPFRTYEKILSGRFKFPSWFDARARDLVKGLLQTDHTKRNWEKLYARYYPAPIPVKAKSPGDTSNFERYPESQEDRAVPLTATQQAEFIGF

SEQ ID NO: 12879 - protein, 519 aa, Danio rerio
MALTILPILGPISVSESLVAIITICLVYLLMRLNRTKIPDGLQKLPGPKPLPIIGNVLEIGNNPHLSLTAMSKCYGPVFQIQIGMRPVVVLSGNDVIRQALLKQGEEFSGRPELYSTKFISDGKSLAFSTDQVGVWRARRKLALNALRTFSTVQGKSPKYSCALEEHISNEGLYLVQRLHSVMKADGSFDPFRHIVVSVANVICGICFGRRHSHDDDELVRLVNMSDEFGKTVGSGNPADFIPFLRILPSTTMKKFLDINERFSKFMKRLVMEHYDTFDKDNIRDITDSLINHCEDRKLDENSNLQVSDEKIVGIVNDLFGAGFDTISTALSWAVVYLVHYPEVQERLQRELDEKIGKDRTPLLSDRANLPLLESFILEIFRHSSFLPFTIPHCTSKDTSLNGYFIPKDTCVFVNQWQVNHDPELWKDPSSFIPDRFLTADGTELNKLEGEKVLVFGLGKRRCIGESIGRAEVFLFLAILLQRLKFTGMPGEMLDMTPEYGLTMKHKRCLLRVTPQPGF

SEQ ID NO: 12880 - protein, 451 aa, Mus musculus
MHLYKTNKMTSLKEDVRRSAMLCVLTVPATMTSHDLMKFVAPFNDVIEQMKIIRDSTPNQYMVLIKFSAQADADSFYMACNGRQFNSIEDDVCQLVYVERAEVLKSEDGASLPVMDLTELPKCTVCLERMDESVNGILTTLCNHSFHSQCLQRWDDTTCPVCRYCQTPEPVEENKCFECGVQENLWICLICGHIGCGRYVSRHAYKHFEETQHTYAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDSLELRLSDLLKEKQSVERKCTQLNTRVAKLSTELQEEQELNKCLRANQLVLQNQLKEEEKLLKETCAQKDLQITEIQEQLRDVMFYLETQQQISHLPAETRQEIQEGQINIAMASAPNPPSSGAGGKLQSRKGRSKRGK

SEQ ID NO: 12881 - protein, 308 aa, Homo sapiens [sequence omitted]

SEQ ID NO: 12882 - protein, 344 aa, Escherichia coli
TPDCYQAADWRHRGYHAVELPGGDDYPQSRSGAGSRLHHGAEARQSDAVLCLALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDNGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 12883 - protein, 269 aa, Gorilla gorilla
VIKCKAAVLWEVKKPFSIEDVEVAPPKAYEVRIKMVAVGICRTDDHVVSGNLVTPLPVILGHEAAGIVESVGEGVTTVKPGDKVIPLFTPQCGKCRVCKNPESNYCLKNDLGNPRGTLQDGTSRFTCRGKPIHHFLGTSTFSQYTVVDENAVAKIDAASPLEKVCLIGCGFSTGYGSAVNVAKVTPGSTCAVFGLGGVGLSAVMGCKAAGAARIIAVDINKDKFAKAKELGATECINPQDYKKPIQEVLKEMIWRVDFSFEVIGRLDTM

SEQ ID NO: 12884 - protein, 502 aa, Myxococcus xanthus
MNGASGNGASDGVGASRRESVLQRRLSLADMLDLPSFVEVVRSFSELYRVGIKVMDTAGDKLADVKVGHGDFCSYVFGFPEGRSRCTATVARVKDGPVALVQGARPARGDGAEAAGIIALPCFTGLRYLVMPVCWEGDTLGRVILGPFTPEELADFPPSLTDISGVDLSRAHELVARVRRVPERTAAQVLVHFGQVLAALVASGQRAFLATQLHIEAMLETHRDLEANNARLAQANIRLKELDRLKSTFLGTVSHELRTPLASIIGYSEMLAEGLAGALNPEQLLYVRTIVEKGESLLNLISSILDLSQIEAGRLRLVMGPVDLGSVIQTAVSSVAPQAQRKGVELEVRLPPLPQPRLAADADKLRQVVVNLLANAVKFTSSGGRVSVVMSEATAQHELAAPGYRVCVEDTGMGIREDQFENIFQSFYQVDGSSTREHGGAGLGLAIVKSLVEGHGGRVSVESEFGRGSRFTVVLPLQPPLSEHGGFSALAPTPSPSGHDRF

SEQ ID NO: 12885 - protein, 147 aa, Citrus unshiu
LANTEGVYRVDLLTRQIASPEVDSSYGEPNEMLSCPSDGTGSCGAYIIRIPCGARDKYIAKESLWPYIHEFVDGALNHIVNMARAIGEQVNGGKPTWPYVIHGHYADAGEVAAHLSGALNVPMVLTGHSLGRNKFEQLLKQGRLPKD

SEQ ID NO: 12886 - protein, 385 aa, Solanum tuberosum
MGSLCSSRNKHYSQADDEENTQTAEIERRIEQETKADKHIQKLLLLGAGDSGKSTIFKQIKLLFQTGFDEAELKNYIPVIHANAYQTIKILHDGSKELAQNELEASKYLLSAENKEIGEKLSEIGGRLDYPRLTKDLVQDIEALWKDPAIQETLLRGNELQVPDCAHYFMENLERFSDIHYIPTKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSCMLFLNKFDIFEQKVLKVPLNTCEWFKDYQSVSTGKQEIEHAYEFVKKKFEESYFQCTAPDRVDRVFKIYRTTALDQKLVKKTFKLVDETLRRRNLFEAGLL

SEQ ID NO: 12887 - protein, 392 aa, Solanum tuberosum
MLSVVLENMGSLCSRNKHYSQADDEENTQTAEIERRIEQETKADKHIQKLLLLGAGDSGKSTIFKQIKLLFQTGFDEAELKNYIPVIHANVYQTIKILHDGSKELAQNELEASKYLLSAENKEIGEKLSEIGGRLDYPRLTKDLVQDIEALWKDPAIQETLLRGNELQVPDCAHYFMENLERFSDIHYIPTKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSFMLFLNKFDIFEQKVLKVPLNTCEWFKDYQSVSTGKQEIEHAYEFVKKKFEESYFQCTAPDCVDRVFKIYRTTALDQKLVKKTFKLVDETLRRRNLFEAGLL

SEQ ID NO: 12888 - protein, 282 aa, Craterostigma plantagineum
LGLSLGSFGPSSSGGSHPPPALPLPSNLFRPSLQEIDRTQRSIGAFLQAPTAAAVCREPASAFRGIDVNRPPTIVDCGEENNNPIASPSPNSTVCSSSGKRTSGEREEKEDGDRAASSSFEVEDDDGGGGDASARKKLRLSKEQAVVLEETFKEHSTLNPKEKIALAKQLNLMPRQVEVWFQNRRARTKLKQTEVDCEYLRRCCENLTEENRRLQKEVNELRALKLSPQFYMSPPTTLTMCPQCERVAAQPSSAAAIRPPSHHQRPAAGMNSWAAMISPRPS

SEQ ID NO: 12889 - protein, 282 aa, Craterostigma plantagineum
MKTQNTSETLGALISICPNTTDEERVSNVETSAMFGLDDECFASEKKRRLSNEQVKALEKYFEVENKLEPERKVKLAQELGLQPRQVAVWFQNRRARSKTKNLERDYGVLKSNYNALKHDFETLKRDNESLLKEIHELKSKLNEDDDSKSVEEEPFVEALELDANSDDVEPDSNQLFGSSDSDSSAILNEDNNNSRSSFLDDHRRKLSKIHGGSSPPSSAKIASEKNGSDESCKRAAAYKPQFVKIEEQHNLFREEDESCTTTFFSDEQAPTLNWYTPDEWN

SEQ ID NO: 12890 - protein, 285 aa, Craterostigma plantagineum
MNSARIFFDPSSHGNMLQFLGNAGGDSSVFRGTRSSSVLNMEESSLKRQIFSGGGGDEFYDEEYYDEQLLPEKKRRLTAEQVHLLEKSFEAENKLEPERKAELAKKLGLQPRQVAIWFQNRRARWKTKQLERDYDKLKSSYDSLLSTYDSIRQENDKLKAELLSLNEKLQPKDDDDPSAEIGRNLSSSSPPVDAAEPPCLKLTVKVEDRLSTGSNGSAVMDGDGPQQLLDDSGDSYFENDEEYDCAAASLAAAKEDDGSDEGGCYFTEALAAEEEEAPFAWCIWS

SEQ ID NO: 12891 - protein, 309 aa, Craterostigma plantagineum
MDSCSVYGDDHPHLKNALLKNEASEDLDSLWPHDSSNPSFHGSASPAMVNFEDVRGEDSPSPQKPIFPKIGNNAGKTRNSEELILDAFSSQKKRRLSSDQVRFLDKSFEVDNKLEPERKVQLAKELGLQPRQVAIWFQNRRARYKTKLLEKDYDALKSNYDRLKEDFDALYSENEKLKTEVNTLAEKLLGKADHGDHRPIKEEPPFDDDVNKQTKASSAKSDVLDYSDADGGNQRSPTMLELEHGDSSHVVGAISDYEDDDSLGRSLLLEAGNCLTKIEESFYDDLQPNSNCNLGFPVQNNHGTWFWQV

SEQ ID NO: 12892 - protein, 406 aa, Rattus norvegicus
MTLDVGPEDELPDWAAAKEFYQKYDPKDIIGRGVSSVVRRCVHRATGDEFAVKIMEVSAERLSLEQLEEVRDATRREMHILRQVAGHPHIITLIDSYESSSFMFLVFDLMRKGELFDYLTEKVALSEKETRSIMRSLLEAVNFLHVNNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSNTVKDLIAKLLQVDPNARLTAEQALQHPFFERCKGSQPWNLTPRQRFRVAVWTILAAGRVALSSHRLRPLTKNALLRDPYALRPVRRLIDNCAFRLYGHWVKKGEQQNRAALFQHQPPRPFPIIATDLEGDSSAITEDEVTLVRS

SEQ ID NO: 12893 - protein, 533 aa, Chlorella kessleri
MAGGGVVVVSGRGLSTGDYRGGLTVYVVMVAFMAACGGLLLGYDNGVTGGVVSLEAFEKFFPDVWAKKQEVHEDSPYCTYDNAKLQLFVSSLFLAGLVSCLFASWITRNWGRKVTMGIGGAFFVAGGLVNAFAQDMAMLIVGRVLLGFGVGLGSQVVPQYLSEVAPFSHRGMLNIGYQLFVTIGILIAGLVNYAVRDWENGWRLSLGLAAAPGAILFLGSLVLPESPNFLVEKGKTEKGREVLQKLRGTSEVDAEFADIVAAVEIARPITMRQSWASLFTRRYMPQLLTSFVIQFFQQFTGINAIIFYVPVLFSSLGSANSAALLNTVVVGAVNVGSTLIAVMFSDKFGRRFLLIEGGIQCCLAMLTTGVVLAIEFAKYGTDPLPKAVASGILAVICIFISGFAWSWGPMGWLIPSEIFTLETRPAGTAVAVVGNFLFSFVIGQAFVSMLCAMEYGVFLFFAGWLVIMVLCAIFLLPETKGVPIERVQALYARHWFWNRVMGPAAAEVIAEDEKRVAAASAIIKEEELSKAMK

SEQ ID NO: 12894 - protein, 352 aa, Mus musculus
MESGSRPSLGQVILLGTSSMVTAVLYSIYRQKAQVAQELKGAKKIHLGEDLKGILSEAPGKCVPYAVIEGAVRSVKETLNSQFVENCKGVIQRLSLQEHKMVWNRTTHLWNDYSKIIHQRTNTVPFDLVPHEDGVAVSVRVLKPLDSVDLGLETVYEKFHPSVQSFTDAIGHYISGERPKGIQETEEMLKVGATLTGIGELVLDNNAVRLQPPKQGMQYYLSSQDFDSLLHRQESSVRLWKVLVLVFGFATCATLFFILRKQYLHRQERLRQQQLQEEFLEHEAQLLSQASPEDRESLKSACVVCLSNFKSCVFLECGHVCSCRQCYLALPEPKRCPICRREITRVIPLYNS

SEQ ID NO: 12895 - protein, 516 aa, Mus musculus
MEPAVSLAVCALLFLLWVRVKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVSMGQVTALLNSIGWTLPVLPELDDLTVGGLIMGTGIESSSHKYGLFQHICTAYELILADGSFVRCTPSENSDLFYAVPWSCGTLGFLVAAEIRIIPAKKYVKLRFEPVRGLEAICEKFTRESQRLENHFVEGLLYSLDEAVIMTGVMTDDVEPSKLNSIGSYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCMSQALHTFQNDIHVYPIWLCPFILPSQPGLVHPKGDEAELYVDIGAYGEPRVKHFEARSCMRQLEKFVRSVHGFQMLYADCYMNREEFWEMFDGSLYHKLRKQLGCQDAFPEVYDKICKAARH

SEQ ID NO: 12896 - protein, 511 aa, Escherichia coli
MQSVTLCIMPRQYLLTTLVEILPMLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLREVKELTERNGFAGYPVVTEENELVGIITGRDVRFVTDLNQPVSVYMTPKERLVTVREGEAREVVLAKMHEKRVEKALVVDDEFHLIGMITVKDFQKAERKPNACKDEQGRLRVGAAVGAGAGNEERVDALVAAGVDVLLIDSSHGHSEGVLQRIRETRAKYPDLQIIGGNVATAAGARALAEAGCSAVKVGIGPGSICTTRIVTGVGVPQITAVADAVEALEGTGIPVIADGGIRFSGDIAKAIAAGASAVMVGSMLAGTEESPGEIELYQGRSYKSYRGMGSLGAMSKGSSDRYFQSDNAADKLVPEGIEGRVAYKGRLKEIIHQQMGGLRSCMGLTGCGTIDELRTKAEFVRISGAGIQESHVHDVTITKESPNYRLGS

SEQ ID NO: 12897 - protein, 813 aa, Escherichia coli
SSMQLGSNVPFPRQLTVTRDGDIMILRTPIISESYSPDESPSSDAKNSQNMLGYIALELDLKSVRLQQYKEIFISSVMMLFCIGIALIFGWRLMRDVTGPIRNMVNTVDRIRRGQLDSRVEGFMLGELDMLKNGINSMAMSLAAYHEEMQHNIDQATSDLRETLEQMEIQNVELDLAKKRAQEAARIKSEFLANMSHELRTPLNGVIGFTRLTLKTELTPTQRDHLNTIERSANNLLAIINDVLDFSKLEAGKLILESIPFPLRSTLDEVVTLLAHSSHDKGLELTLNIKSDVPDNVIGDPLRLQQIITNLVGNAIKFTENGNIDILVEKRALSNTKVQIEVQIRDTGIGIPERDQSRLFQAFRQADASISRRHGGTGLGLVITQKLVNEMGGDISFHSQPNRGSTFWFHINLDLNPNIIIEGPSTQCLAGKRLAYVEPNSAAAQCTLDILSETPLEVVYSPTFSALPPAHYDMMLLGIAVTFREPLTMQHERLAKAVSMTDFLMLALPCHAQVNAEKLKQDGIGACLLKPLTPTRLLPALTEFCHHKQNTLLPVTDESKLAMTVMAVDDNPANLKLIGALLEDMVQHVELCDSGHQAVERAKQMPFDLILMDIQMPDMDGIRACELIHQLPHQQQTPVIAVTAHAMAGQKEKLLGAGMSDYLAKPIEEERLHNLLLRYKPGSGISSRVVTPEVNEIVVNPNATLDWQLALRQAAGKTDLARDMLQMLLDFLPEVRNKVEEQLVGENPEGLVDLIHKLHGSCGYSGVPRMKNLCQLIEQQLRSGTKEEDLEPELLELLDEMDNVAREASKILG

SEQ ID NO: 12898 - protein, 337 aa, Trypanosoma brucei brucei
  unsure (1)..(337): unsure at all Xaa locations
MKSDGCLTRKDVSSWKLQDLEIRETIGTGTFGRVRLCRHRASGQYVVLKILKKQEILRMKQVDHILAESSILQELSHPFIVTMYKGFMDDDRLYLLLEYVVGGELFSHLRKAGKFPNDVAKFYSAEVVLAFEYIHECGIVYRDLKPENVLLDKQGNIKITDFGFAKRVRDRTYTLCGTPEYLAPEIIQSKGHDRAVDWWTLGILLYEMLVGYPPFFDESPFRTYEKILEGKLQFPKWVEMRAKDLIKSFLTIEPTKRLGSVKRGVQDVKRHKFYSGVNWNVLLQRGVAAPIHVRLNNDGDTRYFDRYPESPRHPLQPLTEAQQELFSGFCDGEYTRX

SEQ ID NO: 12899 - protein, 233 aa, Oryza sativa (japonica cultivar-group)
MVRGRTELKRIENPTSRQVTFSKRRNGLLKKAFELSVLCDAEVALIVFSPRGRLYEFASAPSLQKTIDRYKAYTKDHVNNKTIQQDIQQVKDDTLGLAKKLEALDESRRKILGENLEGFSIEELRGLEMKLEKSLHKIRLKKTELLEQQIAKLKEKERTLLKDNENLRGKHRNLEAAALVANHMTTTTAPAAWPRDVPMTSSTAGAADAMDVETDLYIGLPGTERSSNRSETG

SEQ ID NO: 12900 - protein, 103 aa, Sesbania rostrata
MSGRGKGGKGLGKGGAKRHRKVLRDNIQGITKPAIRRLAKRGGVKRISGLIYEETRGVLKIFLENVIRDAVTYTEHARRKTVTAMDVVYALKRQGRTLYGFGG

SEQ ID NO: 12901 - protein, 172 aa, Antirrhinum majus
KATELRLGLPGTDESEPQTSSSIKNNNNKRSSSEMQGSCQKSTQQEESIAPAPKAQVVGWPPVRSFRKNVMKASESDGSGMFVKVSMDGAPYLRKIDLKFYNNYFDLLKALENMFKCTIGVYSEREGYNGSEFAPTYEDKDGDWMLVGDVPWDMFITSCKRLRIMQSKLCCL

SEQ ID NO: 12902 - protein, 252 aa, Prunus caroliniana
AHYKSEADVGNAIAEAIRSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETYPYFQRESLVKFCKKHGVTPMAHTPLGGATANVKSFGSISPLEDPVLLGLAKKYKKSVAQIALRWNIERDTPVIPKSSKVERLKENLEVLNFKLEKEDIELINTIDKKSRTTL

SEQ ID NO: 12903 - protein, 214 aa, Beta vulgaris
MAGNDWINSYLEAILDVGGQGIDASNAKTSSSSPSSLLLRERGHFSPSRYFVEEVITGFDETDLHRSWVRAASTRSPQERNTRLENLCWRIWNLARKKKQIEGEEAQRSAKRHIEREKGRREATADMSEDLSEGEKGDTVGDMSFAGDSTKGRMRRISSVDMMENWTNTFKAKKLYVVLISLHGLIRGENMELGRDSDTGGQVKYVVELARALG

SEQ ID NO: 12904 - protein, 248 aa, Dendronephthya klunzingeri
LKSSFQTCLLVSEENKTVIEVELDQQGKYIVYFDPLDGSSNIECLASIGSIFGIAKKPSESPMKQADALIPGRDFVAAGYALYGSATMVVLSTGNGVNGFTLDPSIGQFVLTDQDIRIKPRGKIYSINEGYYKYFDKETKDYIESVKFPKDGKAPYGARYVGSMVSDMHRLLVYGGIFMYPANSKSPEGKLRLMYECNPMAFIVSQAGGMATNGKIDILDIVPEIHERAPIAIGSTEDVKDYLTFVKK

SEQ ID NO: 12905 - protein, 671 aa, Cyanidium caldarium
EMVQPSSFVTNLVHSSSHWKGTKRQSVSRKNNVAHFCPKETSRFSQASGRTKCCHKHGSETFYRNEAASNNELSGTARVELSEHNERLALSSYPAVPFPQHLSSNQTSLSLLATAIVATLGQWFGKLVRSKAKDVDLLSPQFLQANGSAGSTDGSASVGADGIAKALPPKNELKKILPLGVMFFMILFNYTILRDTKDVLVVTTTGAEIIPFLKTYANLPGAVLFTIAYSKLSNMFDRETLFYVCIVPFILFFLSFAFVLYPLRHALHPYAFVDWIAGYLPASFFAPLGIIRNWTFALFYTLAELWGSVVVSLLFWGFANEVTSVDEAKKYYPLFGLVANVALIFSGQYVRFVSDIRRKLPPGVDGWGVSLKYLMTMIGVAGSVIILAMLYIQKNVLTDPNCVDMSKRKNTKQKTKLGLKESAVYLAKSAYIRNLALLVIAYGMSINIVEVSWKSKLKEAFPDPNSYSTFMGWFSTCTGSVTLIMMLLGRFIFRKFGWGFAALITPTVLGITGFLFFCLTLFSRQLHPVVGMLGTTPLMLAVLVGAAQNILSKSSKYSLFDPCKEMAYIPLDAEQKSKGKAAIDVIGNPMGKSGGSFIQQGLIFAVGSLAASTPYLAFILFVIVGMWIAAARSLDKQFQEAMKRSEVAEVMAKTGIQDPIEAAKVAKESKQ

SEQ ID NO: 12906 - protein, 302 aa, Escherichia coli
MSQNTLNSDNDLAEEELLSQGATQRVLDATQLYLGEIGYSPLLTAEEEVYFARRALRGDVASRRRMIESNLRLVVKIARRYGNRGLALLDLIEEGNQGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 12907 - protein, 1395 aa, Homo sapiens [sequence omitted]

SEQ ID NO: 12908 - protein, 311 aa, Leishmania donovani donovani
MSSFGRATARSGDAGTRDSLDRYNRLDVLGEGTYGVVYRAVDKITGQYVALKKVRLDRTEEGIPQTALREVSILQEFDHPNIVNLLDVICSDGKLYLVFEYVEADLKKAIEKQEGGYSGMDLKRLIYQLLDGLYFCHRHRIIHRDLKPANILLTSGNVLKLADFGLARAFQVPMHTYTHEVVTLWYRAPEILLGEKHYTPAVDMWSVGCIFAELARRKVLFRGDSEIGQLFEIFQVLGTPTDTEGSWPGVSRLPDYRDVFPKWTAKRLGQVLPELHPDAIDLLSKMLKYDPRERISAKEALQHPWFSDLRW

SEQ ID NO: 12909 - protein, 165 aa, Ricinus communis
MAAADIEYRCFVGGLAWATSDKALEEAFSAYGEVLESKIINDRETGRSRGFGFVTFNNEKSMRDAIEGMNGQNLDGRNITVNEAQSRGGGGGGGGGYRNGGGGGYGGGRREGGYGGGGGYSRGGGGYGGGGGGYGGGRDRGYGGGGDGGSRYSRGGGASEGNWRS

SEQ ID NO: 12910 - protein, 647 aa, Yarrowia lipolytica
MSFPQQVIAPGQRLNELLEAIKQEFDSVTNEASVYRLHKDEFDVKVNQQTSDLGQIRQSVYELEMAHRKMKERYEEEIMRLKSELEARGGPAANPAHSQQQQQQQQQQQQQQQQNQQAQDQQARAAQQQAAQQQALAQQQAAQQQALAQQQAQAQQQAQAQAHHMGGVPPSQGQPPSLLRPSSNVFSGIMSGQPGTSSLAPPQGQPGQPQPGQPQPGQPQPYSGYVGANGYTSSPHNGPPVISAMASPNSKKRQVSTPVPGKASPQVAPQEMQQQQQQQGPPQQQQPPQQQQQSPEEMGNYLGDMDIERVPPELKKQKADWFVVYNQRAPRLLDVDIVQSLDHNSVVCCVRFSADGKYIATGCNRSAQIFDVQTGQLICRLQDDSVDREGDLYIRSVCFSPDGKYLATGAEDKQIRVWDIKSQSIRHVFTGHEQDIYSLDFSRNGRHIASGSGDRTVRMWDIESGQCTLTLSIEDGVTTVAISPDGKFVAAGSLDKSVRIWDTSTGFLVERLEAPDGHKDSVYSVAFTPNGMDLVSGSLDKTIKLWELQAPRGIQANQRGGVCVKTLCGHKDFVLSVASTLDGQWILSGSKDRGVQFWDPRTGQVQLMLQGHRNSVISVAPSPMGGLFATGSGDCKARIWRYFPVNR

SEQ ID NO: 12911 - protein, 465 aa, Nyctotherus ovalis
MGCGPSKKDNIYIPALQRELSINTLAVFKDFKENSHQYVYKDFLGHGRFGRVLLGESPETHHQVAIKVLPKQDLPVEKLMSEVDILSAVDHPNIVKYMKHYESKRYLYIVMEYCPGGDLFQKVIKQNKFNEAEAAIVMEEVLRAINHCHHLGIIHRDLKPENIMYSSDGTLKIIDFGLSIKENTEPSEQLVGTAYYMAPEIVREEKFTKAGDIWSLGVLLHILLTGFVPLGGRTFEEIKEEIRAYSGLVFEFERWQGVSSEAKDLVRKMLESDYERRITAAEALKHPWFTSNKSLKTNFNEKSIEALRNYSQFSKLKKDILTVLVKNISDTELKEFQEAFLQLDKNKTGMITCKDLEENLNKIGSKATAKELEELTRRINYKGEAFINYSTFMAALVATRQFMTEEKIDSFYKVLEVEGRAENVEARQKIGATKICPDDPTARSVINSEEKLTFGEFKELLMELK

SEQ ID NO: 12912 - protein, 159 aa, Streptococcus thermophilus
MKNDRKARLILSIFRYGKNHMEKETFYHKVNYGIYKILNAVFVIGFFGTELQASQSISNNIILFHPYGIVVSGEATLGDEVVIRQQVTIGNKGTGEGADDCPIIGDRVDIGAGAKIIGGITIGENSKIGANAVVTKSFPANSILVGVPARNIASKAMNG

SEQ ID NO: 12913 - protein, 501 aa, Ovis aries
MEPQDPVKREGRLTPVIVLATLIAAFGSSFQYGYNVATINSPSEFMKDFYNYTYYDRVGEYMNEFYLTLLWSVTVSMFPFGGFLGSLMVGPLVNNLGRKGTLLFNNIFSIVPALLMGFSDLAKSFEMIIVARVLVGICAGLSSNVVPMYLGELAPKNWRGALGVVPQLFITIGILVAQIFGLRSLLANEEGWPILLGLTGIPAVLQLLFLPFFPESPRYLLIQKKDEEAAKRALRRLRGWHDVDAEIEEILEEDRAEKAAGFISVLKLFKMRSLRWQVISIIVLMAGQQLSGVNAIYYYADQIYLSAGVKEDDVQYVTAGTGAVNVLITVCAIFVVELMGRRFLLLLGFSVCFTACCVLTGALAMQDVISWMPYVSIACVISYVIGHALGPSPIPALLVTEIFLQSSRPAAYMVAGTVHWLSNFTVGLVFPFIQVGLGAYSFVIFAVICFLTTVYIFLIIPETKSKTFIEINQIFIKMNKVPGVHPEKEELKEFPPSTARQ

SEQ ID NO: 12914 - protein, 357 aa, Ovis aries
QVIITHYRHVLGVSLDDGIAINNYALNSTKELPTSPGGPTPVSWAEEEAMTSASLITMFWSLSVSSFAVGGMIASFFGGLLGDKLGRIKALLVANILSLVGALLMGFSKLGPSHILIISGRGISGLYCGLISGLVPMYIGEIAPTTLRGAIGALHQLAVVTGILISQIVGLDFILGNHELWHILLGLSAVPAILQCLLLFFCPESPRYLYIKLDEEAKAKKSLKRLRGSDDVTKDITEMRKEREEASNEKKVSIIQLFTNASYRQPILVALMLHAAQQFSGINGIFYYSTSIFQTAGISQPVYATIGVGAVNTVFTAVSVFLVEKAGRRSLFLIGMSGMFVCAIFMSVGLVLLNKLP

SEQ ID NO: 12915 - protein, 238 aa, Mus musculus
QMELTSDMRAILVDWLVEIQGSFQMTHETLYLAVKIMDLYLMKAQCKKNHLQLLGSTTYMIAAKFEESYPPSLSEFLFICEDMYEKSDMVSLESSILQTLNFDINIPTAYNFLRRYASCIHASMKTLTLSRFICEMTLQEYEYIEERPSKLAAASFILALYMRNLSNCVPTLEYFTGYKMAELHILVRKLNHLLNFRSHSILKNVFEKYSEETYFEVAKIPPLSKQDLENLLNCALFH

SEQ ID NO: 12916 - protein, 299 aa, Drosophila melanogaster
MGKDFDAVGFVKDFAAGGISAAVSKTAVAPIERVKLLLQVQHISKQISPDKQYKGMVDCFIRIPKEQGFSSFWRGNLANVIRYFPTQALNFAFKDKYKQVFLGGVDKNTQFWRYFAGNLASGGAAGATSLCFVYPLDFARTRLAADTGKGGQREFTGLGNCLTKIFKSDGIVGLYRGFGVSVQGIIIYRAAYFGFYDTARGMLPDPKNTPIYISWAIAQVVTTVAGIVSYPFDTVRRRMMMQSGRKATEVIYKNTLHCWATIAKQEGTGAFFKGAFSNILRGTGGAFVLVLYDEIKKVL

SEQ ID NO: 12917 - protein, 770 aa, Arabidopsis thaliana
MVAPALLPELWTEILVPICAVIGIAFSLFQWYVVSRVKLTSDLGASSSGGANNGKNGYGDYLIEEEEGVNDQSVVAKCAEIQTAISEGATSFLFTEYKYVGVFMIFFAAVIFVFLGSVEGFSTDNKPCTYDTTRTCKPALATAAFSTIAFVLGAVTSVLSGFLGMKIATYANARTTLEARKGVGKAFIVAFRSGAVMGFLLAASGLLVLYITINVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMCYPLLISSMGILVCLITTLFATDFFEIKLVKEIEPALKNQLIISTVIMTVGIAIVSWVGLPTSFTIFNFGTQKVVKNWQLFLCVCVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAGIHTVDVLTPKVIIGLLVGAMLPYWFSAMTMKSVGSAALKMVEEVRRQFNTIPGLMKGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYF

SEQ ID NO: 12918 - protein, 347 aa, Homo sapiens
MVGVAEVSCGQAESSEKPNAEDMTSKDYYFDSYAHFGIHEEMLKDEVRTLTYRNSMFHNRHLFKDKVVLDVGSGTGILCMFAAKAGARKVIGIVCSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 12919 - protein, 343 aa, Homo sapiens
MEVSCGQAESSEKPNAEDMTSKDYYFDSYAHFGIHEEMLKDEVRTLTYRNSMFHNRHLFKDKVVLDVGSGTGILCMFAAKAGARKVIGIVCSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 12920 - protein, 462 aa, Renibacterium salmoninarum
MSPTARKISATAAPEDSASAETSTARTRAAVKDAPVAQTAAVKTLAAKKPSAKKVTEIPDAVTIEEKLTPAQKRAATAAAKKAALSEDDAAVKPTRGRKPKADDSAESADDESTEGVADSAETETADAPEEAEETAGSGFVYSDADDDDAPVQQVMSAGATADPVKDYLKQIGKVALLNAEQEVDLALRIEAGLYAEEKLAADDGKITEKLNREYQWVIHDGKRAKNHLLEANLRLVVSLAKRYTGRGMLFLDLIQEGNMGLIRAVEKFDYTKGFKFSTYATWWIRQAITRAMADQARTIRIPVHMVEVINKLARVQRQMLQDLGREPTPEELALELDMTPEKVVEVQKYGREPISLHTPLGEDGDSEFGDLIEDSEAVVPADAVSFTLLQEQLHSVLDTLSEREAGVVAMRFGLTDGQPKTLDEIGKVYGVTRERIRQIESKTMSKLRHPSRSQVLRDYLD

SEQ ID NO: 12921 - protein, 130 aa, Sporobolus stapfianus
DTKETTKQKASETGSFLGQKTDQAKHKAGETTESTKQKAGETTEAAKQKTAETTEAAKQKTAETTEVAKQKTAEAIEVTKQKASEASEYAKDSAVSGMVKTGIVIQQVTEQVMSAVLIAKDAVVITLLDG

SEQ ID NO: 12922 - protein, 86 aa, Sporobolus stapfianus
MSYYGQQPPVGVPPQQGYPGKDGYPPQGYPPAGYPPQQGYPPQGYPQQGYPPPYAQAAAQQQQSGPSFMEGCLAALCCCCLLDACF

SEQ ID NO: 12923 - protein, 654 aa, Cryptococcus neoformans var. neoformans
MEDVKMSGPVGVGVPMGVVDPREKELPREPGSAAMGGRSRSGTGRSSKDKKSMFGFVSDLLGKDKPPVISKPYDPVHVTHVGFDFQTGKYTGMPPKWQQVLDDNGITQDEQERNPNGVMAVVQYLKHQDEGEDEEEEVWAKMKNAQPPAFPPPSAAPSQPTTPGGGVGSREMSREPSNEALGAAGTQVVDFTCPRMAPAPPTKPSLNRMLSERHAPASHRPAELTTPAPLAAAPRVTQAYSSALSHSPHLPPPHPTSSAPPTAPAPHLDRSYSQRAPVSGTKTKVLDRANTTRSPGSSAGIAQGAGTGVGLTKSQSQSGHKSRDPSREPKDSASSSGGLSRNQTTTRQQQGATPRRREKEKKENEDVIRQLRMICTPGDPNLVYKNFRKIGQGASAGVYTAIDRQTLPVAIKQMSLEKQPKQDLIINEILVMRESAHPNIVNFKDSYLWQGDLWVVMEYMEGGSLTDVVTAHCMSEAQIASVSREVCEGLRHLHSKGVIHRDIKSDNILLSLNGDVKLTDFGFCARIADPTTTKRTTMVGTPYWMAPEVVLRKEYGPNVDIWSLGILAIEMLEGEPPYLTENPVRALYLIATNGTPKIKDWDKLSTVFRDYFKVTLQVDPAKRPTAAAILKHEFFKHTAPLISLAPMIRSSRKS

SEQ ID NO: 12924 - protein, 334 aa, Oryza sativa (japonica cultivar-group)
MCWLEITGKLQPAALAPLSGDDVRRLTCLLISPVVGLQQRLVLSPVAGMQQRDAPAGAGITPLKPHQSSPTKPPALATAMDVVSSLSSSPTPAPSVLKSLLLSYAYVSVWITFSISVIMYNKYILDPTMYNWPFPISLTMVHMVFCASLAVVLVRVLRVVAEPTSPPMTPSLYAASVVPIGRALRAVALALMPVVVYCLAIAFRTDSFHHASMLNMLGISAGIAVAAYGEARFDAFGVMLQLVAVTAEATRLVLIQILLTGATPPPAPAPVPAQADRNVEMGLLGGESSASRPAMKPRQVLDCEIAPPSNRATEFGSTGLRVGIDWDAGAIWAF

SEQ ID NO: 12925 - protein, 374 aa, Homo sapiens
MSRRSSRLQAKQQPQPSQTESPQEAQIIQAKKRKTTQDVKKRREEVTKKHQYEIRNCWPPVLSGGISPCIIIETPHKEIGTSDFSRFTNYRFKNLFINPSPLPDLSWGCSKEVWLNMLKKESRYVHDKHFEVLHSDLEPQMRSILLDWLLEVCEVYTLHRETFYLAQDFFDRFMLTQKDINKNMLQLIGITSLFIASKLEEIYAPKLQEFAYVTDGACSEEDILRMELIILKALKWELCPVTIISWLNLFLQVDALKDAPKVLLPQYSQETFIQIAQLLDLCILAIDSLEFQYRILTAAALCHFTSIEVVKKASGLEWDSISECVDWMVPFVNVVKSTSPVKLKTFKKIPMEDRHNIQTHTNYLAMLCMISSHV

SEQ ID NO: 12926 - protein, 323 aa, Homo sapiens
MDPKYQRVELNDGHFMPVLGFGTYAPPEVPRNRAVEVTKLAIEAGFRHIDSAYLYNNEEQVGLAIRSKIADGSVKREDIFYTSKLWCTFFQPQMVQPALESSLKKLQLDYVDLYLLHFPMALKPGETPLPKDENGKVIFDTVDLSATWEVMEKCKDAGLAKSIGVSNFNYRQLEMILNKPGLKYKPVCNQVECHPYLNQSKLLDFCKSKDIVLVAHSALGTQRHKLWVDPNSPVLLEDPVLCALAKKHKRTPALIALRYQLQRGVVVLAKSYNEQRIRENIQVFEFQLTSEDMKVLDGLNRNYRYVVMDFLMDHPDYPFSDEY

SEQ ID NO: 12927 - protein, 299 aa, Homo sapiens
KLISIHIKVDPLFTELLNGIRAMEDPGVRDTMLQALRFVIQGAGAKVDAVIRKNIVSLLLSMLGHDEDNTRISSAGCLGELCAFLTEEELSAVLQQCLLADVSGIDWMVRHGRSLALSVAVNVAPGRLCAGRYSSDVQEMILSSATADRIPIAVSGVRGMGFLMRHHIETGGGQLPAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 12928 - protein, 513 aa, Brassica oleracea
MGAFETENTAKDAAALETQSSLEEFNQPSPLRKIISVSSIAAGVQFGWALQLSLLTPYVQLLGIPHKWSSLIWLCGPVSGMIVQPIVGFHSDRCTSRFGRRRPFIAAGAAMVAVAVFLIGYAADIGYKMGDKLEQTPRVRAIGIFALGFWILDVANNTLQGPCRAFLADLAAGDAKRTRVANAFFSFFMAVGNVLGYAAGSFTNLHKMFPFAMTNACDLYCANLKSCFFLSITLLLIVTVTSLWYVKDKQWSPPPVAADEEKKSVPFFGEIFGAFKVMERPMWMLLIVTALNWIAWFPFLLFDTDWMGREVYGGDSEGDARLKQIYNKGVQSGALGLMFNSIVLGFMSLGVEWIGKKVGGAKRLWGIVNFILAIGLAMTVLVTKLAADYRKVAGPYAGPSPGIRAGALSLFAVLGIPLAITFSIPFALASIFSSSSGAGQGLSLGVLNLAIVIPQMIVSLGGGPFDALFGGGNLPAFIVGAIAAAISGVLAITVLPSPPPDAPALKTGAMGFH

SEQ ID NO: 12929 - protein, 508 aa, Brassica oleracea
MEKGSNGSAALEMQTSELDQPAALRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPRTRAIAIFALGFWILDVANNTLQGPCRAFLADLSAGNAKKTRTANAFFSFFMAVGNVLGYAAGSYKNLYKVVPFTMTKSCDLYCANLKTCFFLSITLLLLVTFMSLCYVTEKPWTPEPTADGKPSSVPFFGEIFGAFKELKRPMWMLLIVTALNWIAWFPFLLFDTDWMGREVYGGNSDATASVASKKLYNDGVRAGALGLMLNAIVLGFMSLGVEWVGRKMGGAKRLWGAVNFILAICLAMTVVVTKQAENHRRDHGGAKTGPPGNVTAGALTLFAVLGIPQAITFSIPFALASIFSTNSGAGQGLSLGVLNLAIVVPQMVVSVGGGPFDELFHGGNIPAFVLGAIAAAVSGILALTVLPSPPPDAPAFKTGAMGFH

SEQ ID NO: 12930 - protein, 480 aa, Brucella melitensis biovar Abortus
MQTRYPDVKLFIDGTWRDGSRGETIEIFNPATDEVIGHIARATTADLDDALAAVDRGFEAWSKVSAFDRYKIMRRAADIFRSRGEEVARLLTMEQGKPLAEARIEAAAACDLIDWFAEEARRSYGRIVPPRQAYVMQAEVKEPVGPVAAFTPWNFPINQAVRKISAALAAGCSILLKAAEDTPAAPAELVRAFAEAGLPDGAINLVYGDPAEISAYLIPHPVIRKVSFTGSTQVGKQLAALAGLHMKRVTMELGGHAPVIIAADADVEQAIKVVSGSKFRNAGQVCISPTRFLIENSVYDQVVEGMAAYATSLKVGDGLEAGTTMGPLVNAKRVNAMERLVQDAREHKARVVTGGERIGNRGNFFEPTILADVPRDAAIMNEEPFGPVALLNRFDALDEALSEANRLNYGLAAYAFTGSSAKAARISSTVRSGMITINHYGLALPEVPFGGINDSGYGTEGGADALEAYQNTKFVSFLQA

SEQ ID NO: 12931 - protein, 772 aa, Rattus norvegicus
MASQIQKLLTTNQDLLLMQKGTMMRKVRTKSWKKLRYFRLQDDGMTVWHGRHLESISKPTFSISDVERIRKGQDSELLRYLVEEFPLEQGFTIVFNGRRPNLDLVANSVEEAQTWMRGLQLLVDLVARMNYQEQLDQMLREWFQQADRNQDSRMSFREAQRLLLLMNVEMDEEYAFSLFQEADVSQSNTLDSEEFVQFYKALTKRTEIEELFENFSSDKQKLTLLEFVDFLREEQKESDHSSDLALKLIDRYEPSENGRLLRVLSKDGFLSYLCSADGNIFNPDCLPIYQDMTQPLSHYYINSSHNTYLLGDQFCGQSSVEGYIRALKRGCRCVEVDTWDGPDGEPVVYHGRTLTSRILFKDVLATLAQYAFQSSDYPLILSLDNHCTWEQQKTMAHHLIAILGEQLLSTTLEEQLIDIMPSPEQLRGKILVKGKKLRTIEVVESDKEEEELEKDEGSDLDPASAELDMQSQPESQEQASGNKSKNKKKFLLQSSTTILCPDLSALVVYLRTAPFCSFTHSKENYHIYDISSFSESKAKNLIREAGNEFVQHNARQLCRVYPSGLRTDSSNYNPQEHWNVGCQMVAMNMQTAGSAMDICDGLFRQNGGSGYVLKPEFLRDTQSSFNPMKPVSLYKAQILVVQVISGQRLPKVDKTKETTVVDPLVRVELYGVPEDTKQQETSYVENNGINPYWGETFYFQIQVPELAMLRFVVKDYSRTSRNNFIGQYTLPWTCMKHGYRHVSLLSKDGTSLHPASIFVYTCMQEDLDMDEP

SEQ ID NO: 12932 - protein, 210 aa, Pinus pinaster
  unsure (1)..(210): unsure at all Xaa locations
TSTLDSLVSQIHAACRDWGFFQVINHGVSPHFLQTILSEAANFFSLPMQEKCKVRRDFENPLGYYDTELTKNVRDWKEVFDFXMPSEFRLPASFEGESAEILTATNQWPENPPGLREACEKYAEAVEKLSFRLLELISLSLGLPARYFHSKFEDPTSRLRLNHYSPCPAPELAXGVGRHKDGGALTVLAQDEVGGLQVRRKDGEWIGVKP

SEQ ID NO: 12933 - protein, 680 aa, Pimpla hypochondriaca
MNLLAVGAVFLLTHTIGAYGDNDGITAAVNRKKNLFRSQINATSMSTPEECARACIDGEPPKTCYYHFTVEYYSTLTEACKLCQQEARSRVTPDCQCIQADGYEKSGLITVNRMYPGPGIMACLGDNIVVDVENRVLGNAVTVHFHGVYQRNYQYSDGVPFVTQCPIQEGSTFRYQWKAENSGTHLWHAHTGLHKGEGLMGPLIIREPKSTEPNHDLWDHDDIDNVIFLSDWFHRSSADHFPGNFHREPGQEPDNFLINGMGQWTDPDTGETTNTSYAHFNVTNGKSYKFRLINGAGMTCPLMLTIEGHKMHIIASDGQPLELVTVNTITSFAAERYDFVLNANKPIGNYWIQLRADGPCINRKMQQFAVLHYTSAPVEPQRSRITFDGPTSLDTGVILNPLNVRCFEQKLRTYIRCMSDLVNAKPIPQEILKDKADVQIFMNFGFNGYDPNDLFQPGRYLPYHVAGGGESVAMMGNISNFYPASPLLSQRSDIPDDQICSIADREAKCGKAYPCQCVHIERIPLNSVTELILTDEAKIANLSHPFHLHGQPFYLFGEGDADLHGVKTINVETVKELEKQGKLNRYPTSVAVEHNDVEGPVPPKVAARFPAKDTYAVPNSGYSIIRFWATNPGYWLFHCHFEFHALMGMMTIFHVGEPEDLPPVPPGFPKCGPYTPPLIF

SEQ ID NO: 12934 - protein, 150 aa, Listonella anguillarum
MNLICFYRISHWAYVNRIPLIPNVIKIISFLLFNSVVPASVKIGKNSRFMYGGIGCVIHKKSIIGNNVCLGQGITIGRKLKESCPEIGNDVYIGAGARILGDIKVGNNIIIGANAVVINSISDNSIVAGSPAKVVKMIEHSIWQELGDLL

SEQ ID NO: 12935 - protein, 215 aa, Drosophila melanogaster
MSSSEEVSWVTWFCGLRGNEFFCEVDEDYIQDKFNLTGLNEQVPNYRQALDMILDLEPEDELEDNPLQSDMTEQAAEMLYGLIHARYILTNRGIAQMIEKYQTGDFGHCPRVYCESQPMLPLGLSDIPGEAMVKTYCPKCIDVYTPKSSRHHHTDGAYFGTGFPHMLFMVHPEYRPKRPTNQFVPRLYGFKIHSLAYQIQLQAAANFKMPLRAKN

SEQ ID NO: 12936 - protein, 215 aa, Homo sapiens
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHAMAYQLQLQAASNFKSPVKTIR

SEQ ID NO: 12937 - protein, 295 aa, Homo sapiens
MEHQLLCCEVETIRRAYPDANLLNDRVLRAMLKAEETCAPSVSYFKCVQKEVLPSMRKIVATWMLEVCEEQKCEEEVFPLAMNYLDRFLSLEPVKKSRLQLLGATCMFVASKMKETIPLTAEKLCIYTDGSIRPEELLQMELLLVNKLKWNLAAMTPHDFIEHFLSKMPEAEENKQIIRKHAQTFVASCATDVKFISNPPSMVAAGSVVAAVQGLNLRSPNNFLSYYRLTRFLSRVIKCDPDCLRACQEQIEALLESSLRQAQQNMDPKAAEEEEEEEEEVDLACTPTDVRDVDI

SEQ ID NO: 12938 - protein, 94 aa, Pinus pinaster
EYWWCTERALDWGPGGGPDLIVDDGGDTTLLIHEGVKAEEEFAKTGKVPDPSSTTNVEFQIVLELIKESLKVDPLRYHRMKDRIVGVSEETTTG

SEQ ID NO: 12939 - protein, 263 aa, Calystegia sepium
MSFGQGKWSLQGMTALVTGGTRGIGYGIVEELAGFGAEVYICSRKQNEVDECVGKWREKGFKVAGSACDISSRTQREELIKNVAHHFNGKLNILVNNAGTILPKDATEFKAEDYTLIMGTNFEASFHLCQLAHPFLKASSMGTIVFNSSVAGIIPVFKTTLYAASKGAINQVTKNLACEWAKDNIRVNSVAPWVIRTKLVNDFDSESEGSEEIERMIRRTPISRPGEVGEVSSLVAFLCLPAASYITGQTICVDGGYTITGFP

SEQ ID NO: 12940 - protein, 370 aa, Chlamydomonas reinhardtii
MARGPGDTDMDEASADAAIPSSTPNPTVAFRCTHALSGHTKAVAAVKFSPDGSLLASGSADRTVALWDAATGARVNTLAGHSCGVSDVAWNPNGRYLATAADDHSLKLWDAETGACLRTLTGHTNYVFCCNFDGAAGHLLASGSFDETLRLWDVRSGRCLREVPAHSDPVTSAAFSYDGSMVVTSSLDGLIRLWDTQTGHCLKTLFDRDSPPVSFAAFTPNAKYVLCNTLDGRAKLWDYAAGRTRRTYAGGHVNTQFCISSGFLGGSSSASFDLGCSMVVTGSEDGSLAAYDISTGHVVGRGAAAAAAAEGGGDEGSAAAAAAGGVAGGHTAAVLSVNVHPSAPLVATGGHHPDNSVRVWAASRTEPAAA

SEQ ID NO: 12941 - protein, 371 aa, Mus musculus
MVVVAAAPSAATAAPKVLLLSGQPASGGRALPLMVPGPRAAGSEASGTPQARKRQRLTHLSPEEKALRRKLKNRVAAQTARDRKKARMSELEQQVVDLEEENHKLQLENQLLREKTHGLVVENQELRTRLGMDTLDPDEVPEVEAKGSGVRLVAGSAESAAGAGPVVTSPEHLPMDSDTVASSDSESDILLGILDKLDPVMFFKCPSPESASLEELPEVYPEGPSSLPASLSLSVGTSSAKLEAINELIRFDHVYTKPLVLEIPSETESQTNVVVKIEEAPLSSSEEDHPEFIVSVKKEPLEDDFIPELGISNLLSSSHCLRPPSCLLDAHSDCGYEGSPSPFSDMSSPLGTDHSWEDTFANELFPQLISV

SEQ ID NO: 12942 - protein, 375 aa, Nicotiana tabacum
MADANMGAGGGQFPDFPSVLTHGGQYVQYDIFGNFFEITTKYRPPIMPIGRGAYGIVCSVLNTELNEMVAVKKIANAFDNYMDAKRTLREIKLLRHLDHENVIGLRDVIPPPLRREFSDVYIATELMDTDLHQIIRSNQGLSEDHCQYFMYQLLRGLKYIHSANVLHRDLKPSNLLLNANCDLKICDFGLARPNIENENMTEYVVTRWYRAPELLLNSSDYTAAIDVWSVGCIFMELMNRKPLFAGKDHVHQIRLLTEFLGTPTEADLGFLQNEDAKRYIRQLPQHPRQQLAEVFPHVNPLAIDLVDKMLTLDPTRRITVEEALDHPYLAKLHDAGDEPICPVPFSFDFEQQGIGEEQIKDMIYQEALSLNPEYA

SEQ ID NO: 12943 - protein, 350 aa, Sparus aurata
MGAGASAEDKKSKELEKQLQEDADKDSKTVKLLLLGAGESGKSTIVKQMKILHQGGYTKEEQLEFRAIIYGNILQSALAIIRGMEMLGIDFGSSTGQEDAQKLQNLSDSIEEGTMPSELADVIKKLWADSGVQASFERAAEFQLNDSAGYYLNEMERICKPEYLPTEQDVLRSRVKTTGIIEEQFSCKELHFRMFDVGGQRSERKKWIHCFEGVTCIIFCGALSAYDMVLVEDDEVNRMHESLHLFNSICNHRFFALTSIVLFLNKKDLFEEKIKKVHLSICFPDYDGPNSYEDASNYIKAQFEELNMKKGVKEIYSHLTCATDTKNVQIVFNAVTDIIIKENLKDCGLF

SEQ ID NO: 12944 - protein, 335 aa, Sulfolobus solfataricus
MALALKQRKVASWKLEEVKELTELIKNSNTILIGNLEGFPADKLHEIRKKLRGKATIKVTKNTLFKIAAKNAGIDIEKLEQYLTGPNVFIFTKDNPFITNMFFENYKLRRYAMPGDKAEEEVVIPAGDTGMPAGPILSVFGKLKVQTKVQDGKVHVVKDTVVAKPGDVIPAEALPILQKLGIMPVYVKLKIKVAYHEGLVIPAESLKLDLEGYRSNITEAYRNAFTLAVEIAYPTPDVLKFTISKVFKNAIALASEIGYITPESAQAVISKAVAKAYALATAIGGKVDLGVQLPTVQQSQSQQPAAEEKKEEKKEEEKKGPSEEEIASGLASLFG

SEQ ID NO: 12945 - protein, 769 aa, Onchocerca volvulus
MTKIFALNPTGKESDEKPKQLDGIAISPTIPSTTIYPVHLPITSIVAKKRSGISYLVVILLCLTTVMLPYIFFKITHRPISNEVTVSGSTLSWAQQSNKFGIANDDGQMIPQFYLTDGLKRMIGLDQNGYIIQDNRDNRIVGNQGSEIAANNDGETRQSDDNMIPDRFAALKAITTLLRIPGVQQVAVIQNDNRIPDNMIMTPESRTDEKASNLEETPIMSSAKSLTQPQVPFVPQMEAKDWEMMNYRRAMREWLLRREMFRRRMIAEMEREAAERRMAQFIMEQQQAQQQQQQQQQQQVQQQQQQPSESSLPLFLSMQMRLMNAQTMRMRNTAPSMMYVESANMQSPMEMIPTITVPIAQPVITPRIPPMYPFMFFRQQQQLQQQLEQQQQQQQLQQQQKQRQQQLQQQLQQQIQQQQQLQQEQQQQEQQEQQQQQPIMMPIKLMPPQMINREEPIIQPIESNPAKPNAMPIQIRDDSINRLDLEPKKEPIVEQPISMTLEGTPDRDTIFKELRSRAQMQQQMLQTAIPIMSPLAPSVVPPAQISSDEIFRELQQRALGMQIEQDRLEAEQRAEKEKTTDPDVPVLMIADTFPRRPVEEMPEQTAEEITEPTVSANIAVTTIDGNSDNLSESSDSPSPFFNFLDKEINENVITISPDKESEIIVKNGDVKVIPQHSAEDDAVRLAIAIAKDAEGMLKQDDTTPQSQVNFVREQRVTTEASSSSDKSEEIHKPKLLKSSTKLRDDSSYTLNGDEVLNAPIKLLATSQMQ

SEQ ID NO: 12946 - protein, 327 aa, Hordeum vulgare
MAGTGSTWILLEQKGAGPGARSSHAITLVGGTAYSFGGEFTPRLPVDNTMYAFDLKAQSWSALDAAGEVPPPRVGVTMASVGGTVFVFGGRDKDHTELNELYSFDTATSTWTLLSSGDDGPPHRSYHSMVADGEGSRVYVFGGCGNAGRLNDLWAYDVAAGRWEELPSPGAACPPRGGPGLAFADGKVWVVYGFSGDAELDDVHSYDPATGEWAVVDTTGDKPTPRSVLCAAGVGKHVVVFGGEVDPSDLGHLGAGKFSAEAFVLDTDTGAWARLDDAGSGHHPGPRGWCAFSAGALDGRRGMLVYGGNSPTNDRLGDMFLFTPLLA

SEQ ID NO: 12947 - protein, 518 aa, Lentinula edodes
MFYFSSFLLLGPIGGALAAIGPVTDLHIVNSFIQPDGFNRSGVLAEGVFPGPLITGNKGDNFQINVIDELTNGTMLLSTSIHWHGLFQKTTNWADGPAFVNQCPIAANDSFLYNFNVPDQAGTFWYHSHLSTQYCDGLRGPLVVYDPQDPYADLYDVDDDSTVITLADWYHVPAPQAGAVPTSDATLINGLGRSVNGPADAPFAVVNVVQGSRYRFRLVSISCDPNFLFSIDGHTFTVIEADGVNHEPIVADSIQIFAAQRYSFILTANQTADNYWIRANPNNGHTGFAGGINSAILRYSGAPVADPVTTQTSANLLQETSLVPRENPGAPGNATANGVDVDLNLVLSFVGGRFEINGVSFVPPTVPVLLQILSGATTAAELLPSGSVYTLPLNSVIQLSFNTVAVAAVGGPHPFHLHGHTFDVVRSAGSTEYNYINPPRRDVVSTGAATDNVTIRFTTDNAGPWFLHCHIDWHLEAGFAIVFAEDAPDVAAVNPVPDAWNQLCPTYDALTPAQLGGN

SEQ ID NO: 12948 - protein, 533 aa, Lentinula edodes
MLPFVSLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADWFHNTSTELIAAAVAPPADATLINGKGRYLGGPAVPLAVINVQQGKRYRFRMISIACDAYHNFSIDGHRLTVIEVDGENHEPATVDNIQIFPGQRYSFVLSATQPVDNYWVRALSSSGVGFSGFTGGLNSGILRYQGAPDADPTTTNSTGVVLTESMLHPLENPGAPGLPFPGGADEVLNLTLGFNLPATFFMNDTQYIPPTVPVLLQILSGAQSPQDLMPPGSVYTLPINKTIEINFFGNATPGGPHPFHLHGHSFDVVRSADNTTYNYKNPVRRDVTAVAIGNQTTIRFVTDNPGPWFLHCHIDLHLEFGLAVVMAEAPSLVKATDVTTPAWDELCPIYDSLTPAQLP

SEQ ID NO: 12949 - protein, 505 aa, Lentinula edodes
MLPFVSLLAAELVCLVYGAEVIRDTTSYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADWFHNTSTELIAAAVAPPADATLINGKGRYLGGPAVPLAVINVQQGKRYRFRMISIACDANHNFSIDGHRLTVIEVDGENHEPATVDNIQIFPGQRYSFVLDATQPVDNYWVRALSSSGVGTSGFIGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGHSFDVVRSADNTTYNYENPVRRDVTSVAIGNQTTIRFVTDNPGPWFLHCLLLKPYRPSFGIRTCRRNG

SEQ ID NO: 12950 - protein, 346 aa, Asterina pectinifera
MSKEFFWGDSLTGTKKEVKWNPSLDDEDDFDNLDSDGIQHFLFLKQAVLGATAKEGERNVVEIETENFDGDNVKQPLFSLKLGLNESSPLDIGIQPPVTFILTAGSGPVFLSGQHMIEISADDEEELEEDDEEEEEEDEVEVNASPDLPVAKSKKRPLSTSDGTAKKTKMAKLDKDADKKEDDDEEEDDEEEDEVMAMMDDDEDDEDDEDFEGGEDDEEEDEEESDEDEDDEDDNEEEEEEDEDEESPEKPLKTTAKGKKGQMNGTTTAKGDNKPKAKAKTDTKLVKGKAKKKVLALDEIKGKLQESSNVPKKEEKFKNYVRSAFHISEAKKLQDLWGWFRASLQK

SEQ ID NO: 12951 - protein, 288 aa, Sus scrofa
MELLCCEVDPVRRAVPDANLLHDDRVLQNLLTIEERYLPQCSYFKCVQKDIQPYMRRMVATWMLEVCEEQKCEEEVFPLAINYLDRFLAGVPTPKTHLQLLGAVCMFLASKLKETIPLTAEKLCIYTDNSIKPQELLEWELVVLGKLKWNLAAVTPHDFIEHILRKLPQPNEKLSLIRKHAQTFIALCATDFKFAMYPPSMIATGSVGAAICGLQQDEDVSSLTGDALVDLLARITNTDVDCLKACQEQIEVVLLNSLQQYRQDQDGSKSEDELDQASTPTDVRDIDL

SEQ ID NO: 12952 - protein, 827 aa, Tribolodon hakonensis
MALLRQFALLLALLMVFSTPCKVAALEVGSNYSSKSTAAETPSNVTTTTITTLPIVTWKWHHVETPYLVALWILTCWLCKLVCELNHSITSVIPESGLLIMMGFILGGIVWGADKAQTFKLIPVNFFYYLLPQIVLDASYCMPNKLFFSNLGAILVHAIIGTCWNAGTVGIALWACYEWGAMGTLNIGPLQFLLFGSLMSAVDPVAVIAVFEEVHVNEVLYILVFGESLLNDGVTVVLYNVFDAFVTLGGPRINAEEIIKGIISFFVVAFGGSFLGVVFAILISMLTRVTKNVQVIEAGFIIVLGYLSYLTAEMLSLSAILSITFCGVCCQKYVNANMDEKSVTTLRYTLKVMANGSETMIFVFLGVSAIDKNIWVWNTGFILLTVLFIIVFRFMGVFFLNWILNQTRLIPIDITDQIVMSYGGLRGAVAYGLAATLDEAKIPEKNLMLGTTLIVVYFTVVLQGITMKPFVQWLKVKKATISDLTLNGKINNRTFEHTLTAMEDICGRMGDNWWTRHWKNFEDKYVCWLLMNSDARKHNDNIFGAFHKLNLEDAKNYVTVGENKGSLAFIRNDDNASVDFKKKLALEYENVMPDMSDMSEYDFGIDNVPVNSFMKNQIPSVSLDIHEQDRKSMPDDLSAHHLLEQHLYKSRRYNRPTYSRSHYKASENPDEMQEIFQRTMRSRLESFKSAKMGVNPAKKLSKHPKKDSSHKPNGKPADPNRTFPYGDEDFEFSADSASSSEIGHFPRRSTNAPGAGVDNPAFIPEMDNTAVAPSQRTQGRPPWTTTNLRHLAPLRRSSRSTDSIPMADASVDEEASEEKPGKNHTRL

SEQ ID NO: 12953 - protein, 410 aa, Malus x domestica
MDPDAFSANLFKWDLRGMVVPTNRVQLEAAVPPAATAGGAAAGYTLRPSRELGLGGLEDLFQAYGVRYYTAAKIAKLGFTVNTLLDMKDDELDDMMSSLSQIFRWELLVGERYGIKAAVRAERRRFEEEDSRRRNPVSGDTTTNALDALSQEGLSEEPVQQEKEMVGTGVGMAWEVVTAGERRKKQRRMKKGQYRNCSAGGGHDNDHNEGVDDKDDDMDNMNGQGNGGGGGLLGERQREHPFIVTEPGEVARGKKNGLDYLFYLYELCRDFLIQVQNIAKERGEKCPTKVTNQVFRYAKKSGASYINKPKMRHYVHCYALHCLDVEASNVLRRAFKERGENVGAWRQACYKPLVVIAAAQGWDIDAIFNSHPRLSIWYVPTKLRQLCHAERHNATASSSASGGGGEHLPY

SEQ ID NO: 12954 - protein, 410 aa, Malus x domestica
MDPDAFSANLFKWGLRGMVVPTNRVQLEAAVPPAAAAAAAAAGCTLRPPGELGLGGLEDLFQAYGVRYYTAAKIAELGFTVKTLLDMTDDELDDMMSSLSQIFRWELLVGERYGIKAAVRAERRHLDEEDSRRRNHVSGDTTTNALDALSQEGLSEEPVQQEKEMVGSGGGAAWEVATAGERRKKQRRMKKGQFRNCSAGGRHNNDNNEGVDDEDDNDMDDMTGHGNGGGGGMLGERQREHPFIVTEPGEVARGKKNGLDYLFHLYEQCRDFLIQVQNIAKERGEKCPTKVTNQVFRYAKKAGASYINKPKMRHYVHCYALHCLDEEASNALRRAFKERGENVGAWRQACYKPLVAIAAGQGWDIDAIFNSHPRLSIWYVPTKLRQLCHAERNNATASSSASGGGDHLPY

SEQ ID NO: 12955 - protein, 209 aa, Allium cepa
MGLKLYGPTLSPNVVRVIAVLNEKGLDFELIPVDMKSGEHKKPEFLQINPFGQVPALEDGDIKLFESRAICRYLATKYKESGTDLLPAKTAAEMAATEIWLEVESQQFSQPISKVCFELLIKPILGMVTDEEAAEKHATDAIKILDVYEARLSQSKHLAGDEFTLADCNHMAWLNVLMMTKKACLVNDRPHLKAWWEIVSARPAWQKTA

SEQ ID NO: 12956 - protein, 258 aa, Pseudomonas putida
MSTEFNGKKLLVIGGTSGMGLQTARMVLEQGGSVVIVGHREDKAEEARKALSSLGTVTALTADLSRAEDVKRLLHTIDEHHKDINLLVNAAGVFFPKAFLEHTESDYEQYLTLNKAFFFITQKVVANLVASERPGAIVNIGSMWGKQAIAATPSSAYSMAKAGLHSLTQHLAMELASKQIRVNAVSPAVVETPIYEGFIPKAEVHGALQGFNSFHPIGRVGTPQDVAEVILFLLSDKAAWVTGAIWDVDGGVMAGRNT

SEQ ID NO: 12957 - protein, 269 aa, Pseudomonas putida
MNKRFQGKVAVITGAAQGIGRRVAERMAAEGGRLLLVDRSELIHELADELVGVAEVLTLTADLEQFAECQRVMAAALERFGRLDILINNVGGTIWAKPFEHYQEREIEAEVRRSLFPTLWCCHAALAPMIEQGSGAIVNVSSVATRGIHRVPYGAAKGGVNALTACLAFETAERGIRVNATAPGGTEARHGGFRNSAEPSEQEKVWYQQIVDQSLDSSLMKRYGSIDEQVEAILFLASDAASYITGITLPVAGGDLGCQSCSVMFSVSG

SEQ ID NO: 12958 - protein, 366 aa, Pseudomonas putida
MEIKAAIVRQKNGPFLLEHVALNEPAEDQVLVRLVATGLCHTDLVCRDQHYPVPLPMVFGHEGAGVVERVGSAVKKVQPGDHVVLTFYTCGSCDACLSGDPTSCANSFGPNFMGRSVTGECTIHDHQGAEVGASFFGQSSFATYALSYERNTVKVTKDVPLELLGPLGCGIQTGAGSVLNALNPPAGSAIAIFGAGAVGLSAVMAAVVAGCTTIIAVDVKENRLELASELGATHIINPAANDPIEAIKEIFADGVPYVLETSGLPAVLTQAILSSAIGGEIGIVGAPPMGATVPVDINFLLFNRKLRGIVEGQSISDIFIPRLVELYRQGKFPFDKLIKFYPFDEINRAAEDSEKGVTLKPVLRIG

SEQ ID NO: 12959 - protein, 348 aa, Theileria annulata
MDQMEVPDNDKNRKYPTKDLKIILPKTYADVNSKKGPEYWDYENITLKWNVPDSYEIVRKIGRGKFSEVFEGLNTVTKDKCVIKILKPVKKKKIKREIKILQNLRGGPNIIKLLDIVKDPQSRTPSLIFEHVNNTDFKTLYPTLTIQDIKYYIYQLLKAMNYCHSQGIMPRDIKPHNVMIDHEKKILRLIDWGLAEFYHPEQEYSVRVATRYYKGPELLVDMRYYDYSLDIWSIGCMLAGIIFKKEPFFYGHDNYDQLVKIAKVLGTEDLHRYFEKYGLKFAPAYQEILGNHSKKPWTKFVHHENQHLVSPEVMDLLDRMLVYDHTKGITPLEAMEHPFFNEIKNNSV

SEQ ID NO: 12960 - protein, 359 aa, Mus musculus
MAVVAGLVRGPLRQASGLLKRRFHRSAPAAVQLTVREAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSAGLQPVPIVFRGPNGASAGVAAQHSQCFAAWYGHCPGLKVVSPWNSEDAKGLIKSAIRDNNPVVMLENELMYGVAFELPAEAQSKDFLIPIGKAKIERQGTHITVVAHSRPVGHCLEAAAVLSKEGIECEVINLRTIRPMDIEAIEASVMKTNHLVTVEGGWPQFGVGAEICARIMEGPAFNFLDAPAVRVTGADVPMPYAKVLEDNSVPQVKDIIFAVKKTLNI

SEQ ID NO: 12961 - protein, 536 aa, Escherichia coli
MVSAPVDGAISGLSVQNGIAIGPVKWFTCERPEITQRTVDSPQEELSRIESAIDIVVCELADKAAGPEGDIFAAHKMMLEDPEINRQLQQRLAKGKQAEFAWLEVMQALAEQYCQAETLYLREREADIRDLTRQVLNQLCGVSEQHFITTAPCILLANDLLPSQITSLNKAHILGICLHNGGTTSHTAILARAMGIPAIVKAAITPQNVRDNDTVILDGETGRLWLQPDEVTRLDLLQRAEAWRQQRDRQLADAMLPAVTQGGRKISVLANIGDLQDIEAALSHGAEGVGLLRTEFLFHESATLPDEEEQFRVYCSVAQAFGDKPVTIRTLDIGGDKPLPSYPLPAEDNPFLGLRGIRLCLAHPQIFIPQLRALLRAGKEYPTLQIMLPMVSTLEEVNAVKTLIQTQAKLLGLTAENLPALGIMIEVPAAVMVAEKLASEVDFFSIGTNDLTQYIMAADRGNSTVAKLVDYRNDAVINAIAMVCQAGRNNEIPVSMCGEMAGDTQQTARLLTMGIDKLSASPSRLPALKAAIRASH

SEQ ID NO: 12962 - protein, 443 aa, Escherichia coli
MHYLKKRFSLIELNVFIPAILFIAVIILCLTIYPQDTSRYINKIHHFLTWEMGGIFLVMTFLVVLCCLWLAFSRYGDILLGQSGEKPDFSLLTWLGLIFTSGTGGSLLYLASVEWIWIIQQPPFGATAGSAQAARWASVYGMFHWGPSAWAWYLICAVPIGWFMHVKKTNSLKVSDLCRGCLGARADGFCGHCVNFFYMFGLLGGAVTSLALGTPMISAVFCHVFHLDPAGQFINVMVIFIWTLVPLFILFFGLKKGVAWASNWNIRADILMLLAILICGPTAFILNQSIDGLGLMLQNFVAMSLSTDAIGRSGFPQMWTVFYFSWWVVYAIPFGLFIARISKGRTIRQLIVCGTLAGSLGCMVFYMVLANFGLSLQTTHVIDFVPILNEQGRGVVVSRLLEQLPASQVFLVAFGAIALISYITGHCTVGYALGFATQKRPDK

SEQ ID NO: 12963 - protein, 538 aa, Rhizobium sp. BR816
MKQSGRVVIITGAAGGIGRALGNAFAEDGDTVVAVDLPGRGILEFARGLGHRHLGLEFDVSREKDIVELCGRIEAQFARVGVLINNAAIGPIMAATIDNSVDVFRHTLAVNLIGPFAMAREAARRMQPGAVVVNVASLAGVLGNPRRNAYAASKAGLISITKSLACELAPRGIRVTAVAPGYVRTPMVDRLERAGEMNLAAVRPALPIGRMARPDEIARVLRFLASPQTGYVNGSVLTVDGGWMSFNQPGDAHPPVGEIPAAELSRPPSSAVARLVLVTGGANDIGAAVARRFAANGDTVVIADRDGVAAAELAGSLGGEHMAKSVDVAVESEVVGLFEEVRGRFGRLDVLVNGACVADTFGPGNQQITAQLERVLDVNLTGAFTCAREAIKMMRPGGVILNVGSIDAFLPSAPRHAYEASQAGIEILTRCMAAELGPGGIRTATIALGSTRPSSVAGSAKVGDIAAKVIRRRIPGRMGEPEDVAAAAFFLASPDASYISGSTLCVNGGCTSFGNTGFATDLDQEHPVVDAKWLSFMP

SEQ ID NO: 12964 - protein, 537 aa, Pichia angusta
MSILALVATSIGSAQAAAIKKDTAGQHPLGMNSNFGDVFVEKGKSLLDRVSEVVSESSKNISPELRDIWNEMEAKFPDTLRNMKLKSEPAVKITKKPADFWDFNVLNEKFSNYKLRVKKTDPGALGLDHTRQYSGYLDVEDEDKHFFYWMFESRNDPVNDPVILWLNGGPGCSSLTGMLFELGSASIGPDLKPINNPYSWNSNATVIFLDQPVNVGFSYSSKSVSNTVAAGKDVYAFLELFYQQFPHLLKNDFHIAGESYGGHYIPVFASEILTHADRSFNLTSVLIGNGLTDPLNQYPFYERMACSTDGGYEPTLDESECEGMLETLPRCLSLIESCYSSQSVFSCVPASIYCNNAQLGPFQKTGRNVYDVRKMCEGTLCYKDMEYIDQYLNQDFVKEKVGAEVDTYESCNFDVNRNFLFAGDWMKPYHKNVINLLEQGLPVLIYAGDKDFICNWLGNQAWSNELPWSGHDEFESAELYNLTLKDGTKVGEVKNAGKFTFARMFDGGHMVPYDQPESSLAMVNRWIAGDYSLGTKK

SEQ ID NO: 12965 - protein, 323 aa, Homo sapiens
MDSKQQCVKLNDGHFMPVLGFGTYAPPEVPRSKALEVTKLAIEAGFRHIDSAHLYNNEEQVGLAIRSKIADGSVMREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEIILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEY

SEQ ID NO: 12966 - protein, 478 aa, Clostridium josui
MKKIKRLIALAILTMVFISPFPASVLNFNQVMALNNGLGLTPPMGWNSWNIFGGDINEDKIKEIADAMVTTGMKDAGYEYVNLDDNWMANPARDANGKLIPDPKRFPSGMKALADYIHSKGLKFGIYGDRGVTTCCNIPQSGSQGYEEQDAKTFAEWGLDYLKYDNCASDSNLQAGYEKMRDALLKTGRPIFYSICCWYFAGPWMVDCGNSWRTTGDISDSWGSIIRNIDENSKSAAYAGPGHWNDPDMLEVGNGNMTDTEYKAHFSMWCMMAAPLIAGNDLRNMTPATKEILTNKEVIAIDQDAAGVQGTKVSSSGELEVWCKPLGTDGTTKAVALLNRGATSADITVNWSDIQLADGPVTVRDLWEHKDCGTFNTGYTANVPSHGVVVLKVQASSTDTNIEFGDVDGNGMIDALDYSLVKRYLLGQISDCPDSKGKLAADVDGDQQITALDFSLIKQYLLGTINKFPAQTASKIKP

SEQ ID NO: 12967 - protein, 315 aa, Phaseolus lunatus
MSNFPVINFERLNGEERKDTMEKIKDACENWGFFELVNHGIPHDLLDTVERLTKEHYQKCMEERFKELMASKGLEAIQTEVKDMDWESTFHLRHLPESNISEVPDLVDEYRKVMKDFALRLEKLAEQLLDLLCENLGLEKGYLKKAFYGSRGPTFGTKVANYPPCPNPELVKGLRPHTDAGGIILLFQDDKVSGLQLLKDDQWVDVPPMRHSIVVNIGDQLEVITNGKYKSVEHRVIAQTDGTRMSIASFYNPGSDAVIYPAPELLEKEAEEKAQLYPKFVFEDYMKLYAKLKFQAKEPRFEAFKASNFDPIATA

SEQ ID NO: 12968 - protein, 101 aa, Caenorhabditis elegans
MEVEEATNQTVKKRFEVKKWSAVALWAWDIQVDNCAICRNHIMDLCIECQANQAAGLKDECTVAWGNCNHAFHFHCISRWLKTRQVCPLDNREWEFQKYGH

SEQ ID NO: 12969 - protein, 261 aa, Oryzias latipes
MAASTRLISRLTLVTGGGSGIGRAVCQRLASEGASVVVADINQESADETFSSLPDNLRGQVHMATVVDVSLKDSVKKLVTNIQTRYFQPPSVCVNTAGITQDEFLLNMEEEQFDRVIQVNLKGSFLVTQAVAQALVACGASKGSIITVGSIVGKVGNLGQANYAASKAGVEGLTRTAAKELSRFGIRCNCVLPGFITTPMTDKVPEKVISKITTLVPLGRMGEPAEVADACAFLASDDSRYITGTSIEVTGAVLEQKNPFH

SEQ ID NO: 12970 - protein, 500 aa, Euphorbia lagascae
MEQKNLSFPSILISFLLVLILVVVMRLWKKQNPPPGPWKFPIIGNLPHLLLTSDLGHERFRALAQIYGPVMSLQIGQVSAVVISSAEAAKEVMKTQADAFAQRPIVLDAQIVFYNRKDVLFASYGDHWRQMKKIWILEFLSAKKVQSSRLIREEEMEDAITFLRSKAGSPVNITKIIYGIIISIMIRTSVGNCKQKERLLSVADAVNEAATSFGTADAFPTWKLLHYIIGAESKPRRLHQEIDDILEEILNEHKANKPFEADNLMDVLLNLQKNGNVPVPVTNESIKASVLQMFTAGSETTSKATEWVMAELMKNPTELRKAQEEVRQVFGEMGKVDESRFHDLKFFKLVVKETLRLHPPVVLIPRECRETTRIDGYEIHPNTRIVVNAWAIGRDPNTWSEPGKFNPERFKDCAIDYKGTTFELVPFGAGKRICPGITSAITNLEYVIINLLYHFNWELADGITPQTLDMTEAIGGALRKKIDLKLIPIPYQVSLGSNIS

SEQ ID NO: 12971 - protein, 478 aa, Mus musculus
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIN

SEQ ID NO: 12972 - protein, 727 aa, Rattus norvegicus
MAKDKGLISPEDFAQLQKYIDYSTKSVSDVLKVFEMNKYCQGDEIGYLGFEQFLKMYLEVEEVPHHLCWTLFWSFHSSQDLDEETESKANVICLSDVYCYFTLLEGGSPEDKLEFTFKLYDMDRNGILDSTEVEKIILQMMRVAEYLDWDVSELRPILQEMMKEMDRDGSGCVSLAEWVRAGATTVPLLVLLGIDMTMKDDGHHIWRPKRFSRPVYCNLCELSIGLGKQGLSCNLCKYIVHDHCAMKAQPCEVSTYAKSRKDIGVQPHVWVRGGCHSGRCDRCQKKIRTYHSLTGLHCVWCHLEIHDDCLQAVGPECDCGLLRDHILPPCSIYPRVLVSGQECKQKTTDVTSLCTPEAFRIEPVSNTHPLLVFINPKSGGKQGQSVLWKFQYILNPRQVFNLKDGPEPGLRFFKDVPQFRVLVCGGDGTVGWILETIDKANFPIVPPVAVLPLGTGNDLARCLRWGRGYEGENLRKILKDIEISKVVYLDRWLLEVIPQQNGEKSDPVPSQIINNYFSIGVDASIAHRFHLMREKYPEKFNSRMKNKLWYLEFATSESIFSTCKKLEESVTVEICGKLLDLSDLSLEGIAVLNIPSMHGGSNLWGDTKRPHGDTCGINQALGSVAKIITDPDILKTCVPDMSDKRLEVVGIEGVIEMGQIYTRLKSAGHRLAKCSEITFQTTKTLPMQVDGEPWMQAPCTIKITHKNQMPMLMGPAPSSSNFFGFWS

SEQ ID NO: 12973 - protein, 488 aa, Retama raetam
MVEPSPTTGSFSKLLQTVHGSMPSAASATFPVTTACFNTNTVEERKSNIFEFKPHNKSNMVPADFKNHVSEQSIQAEGPGKAQSFASSPLIECEIDVPSNELSLSSPVQMVSSGASTPVEVDSDELNHKGNTITVLQASQVEEVKGSGLPVAPERASDDGYNWRKYGQKLVKGSEFPRSYYKCTHPNCEVKKLLECSHDGQITEIVYKGMHDHPKPQPSRRYSVSMQEERSGKASLAGRDAEPNSTPDLSSVATNDDSREGADRTNDEVDDDDPFSKRRKMELGFADITHVVKPIREPRVVVKTLSEVDILDDGYRWRKYGQKVVRGNPNPRSYYKCTNAGCPVRKHVERASHDPKAVITTYEGKHNHDVPAARNSSHDMAGPAGVVGGQTRIKLEESDSISLDRGMGISSAAENRSNGQGKMLLSEFGNSQTQTSNSNFKFVHTTAGPVYFGVNPYGSIENRSDGPSLNHASSYPCSQNIGRILTGP

SEQ ID NO: 12974 - protein, 190 aa, Mus musculus
SVLFPCKYASSGCEITLPHTEKAEHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 12975 - protein, 369 aa, Pyrobaculum aerophilum
HHHHHHSSGLVPRGSGMKETAAAKFERNHMDSPDLGTDDDDKMVAGVVMMANMAKAINMALHEEMERDERVVVLGEDVGKKGGVFLVTEGLYERFGPERVIDTPLNEGGILGFAMGMAMAGLKPVAEIQFVDFIWLGADELLNHIAKLRYRSGGNYKAPLVVRTPVGSGTRGGLYHSNSPEAIFVHTPGLVVVMPSTPYNAKGLLKAAIRGDDPVVFLEPKILYRAPREEVPEGDYVVEIGKARVAREGDDVTLVTYGAVVHKALEAAERVKASVEVVDLQTLNPLDFDTVLKSVSKTGRLIIAHDSPKTGGLGAEVRALVAEKALDRLTAPVIRLAGPDVPQSPIAADAAYAPTVERIIKAIEYVMRY

SEQ ID NO: 12976 - protein, 444 aa, Arabidopsis thaliana
MATITVVKARQIFDSRGNPTVEVDIHTSNGIKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGHDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 12977 - protein, 466 aa, Lactococcus lactis subsp. cremoris
MLYGKENRDEAEFLEPIFGSESEQVDLPKYKLAQQSIEPRVAYQLVQDEMLDEGNARLNLATFCQTYMEPEAVKLMSQTLEKNAIDKSEYPRTTEIENRCVNMIADLWNASEKGKIYGTSTIGSSEACMLGGMAMKFSWRKRAEKLGLDINAKKPNLVISSGYQVCWEKFCVYWDIEMREVPMDREHMSINLEKVMDYVDEYTIGVVGIMGITYTGRYDDIKALDNLIEEYNKQTDYKVYIHVDAASGGLYAPFVEPELEWDFRLKNVISINTSGHKYGLVYPGVGWVLWRDKKYLPEELIFKVSYLGGELPTMAINFSHSASQLIGQYYNFVRYGFDGYKAIHERTHKVAMYLAEEIEKTGMFEIMNDGAQLPIVCYKLKENSNRGWNLYDLADRLLMKGWQVPAYPLPKNLENEIIQRLVIRADFGMNMAFNYVQDMQEAIDALNKAHILFHQEPENKTYGFTH

SEQ ID NO: 12978 - protein, 248 aa, Ovis aries
MERASLIQKAKLAEQAERYEDMAAFMKSAVEKGEELSCEERNLLSVAYKNVVGGQRAAWRVLSSIEQKSNEESSEEKGPEVQEYREKVETELRGVCDTVLGLLDTHLIKEAGDAESRVFYLKMKGDYYRYLAEVATGDDKKRIIDSARSAYQEAMDISKKEMPPTNPIRLGLALNFSVFHYEIANSPEEAISLAKTTFDEAMADLHTLSEDSYKDSTLIMQLLRDNLTLWTADNAGEEGGEAPEEPQS

SEQ ID NO: 12979 - protein, 364 aa, Lactococcus lactis subsp. cremoris
AYEKAVKGYITKRKPLGEALDEEIMDELSVKFGIVDDALEDLFKQIQDAGISIVDKDGNPSPLALVTDEIEKEEVSDTAMDEIVTNVRIDDPVRMYLKEIGRYPLISLDEETKLAEAIIAGGEGAEFAKQMLAEANLRLVVSIAKRYSGRGMQFLDLIQEGNMGLMKAVDKFDQTKGFKFSTYATWWIRQAITRAIADQARTIRIPVHMVETINKLIRVQRNLLQELGRDPSPEEIGKELHMAPDKVREVLKIAQEPVSLETPIGEEDDSHLGDFIEDDVIESPVDYTNRILLREQLDEVMDTLTDREENVLRMRFGLDDGRMHTLEDVGKQFKVTRERIRQIEAKAIKKLRHPRRSKPLRDFM

SEQ ID NO: 12980 - protein, 363 aa, Toxoplasma gondii
MAVDSSNSATGPMRVFAIGNPILDLVAEVPSSFLDEFFLKRGDATLATPEQMRIYSTLDQFNPTSLPGGSALNSVRVVQKLLRKPGSAGYMGAIGDDPRGQVLKELCDKEGLATRFMVAPGQSTGVCAVLINEKERTLCTHLGACGSFRLPEDWTTFASGALIFYATAYTLTATPKNALEVAGYAHGIPNAIFTLNLSAPFCVELYKDAMQSLLLHTNILFGNEEEFAHLAKVHNLVAAEKTALSTANKEHAVEVCTGALRLLTAGQNTGATKLVVMTRGHNPVIAAEQTADGTVVVHEVGVPVVAAEKIVDTNGAGDAFVGGFLYALSQGKTVKQCIMCGNACAQDVIQHVGFSLSFTSLPC

SEQ ID NO: 12981 - protein, 456 aa, Homo sapiens
GTRRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 12982 - protein, 354 aa, Ciona intestinalis
MGCTVSTDDKAANERSRAIDRNLRVDGDKQSREVKLLLLGAGESGKSTIVKQMKIIHEDGYSEEECLQYKAVVYSNTLQSLITIVRAMGNLKIDFGSSDRADDARQLFSLAGSLEDGEMTQELGDCMKRMWGDKGVQVCFNRSREFQLNDSAQYYLDSLDRLVASDYVPTEQDVLRSRVKTTGIVETQFEHKDLHFKMFDVGGQRSERKKWIHCFEGVTAIIFCVALSAYDLVLAEDEEMNRMHESMKLFDSICNNKWFTETSIILFLNKKDLFEVKILKSPLSICFPEYPGQNTYAEAAAYIQLQFEDLNKRKDSKEIYTHFTCATDTTNIQFVFDAVTDVIIKNNLKDCGLF

SEQ ID NO: 12983 - protein, 354 aa, Ciona intestinalis
MGCTVSTDDKAANERSRAIDRNLRVDGDKQSREVKLLLLGAGESGKSTIVKQMKIIHEDGYSEEECLQYKAVVYSNTLQSLITIVRAMGNLKIDFGSSDRADDARQLFSLAGSLEDGEMTQELGDCMKRMWGDKGVQVCFNRSREFQLNDSAQYYLDSLDRLTEPRYVPTQQDVLRTRVKTTGIVEVDFNFKGLTFKMFDVGGQRSERKKWIHCFEGVTAIIFCVALSAYDLVLAEDEEMNRMHESMKLFDSICNNKWFTETSIILFLNKKDLFEVKILKSPLSICFPEYPGQNTYAEAAAYIQLQFEDLNKRKDSKEIYTHFTCATDTTNIQFVFDAVTDVIIKNNLKDCGLF

SEQ ID NO: 12984 - protein, 164 aa, Ciona intestinalis
KQMRIIHGTGYSHEELAGHIPLIYQNINFSIKTLATAMLELGIPYELEANKDFGEVSIELPRECENSLDTTRVLGIMLFWKDEGVQQCYLRRNEFHLLDSAAYYLNNLTRISSASYLPTLQDVLRSRRPTLGITEYLFKIDKFMFGIVDVGGQKSERRKWIHCF

SEQ ID NO: 12985 - protein, 165 aa, Ciona intestinalis
KQMKIIHGAGYSDEDKRSFIKLVYQNIVTSIQNMSAAMQTLNLEYEIEENNEHAEEIREVQVDKISSYDDFITNISYIECLWKDTGIQKCYDRRREYQLSDSTYYYLSDLDRIKKPDFLPTQQDILRVRIPTTGIIEYPFDLDQIIFRMVDVGGQRSERRKWIHC

SEQ ID NO: 12986 - protein, 165 aa, Ciona intestinalis
KQMRIIHESGYSEDECIQYKPVVYSNTIQSMLAIIRAMGTLSIEFANPERQDDARQLFSLAGSVEDGSFTPELISIMKRLWQDDTLQQCFQRAREYQLNDSAGYYLFALERIGAPDYVPTQQDVLRTRVKTTGIVETHFVFKDLHFKMFDVGGQRSERKKWIHCF

SEQ ID NO: 12987 - protein, 741 aa, Pyrus communis
MEACNCIEPQWPADELLMKYQYISDFFIALAYFSIPLELIYFVKKSAVFPYRWVLVQFGAFIVLCGATHLINLWTFNMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLHQQNPVGYTVPIHLPVVNQVFSSNCAVKISPNSPVARLRQLAGKHIPGEVVAVRVPLLHLSNFQINDWPELSTKRYALMVLMLPSDSARQWHVHELELVEVVADQVAVALSHAAILEESMRARDLLMEQNIALDLASREAETAIRARNDFLAVMNHEMRTPMHAIIALSSLLQETDLTPEQRLMVETILKSSNLLATLINDVLDLSRLEDGSLQLDIATFNLHSIFREVHNMIKPVASIKRLSVALNIAADLPVYAIGDEKRLMQIILNVVGNAVKFSKEGSISITAYVAKSESLRDFRAPDFFPVQSDNHFYLRVQVKDSGSGINPQDIPNLFTKFTQTQTLASQNSGGSGLGLAICKRFVNLMEGHIWIESEGLGKGCTATFIVKLGFPERSNESKQPFAPKLQANHVQTNFPGLKVLVMDDNGVSRSVTKGLLVHLGCDVTTVSSIDEFLHVISQEHKVVFMDVCMPGIDGYELAVRIHERFTKRHERPVLVALTGSIDKMTKENCMRVGMDGVILKPVSVDKMRSVLSELLEHRVLFEAM

SEQ ID NO: 12988 - protein, 150 aa, Pyrus communis
MAEQGFMDKAKNFVTDKISNVAKPEAEVTDVDFKKMGLSHVEYLSKVSVTNPYSHSIPICDIKYTLKSVNREIASGTIPDPGSLKASDITVLEVLLKVPHSILVTLAKDLGADWDFDYELDIGLTIDLPVIGNFTTPLNKKGEFKLPTLF

SEQ ID NO: 12989 - protein, 639 aa, Pyrus communis
MESCDCIEAQWPPDELLVKYQYISNVFIALAYFSIPLELVYFVQKSAFFPYRWVLVQFGAFIVLCGATHFINVWTFSMHTKTVAIVMTVAKVSCAVVSCRTALMLVHIIPDLLSVKKRELSLKSRAEELDKEMGLMLTQEETGRHVRMLTHEIRGTLDRDTILKTTLVELGRTLGLEECALWMPSRTGMNLQLHHTLNYQIQVGSTVSINLPVVNEVFNSSRAIRVPYTCPLARIRPLVGRYVPPEVVALRVPLLNLSNFEINDWPDLSAKSYAIMVLILPTDSTRKWRDHELELVDVVADQVAVALSHAAILEESMRARAQLMEQNKALDLARREAEMAIHARNDFLAVMNHEMRTPMQAIIALSSLLLETELTPEQRLMIETVLKSSNLLETLINDVLDLSRLDDSSLELDNEIFNLHGVFREVMNLVQPIASVKKLSMTLILAPDLPVCAVGDENRLMQTILNVAGNAVKFTKQGYISIYYASVAKPEVFKRLATTGVYPESIEGHFYLRVQVKDSGCGILPEDIPHVFTKFSQPRNGSNRINEGAGLGLAICKRFVNTMGGHIWIESEGIDKGSIVAFIVKLGICDNHSDTTTHQVQMPPKGQANYGSGDLVGRKPSFRVRFGASSSIARYQRSL

SEQ ID NO: 12990 - protein, 638 aa, Pyrus communis
MESCDCVDAQWPPDELLVKYQYISDVFIALAYFSIPLELVYFVQKSAFFPYRWVLMQFGAFIVLCGATHFINVWTFSMHTKTVAIVMTVAKVSCAVVSCATALMLVHIIPDLLSVKSRELRLKNRAEELDREMGLMPTQEETGRHVRMLTHEIRSTLDRDTILKTTLVELGRTLGLEECALWMPSRTGMNLQLHHTLNYQIQVGSTVSINLPVVNEVFNSSRAIRVPYTCPLARIRPLVGRYVPPEVVALRVPLLNLSNSEINDWPDLSAKSYAIMVLILPTDSTRKWRDHELELVDVVADQVAVALSHAAILEESMRARAQLMEQNKALDLARREAEMAIHARNDFLAVMNHEMRTPMQAIIALSSLLLETELTPEQRLMIETVLKSSNLLETLINDVLDLSRLDDGSLELDNEIFNLHGVFREVMNLVQPIASVKKLSMTLILAPDLPVCAVGDENRLMQTILNVAGNAVKFTKQGYISIIASVAKPESSRDLATTGVYPESIEGHFYLRVQVKDSGCGILPEDIPHVFTKFSQPRNGSNRINEGAGLGLAICKRFVNTMGGHIWIESEGIDKGSIVAFIVKLGVCDNHSDTTTHQVQMPPKGQANYGSGDLVGRKPSFRVRFGASSSIARYQRSL

SEQ ID NO: 12991 - protein, 741 aa, Pyrus communis
MEACNCIEPQWPADELLMKYQYISDFFIALAYFSIPLELIYFVKKSAVFPYRWVLVQFGAFIVLCGATHLINLWTFSMHSRTVAIVMTMAKVLTAVVSCATALMLVHIIPDLLSVKTRELFLKNKAAELDREMGLIRTQEETGRHVRMLTHEIRSTLDRHTILKTTLVELGGTLALEECALWMPTRTGLELQLSYTLRQQNPVGYTVPIHLPVINQVFSSNRAVKISPNSPVARLRQLAGRHIPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTPEQRLMVETILRSSNLLATLVNDVLDLSRLEDGSLQLEIATFNLHSVFREVHNLIKPVASVKKLSVTLNIAADLPMYAIGDEKRLMQTILNVVGNAVKFSKEGSISITAFVAKSESLRDFRAPDFFPVQSDNHFYLRVQVKDSGSGINPQDIPKLFTKFAQTQTLATRNSGGSGLGLAICKRYVNLMEGHIWIESEGLGKGCTATFIVKLGFPERSNESKLPFGPKLQANHVQTNFPGLKVLVMDDNGVSRSVTKGLLAHLGCDVTAVSLIDESLHVISQEHKVVFMDVSMPGIDGYELAVRIHEKFTKRHERPALVALTGSIDKITKENCMRVGVDGVILKPVSVDKMRSVLSEILEHRVLFEAM

SEQ ID NO: 12992 - protein, 219 aa, Pyrus communis
GKLRSNFLGTKFTIFDGQPSHSGARIAKSRSTRLVNLKQETPRVPAGNYPVAQIQYELNMLGSRGPRRMQCTMDSIPSSSIEPGGVAPTQAEFSHNNAELFPSLSFNRSKSNRMESFLSGPLARQKDGVLVLRNKSPRWHEQLQCWCLNFHGRVTVASVRLSVGGFSGNGPPGPEHEKIILQFGKVGKDQFTMDYRYPISAFQAFSICLSSFDTKIACE

SEQ ID NO: 12993 - protein, 638 aa, Pyrus communis
MESCDCIEAQWPPDELLVKYQYISNVFIALAYFSIPLELVYFVQKSAFFPYRWVLVQFGAFIVLCGATHFINVWTFSMHTKTVAIVMTVAKVSCAVVSCATALMLVHIIPDLLSVKKRELSLKSRAEELDKEMGLMLTQEETGRHVRMLTHEIRSTLDRHTILKTTLVELGRTLGLQECALWMPSRTGMNLELSHTLNYHIQAGSSVSIDLPEVNEAFNSSQAIRIPYTCPLARIRPLVGRYVPPEVVALRVPLLNLSNFQINDWPDVSAKSYAIMVLILPTDGTRTWREHELELVDVVADQVAVALSHAAILEESMRARKQLTEQNDALDLAWREAEMAIHARNDFLAVMNHEMRTPMHAFIALSSLLLETELTPEERLMIETALKDSNLLETLVNDVLDLSRLEDDSLELDIEKFNLHGVFREVMNLVQPVASVKKLSMTLILSPDLPVYAVGDENRLLQTILNVAGNAVKFTKQGYISITASVAKSESSRDWQPPEFYPASTDGYFYLRVQVKDSGCGVLPEDIRHLFTKFSQPRNGSNRINNGAGLGLAICKRFVNTMGGHIWIESEGIDRGSIVAFIVQLGICDNHSDTTTHQVQMPPKGQANYGSGDVIGHKPAFRDCFGVTSSIARYQRSL

SEQ ID NO: 12994 - protein, 741 aa, Pyrus communis
MEACNCIEPQWPADELLMKYQYISDFFIALAYFSIPLELIYFVKKSAVFPYRWVLVQFGAFIVLCGATHLINLWTFNMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLHQQNPVGYTVPIHLPVVNQVFSSNCAVKISPNSPVARLRQLAGRHIPGEVVAVRVPLLHLSNFQINDWPELSTKRYALMVLMLPSDSARQWHVHELELVEVVADQVAVALSHAAILEESMRARDLLMEQNIALDLASREAETAIRARNDFLAVMNHEMRTPMHAIIALSSLLQETDLTPEQRLMVETILKSSNLLATLINDVLDLSRLEDGSLQLDIATFNLHSIFREVHNMIKPVASIKRLSVALNIAADLPVYAIGDEKRLMQIILNVVGNAVKFSKEGSISITAYVAKSESLRDFRAPDFFPVQSDNHFYLRVQVKDSGSGINPQDIPNLFTKFTQTQTLASQNSGGSGLGLAICKRFVNLMEGHIWIESEGLGKGCTATFIVKLGFPERSNESKQPFAPKLQANHVQTNFPGLKVLVMDDNGVSRSVTKGLLVHLGCDVTTVSSIDEFLHVISQEHKVVFMDVCMPGIDGYELAVRIHERFTKRHERPVLVALTGSIDKMTKENCMRVGMDGVILKPVSVDKMRSVLSELLEHRVLFEAM

SEQ ID NO: 12995 - protein, 285 aa, Glycine max
MPTGLPAANSLVAPDEEGWVWGQIKAEARRDAESEPALASYLYSTILSHSSLERSLSFHLGNKLCSSTLLSTLLYDLFLNAFSSDPSLRSAAVADLRAARERDPACVSYSHCLLNYKGFLACQAHRVAHLLWRQSRRPLALALHSRIANVFAVDIHPAARIGKGILFDHATGVVEGRHRNREQCVDPAPCSLGGTGKVGGDRHPKIGDGVLIGAGATILGNIKIGEGAKVGAGSVVLIDVPPRTTAVGNPARLVGGKEKPSKHEDVPGESMDHTSFISEWSDYII

SEQ ID NO: 12996 - protein, 635 aa, Oryza sativa (indica cultivar-group)
MDGSCDCIEPLWQADDLLVKYQYISDFFIALAYFSIPLELIYFVKKSAFFPYRWVLIQFGAFIVLCGATHLINLWTFAIYTKTIAVVLTVAKAATAVVSCITALMLVHIIPDLLNVKLRERFLKDKADELDREMGIIRTQEETGRHVHMLTHEIRSTLDRHTILRTTLVELGRTLALAECALWMPTRSGSALQLSHTIYNSAAIGSVVPINLPIVSKVFNSNRVVKIPHTSPLASITADKSRYVPPEVVAIRVPLLHLTNFQINDWPELSAKSFAVMVLMLPPDSAREWRPHERELVEVVADQVAVALSHAAILEESMRARDLLMEQNIALDAARREAEMAICACNDFLAVMNHEMRTPMRAIVSLSSLLLETNLSAEQRLMVETILKSSDLLATLTNDVLDVSKLENGSLELEIAPFNLHSTFTDVVNLIKPVAACKRLSVMVTLAPELPLHAIGDQKRLMQIILNVAGNSIKFTKEGHVSITASMARPHALRGPHEPDYHPVVSDGFLYLAVQVKDTGCGISPQDMPHTFRKFAHPENAGKWNSGSGLGLALSRRFVSLMEGNIWLESEGVGKGCTAMFFVKLGMPEKPNANLRRMAPHPLQPNQGAGGPDALSISIMDSNPRVPRVRYQSSV

SEQ ID NO: 12997 - protein, 618 aa, Hordeum vulgare subsp. vulgare
MKREYQDGGGSGGGGDEMGSSRDKMMVSSSEAGEGEEVDELLAALGYKVRASDMADVAQKLEQLEMAMGMGGPAPDDGFATHLATDTVHYNPTDLSSWVESMLSELNAPPPPLPPAPPQLNASTSSTVTGGGGYFDLPPSVDSSSSTYALRPIISPPVAPADLSADSVRDPKRMRTGGSSTSSSSSSSSSLGGGAARSSVVEAAPPVAAAAAAPALPVVVVDTQEAGIRLVHALLACAEAVQQENLSAAEALVKQIPLLAASQGGAMRKVAAYFGEALARRVFRFRPQPDSSLLDAAFADLLHAHFYESCPYLKFAHFTANQAILEAFAGCRRVHVVDFGIKQGMQWPALLQALALRPGGPPSFRLTGVGPPQPDETDALQQVGWKLAQFAHTIRVDFQYRGLVAATLADLEPFMLQPEGEEDPNEEPEVIAVNSVFEMHRLLAQPGALEKVLGTVRAVRPRIVTVVEQEANHNSGSFLDRFTESLHYYSTMFDSLEGGSSGGPSEVSSGGAAPAAAAGTDQVMSEVYLGRQICNVVACEGTERTERHETLGQWRNRLGNAGFETVHLGSNAYKQASTLLALFAGGDGYKVEEKEGCLTLGWHTRPLIATSAWRLAAP

SEQ ID NO: 12998 - protein, 447 aa, Mus musculus
MSDSKSDGQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMAEMVLHKCLFPGRDFDIWSVGCIMGELVKGCVIFQGTDHIDQWNKAIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVKDQPSDAAVSSKATPSQSSSINDISSMSTEHTLASDTDSSLDASTGPLEGCR

SEQ ID NO: 12999 - protein, 266 aa, Mus musculus
QHQYQEAMAALRFLWGSEEGWEEPPVGAEHQGFQLALLRRPGIYKPLIIGISLMVFQQLSGVNAIMFYANSIFEEAKFKDSSLASVTVGIIQVLFTAVAALIMDRAGRRLLLALSGVIMVFSMSAFGTYFKLTQSLPSNSSHVGLVPIAAEPVDVQVGLAWLAVGSMCLFIAGFAVGWGPIPWLLMSEIFPLHVKGVATGVCVLTNWFMAFLVTKEFSSVMEMLRPYGAFWLTAAFCALSVLFTLTVVPETKGRTLEQVTAHFEGR

SEQ ID NO: 13000 - protein, 185 aa, Brassica oleracea
MEEAKVEAKDGTISVATAFAGHQQAVQDSDHKFLTQAVEEAYKGVDCGDGGPFGAVIVHKNEVVASCHNMVLKYTDPTAHAEVTAIREACKKLNQIELSECEIYASCEPCPMCFGAIHLSRLKRLVYGAKAEAAIAIGFDDFIADALRGTGVYQKSNLEIKKADGNGAAIAEQVFQNTKEKFRLY

SEQ ID NO: 13001 - protein, 153 aa, Narcissus pseudonarcissus
MCGGAIISDFIPPSRSRKLTADYLWPNLNKGKDKKKSFGFEDDFEADFNEFEDESEEGESEAVDVKPFKFGAKAGFSREGSTYLKPIELNGAAERSSKRKRKNQYRGIRQRPWGKWAAEIRDPNKGVRVWLGTFNTAEEAARAYDDEARRIRG

SEQ ID NO: 13002 - protein, 292 aa, Rattus norvegicus
MQKYEKLEKIGEGTYGTVFKAKNRETHEIVALKRVRLDDDDEGVPSSALREICLLKELKHKNIVRLHDVLHSDKKLTLVFEFCDQDLKKYFDSCNGDLDPEIVKSLLFQLLKGLGFCHSRNVLHRDLKPQNLLINRNGELKLADFGLARAFGIPVRCYSAEVVTLWYRPPDVLFGAKLYSTSIDMWSAGCIFAELANAGRPLFPGNDVDDQLKRIFRLLGTPTEEQWPAMTKLPDYKPYPMYPATTSLVNVVPKLNATGRDLLQNLLKCNPVQRISAEEALQHPYFSDFCPP

SEQ ID NO: 13003 - protein, 472 aa, Rattus norvegicus
MATKCTKCGPGYATPLEAMKGPREEIVYLPCIYRNTGIEAPDYLATVDVDPKSPHYSQVIHRLPMPHLKDELHHSGWNTCSSCFGDSTKSRDKLILPSIISSRIYVVDVGSEPRAPKLHKVIEPNEIHAKCNLGNLHTSHCLASGEVMISSLGDPQGNGKGGFVLLDGETFEVKGTWEKPGGEAPMGYDFWYQPRHNIMVSTEWAAPNVFKDGFNPAHVEAGLYGSHIHVWDWQRHEIIQTLQMKDGLIPLEIRFLHDPDATQGFVGCALSSNIQRFYKNEGGTWSVEKVIQVPSKKVKGWMLPEMPGLITDILLSLDDRFLYFSNWLHGDIRQYDISNPKKPRLTGQIFLGGSIVKGGSVQVLEDQELTCQPEPLVVKGKRVPGGPQMIQLSLDGKRLYVTTSLYSAWDKQFYPNLIREGSVMLQIDVDTANGGLKLNPNFLVDFGKEPLGPALAHELRYPGGDCSSDIWI

SEQ ID NO: 13004 - protein, 289 aa, Rattus norvegicus
MCRELLEMSRQTATALPTGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKAEHEELCEFRPYSCPCPGASCKWQGSLDAVMPHWMRQHKSITTLQGEDIVFLATDINLPGAVDWVRMQSCFGFHFMLVLGKQEKYGGHQQFFAIVQLIGTRKQAENFAYWTELNGHRRRLTWEATPRSIHEGIATAIMNSDCLVFDTSIAQLFAENGNLGINVTISMC

SEQ ID NO: 13005 - protein, 348 aa, Methylococcus capsulatus
MQRVHTITAVTEDGESLRFECRSDEDVITAALRQNIFLMSSCREGGCATCKALCSEGDYDLKGCSVQALPPEEEEEGLVLLCRTYPKTDLEIELPYTHCRISFGEVGSFEAEVVGLNWVSSNTVQFLLQKRPDECGNRGVKFEPGQFMDLTIPGTDVSRSYSPANLPNPEGRLEFLIRVLPEGRFSDYLRNDARVGQVLSVKGPLGVFGLKERGMAPRYFVAGGTGLAPVVSMVRQMQEWTAPNETRIYFGVNTEPELFYIDELKSLERSMRNLTVKACVWHPSGDWEGEQGSPIDALREDLESSDANPDIYLCGPPGMIDAACELVRSRGIPGEQVFFEKFLPSGAA

SEQ ID NO: 13006 - protein, 135 aa, Trypanosoma cruzi
MATPKQAAKKASKKRSGGRSAKAGLIFPVGRVGSLLRRGQYARRIGASGAVYMAAVLEYLTAELLELSVKAASQQAKKPKRLTPRTVTLAVRHDDDLGMLLKDVTLSRGGVMPSLNKALAKKHKSSKKARATPSA

SEQ ID NO: 13007 - protein, 762 aa, Hordeum vulgare
MAILGELGTEILIPVCGVIGIVFAVAQWFIVSKVKVTPGAASAAAGAKNGYGDYLIEEEEGLNDHNVVVKCAEIQTAISEGATSFLFTMYQYVGMFMVVFAAIIFLFLGSIEGFSTKGQPCTYSKGTCKPALYTALFSTASFLLGAITSLVSGFLGMKIATYANARTTLEARKGVGKAFITAFRSGAVMGFLLSSSGLVVLYITINVFKMYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTAMCYPLLVSSVGIIVCLLTTLFATDFFEIKAANEIEPALKKQLIISTALMTVGVAVISWLALPAKFTIFNFGAQKEVSNWGLFFCVAVGLWAGLIIGFVTEYYTSNAYSPVQDVADSCRTGAATNVIFGLALGYKSVIIPIFAIAVSIYVSFSIAAMYGIAMAALGMLSTMATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGNSEHARSLGPKGSDCHKAAVIGDTIGDPLKDTSGPSLNILIKLMAVESLVFAPFFATYGGLLFKYI

SEQ ID NO: 13008 - protein, 276 aa, Schizosaccharomyces pombe
  unsure (1)..(276): unsure at all Xaa locations
MKPFSPSQTNFEKEQLCFGVYQLKDCYQQVIEALSLGIRVIDSAITYRNEKECEQAIQDFCHQNVNIKREDITLITKIPDSLQGFERTWKAVXQSLRRTGRPKLDVVLIHSPKWPVRRIESWRALLQHQKEGRINKIGVSNYNIHHLEEIISLGLPLPAINQVEFSAFNNRPTFLSYCFNHGILVQAFSPLTRGYRLSDIRLLDLSLKYNKTPANILLRYCLQKGVSPISKASSFVHIHENVKAEQFMLDPSDMDVMDTWDEEFVSKPTWNPIILP

SEQ ID NO: 13009 - protein, 273 aa, Rattus rattus
AVRRALIVLAHAERTSFNYAMKEAAVEALKKKGWEVVESDLYAMNFNPLISRNDITGEPKDSENFQYPVESSLAYKEGRLSPDIVAEQKKLEAADLVIFQFPLYWFGVPAILKGWFERVLVAGFAYTYATMYDKGPFQNKKTLLSITTGGSGSMYSLQGVHGDMNVILWPIQSGILRFCGFQVLEPQLVYSIGHTPPDARVQVLEGWKKRLETVWEESPLYFAPSSLFDLNFQAGFLLKKEVQEEQKKNKFGLSVGHHLGKSIPADNQIKARK

SEQ ID NO: 13010 - protein, 4499 aa, Chlamydomonas reinhardtii
MSIFWEVPNAQGEAPCPRSGHSFTVLGERFVLFGGCGRKDGKAAAFNDLYELDTSDPDEYKWKELVVANAPPPRARHAAIALDDKRLLVFGGLNKRIRYNDVWLFNYDDKSWTCMEVEGAAPEPRAHFTATRFGSRVFIFGGYGGSGQVYNEMWVLHFGEDGFRWQNITESIEGTGPAPRFDHSAFIYPVTPNSDTYDKLLIMGGRDLSQMYQDSHMLDLNKMAWENETQPPTLPYEICNNVCDGIESVPYHKVFSFGGRKGMMQYLNTVEVMDCGTQMWSTPPVDHGVAPVGREDTAWVFDVKTCSLLIFGGWANRWLGDLHKLNVSPIIGPPYACTAIQPEMGPVFGSTELVIRGLRFRDGKVQVKFGLSEKNEVVVEGTYVDQETIRVQTPNYEQFGALTVDVRVSINGEGWTVNKIKYAYFANTAARNCIAYGPGLLAETISGVEVPFIIQAKDTLNDKRTSGGDVFKVTVVSADGKNEGVSRVRDLQNGQYEVQYAAPTAGPYLIHVAFNELGTSDFVPIRGSPFTVKCTDSWTKHRVMGAAPAKRKGATICTMGNELVLYGGDKSGVTVLNTEGAEWRWSPATVSGSTPPDRTAHSTVVLSDGELVVFGGINLADQNDLNDIYYLRKQGEGWVWSCPSESRPYIRHPKGAAAVSAEPSAEPAAEPAAEPAAEPDADAPAAEPAAEGEEGAVPAEGEEGAEGATGSRPVSAKPAPAAAAPAAEALPELPVSARNSHVAVAIDKDLYVMMGDHDGDLMTELAMVDTSDRTCAHWLEPILKGDVPVPRKACAAAATGNTIVLFGGQTQNADGEATVTGDLVIMEVTGPNSIQCAVNPAAPGASGSPAARYGAVMQEFSNGKLFLHGGMDAASKPLNDGWLFDVPSKTWQCVYVGSSDVVLPTGQLATLSGNRIVLVSAAVGSPKLDSVQSLDFQELRDQAGVHAKMRASTETLLKGLEDWVDTQAHGMELARSPEKLSKDFENGLRKVMDALFQVKSQRSQTDLLIDQLHEAFAQLAEEKVPGINKMEKRLEAAAHKWDEIKKAQPQVKTDVEPIQAAKGEDIKKEIETFAAKVRNYRADFRRRGFFKYATGFDGAYPLLDAAAHELAELKKECDRLSELASVFEFPQAIEPVTVAIKETVEDLVMVKDVWDTAVLCELQFQDWRQTLWSDIRTDIMEEGAKQFVKEVKSLHKKVRDEDVFRGVDQVVKNFLVSVPLVADLRSPAMRDRHWEQLMATTKMTFNVKDPNFKLDDLLALELHKFEEEVGEIVDRAQKEEKMEIAIRKLNDTWTRVEFQFHRHKDYDVHTVKMAEEDFEALEDNQVQVQGMIANRYMATFKDEILGWQKKLNDVADVNQIMAEIQRTWAYLESLFIHSEEVKKELPQATERFAAIDTEVKKVLREFQQLKNCVSCCNREGLYANLETQERELEICKKALNDYMESKRRAFPRFYFVSSADLLDILSNGNNPMRVQIHMNKCFQAIDNVRLDSEEVVPGRRPKALGMESCVGIEYVPFSSLPLENKVEQYMNDIIAKMRNDVRMVLKASVEDYPSKPRDKWLFDWPSQIILVVNQIYWCLEVEQAFTEMARGDKGAMSKYNEFQVKQLTKLIEVTRTDLSKPDRQKIMNMITIDAHSRDMVLAGADQPDSFQWVSQLRSYWDRDISDCRIRICDASFPYGYEYLGNGPRLVITPLTDRIYITATQACWLSLGTAPAGPAGTGKTETTKDLSAQLGKSVYVFNCSPEMDYRTMGDIFKGLAASGSWGCFDEFNRLVPEVLSVCSVQYKCVTDSQKKKTMLPGRGLEYIKDGVKHPAVEHWSFIAADGVEMPLEEGTSAFITMNPGYIGRAELPESLKALFRPITVMVPDRQLIMENMLMAEGFVEAKMLAKKFASLYYLLEDLLSPQKHYDWGLRAIKSVLVVAGSLLRAEAGQVEADVLFRALRDFNIPKILAQDMVIFMGLLNDLFPGIDPPRKRDMEFEDVIVSTIKDLGLTPEDDFVLRVVQFSELLAIRHCVFLMGPTGTGRTECYRVLAKAITKGCNNPVNDYLKMTNKKKVVIRDINPKSISTYELYGQVNQATREWKDGLLSYYMRDVANMPGDDPKWLLLDGDLDANWIESMNSVMDDNRLLTLPSNERIRVLPHMKLIFEIRDLKFATPATATRAGILYISEGQQWHNMAMSWINRVVKPYAERAKWKDPQLPCTWLREMFDKYIPPTLLEMKKSYSHITPLAQMNFISTLVNIMEGVLKPENLSNKADQAMFEMYFVFAMIWAFGGGLVEKDGIPYRRNFDKWFKQTWTTVKIPGKGTVYDYFVNPKTQKFQPWAELVTDIDYDGSRPMSTVFVPTAETSSLRFFLDMMVDLRKPIMFVGGAGVGKTQLVKGKLGSLNEEQISLSISFNYFTDVVSFQKVLESPLEKQPAGINYGPPGTKQLIYFVDDLNMPKLDLYETAMPISLIRQHLGWGHWFDRAKLTPKNINNTQYVACMNPTAGSFIINPRLQRLFMTLAVDFPGQDSLMKIYGTFLQGHLKKFSESIQDMGTKILQAALALHDRVSQTFRKTAINFHYEFTVRHLANVFQGLLMSTPEAFNSPTKWGKLWLHESERVYADRLVSLYDLDAYNKAATAIAKKYFSVADIDDYYKKKDPKPLIFCHFARGLADKAYDEVADYTSLYKTLTEALNEYNETNAAMDLVLFEDAMKHVCRISRIVSNPSGHALLVGVGGSGKQSLARLAAHICGYATQMIVISGSYSMNNFKEDIQKMYKRTGVKGEGVMFLFTDSQIVDERMLVYINDLLSSGEIPDLFPQEDRDEIVNALRSETKSLGLLDTAENCWATFIQKVKTNLHMVFTASPVGENFRVRSQRFLATVTSTVIDWFQPWPESSLFSVAKRFLDEVDLGEDAVANAVVEFMPYSFQLVNKVSIKFREQERRYNYTTPKTFLELIKLYKNVLAAKRKANQDNTERLENGLHKLHKVQADVDILVEEAKVKAVEVEHKVASANIFAEQVGVEKEKVNAENAAAQVEAEKCAVIAKEVSEKQASCEKDLAAAEPLVAEAMAALETVTKKDLGEAKSLKKPPPGVDDITAVVIILLENNPKDKSWQAAQKLMNNVDKFLERVKSFKSVIDAGQVARKTVDACRPYLALEWFNREAIGKKSAAAAGLCEWAVNIIKYYDVVQEVEPKRQELAAANAKLEEANVTLAAVEEKVALLNAKVQELEQQYKEANDDKEAAIRESERCQRKLELANRLINALASEGERWALTVEQLRKSYEVLTGDMLLAAAFVSYAGPFTAKFRAHVIDDWILFLRERHMPMTEGITDPLKVLVDDALVAGWIREGLPSDPTSVQNGTILTNSERWSLMMDPQLQGILWIKERESKNNLQVTRMGASNMLQVMERAIEAGHSVLVENMGETIDAVLNPIITRSTFKKGRSLYVKLGDKECEYNKNFRLFLHTKLSNPHYPPEIQAETTLINFTVTEAGLEDQLLALVVNKERPDLEETKTQLIIQNTEFTIKLKELEDGLLLKLSTAEGDITEDVALIESLEDAKRVSTEISEKVKESRETEAAINENRNKYRTVAARGAMLFFLLNSLNKIHAFYQFSLNAFVTVFSRGLDLAPGGRKKGKGLKKTPSLRDQPMDHQSLMEKARRSSGVGDRRPSQEGLPGPEASQASLAESQGGRGSQVGDAEDEDDESFAMAPEALEQRLVNLLETCTFTVYNYTRRGLFDRDKLIVLSLLTFTILLRSQAVDASEYEALCRGMRNPTPPPITDDLSRWMAESQWAALDVLTTLPCFAHLAKDMEKNSDDWFNWCNNEAAERAPMPGEWGKLTEFRQLLIIRALRPDRITNALQNFCEHMMGSDYVNQDAFSPAAMMDESSSATPIFFILFPGYSPSKEIEVYANKCGYSVANGRLCLISMGQGQEAPAEAVLDKYTREGGWVFLDNVHLMQGWIPKLERKLEIAAESAHPDFRCFFSAEPINGAPHANIIPESILQTCIKISNEPPSDMKSNMRRAFAAFTPEQCDRPSTPAKRVAFRAILFGLCFYHSLLLGRKKFGVGIGTGSGSGLGFCRGYSFNIGDLTTCGDVLYNYLEAYEQIPWRDLQYMFGEVFYGGHITDSMDRRCCTTYLEVLIRNEILPKGNPDEVEAWEAPTLELAPGFFAPKPVDYPTLKEYIETSLPAESPVVYGMHPNAELSLLTSLGETLFKTVVEVAGGGGGGGGGGGGGENAVRQALETFKERLPEPFNMVEVELRVKEKTPFVVVALQEATRMNALLSEMKRSMEELQLGLDGALNMSDNMEKLAKGIASNTVPELWMSCMSTRVQEVYTLTAWYQDVVKRHDQLSAWTAGDIITPHSVWLPGLFNPKAFLTAVMQTFARANKLPLDVMKFMTEVTRMTSPEQVTEAAPLGVYVHGLVLEGARWDREDGCLRDSKPNELHPAMPVLQVKPVTADQFNLEGYYECPVYTNMQRANVYSPVVSTFTLRTQDMPAKWVLASVALLLQDDLAG

SEQ ID NO: 13011 - protein, 527 aa, Trametes villosa
MGKYHSFVNVVALSLSLSGRVFGAIGPVTDLTISNADVTPDGITRAAVLAGGVFPGPLITGNKGDEFQINVIDNLTNETMLKSTTIHWHGIFQAGTNWADGAAFVNQCPIATGNSFLYDFTVPDQAGTFWYHSHLSTQYCDGLRGPLVVYDPDDPNASLYDVDDDTTVITLADWYHTAAKLGPAFPAGPDSVLINGLGRFSGDGGGATNLTVITVTQGKRYRFRLVSISCDPNFTFSIDGHNMTIIEVDGVNHEALDVDSIQIFAGQRYSFILNANQSIDNYWIRAIPNTGTTDTTGGVNSAILRYDTAEDIEPTTNATTSVIPLTETDLVPLDNPAAPGDPQVGGVDLAMSLDFSFNGSNFFINNETFVPPTVPVLLQILSGAQDAASLLPNGSVYTLPSNSTIEISFPIITTDGVLNAPGAPHPFHLHGHTFSVVRSAGSSTFNYANPVRRDTVSTGNSGDNVTIRFTTDNPGPWFLHCHIDFHLEAGFAIVWGEDTADTASANPVPTAWSDLCPTYDALDSSDL

SEQ ID NO: 13012 - protein, 402 aa, Bordetella avium
MTHNNQRIERASQASLHVPPGSRLSVALLSDAGSIHTMRWVHGLHQRGLKVHLISIKPPNSPLADGIEFHRLPWKAPHGYRLNARYLRQLLKRLQPDLLNAHYATGYGLLARLSRFSPVLLSAWGSDIYEFPTRSSWHRKLLRKNLESATCLAATSHAMAARMQELSPLPVTITPFGIDTELFSPGTLTERHVDKALRIGTVKSLEDTYGIDTLLEAYARLYRRIKAEDAALAQRLQLLIYGRGSRLDALSQQARDLAIDHCTTFAGHIEHHAVPDALRSMDIFAALSRADSFGVAILEASACRLPVVVSDADGPAEIVEDQHTGFIVPRENAEAAAQCLYTLVMDSALRERMGRAGRQLVDARYSWNHSVDIMLAAYRATIENAGLGQHSGRAPTPPSARS

SEQ ID NO: 13013 - protein, 143 aa, Clostridium perfringens str. 13
MLSLALEEAEKAREKGEVPVGAVIVKDGEIIARAHNLKETLKDPTAHAEILAIREACNKLNNWRLHGCEMYVTLEPCPMCAGAILQSRLSKIYIGTFDDTTGAAGSVVNILQNHNLNYFLEVVWQNDEKCSKILTKFFKDRRG

SEQ ID NO: 13014 - protein, 791 aa, Clostridium perfringens str. 13
MDNPIFFHIFNDDKNKLETQRIIKLSIFIVFSIFFILLIDLSYKVLIRKNIEFIPGNSMPSFSLSLSLILGTMAYISSLIYYSSTKKDDFFIISLIYMNLSVELLITKGHNLIIFDKFIFIHAIFRIILLFYVAFNKKGIPPLITKHKIITSIVVFLFSVITPMINYRIFSNNLFAKDIYFYATLMTMIIILYIIACIFLSKKSLDDCELIYSFIIASILLIALRGLYWICEVLLPNITLLKTNNVVLLLTILSFLLAISGVFNEITAKNKRSSLLQNELQVFYHLVEFNTSSSIILYDNKKKVIYTNKTIRERYCKSTKLKDQLKEVEKLFVDSIFIDDSEKNATKALFNKGNWEGKLILKNGKIVSAYIQILNVENKNYFAVNLKDITEEYTLTKNIKRNEQLLSCINNNVQDLIISVDNNGLITYVNDSVLKTLNYTYEEIIGMPIINLLGKNDEILNQLKLEDEEDSIKCKLVGKHSFVYVESIIRTLNDNNEIPYGKVIVAKNLTSKKRLENLAIKFKEAKAYEQIRNEFFANISHELRTPLNIIYSTIQLLNSKHETDPMDFNNFYDKYKQGLKINCYRMLRLINNLIDVSKIEVGFLKADFTNRDIVFLVENIVSLVIPHSENKDINIIFDTNVEENIIKCDPVKIERLILNLLSNAIKFTQNHGEIFVDLNISKDWVKISIKDNGIGIPKEMQASIFDRFVQADKSLKRRNEGSGIGLSIVKSIAELHDGKIELISDGIKGSEFIVWLPNVKLNYTEESNNLVDYITDDKNIELELSDIYEVH

SEQ ID NO: 13015 - protein, 217 aa, Clostridium perfringens str. 13
MLSNIKGVIFDLDGTLVDSMGVWAKIDSDYLTDLGLEVPKNLKEEITHLGFKEVAKYFKKRFNIASSEEEIMKTWHDMAYVEYKNNIKLKSGAREFLEQLKESNIKIGLATSNSYPLLEVCLKSNDIFHLFDSITITGEVPRGKDFPDVYLLAAERLGLEPKECAVFEDILPAVKGALSAGMKVFAVEEHTVSEEEKSQIKEIVHEYIDSFNDLLVN

SEQ ID NO: 13016 - protein, 314 aa, Clostridium perfringens str. 13
MAKKIATREAYGKALAALANENKNIVVLDADLSKSTKTADFKKACPERFINMGIAEGNMMSVAAGLSTCGKIPFASTFAMFAAGRAFEQIRNSICYPRLNVKICATHAGLTVGEDGASHQAIEDLSLMRSIPNMTVICPSDAVETEAAIRAIAEYNGPCYVRLGRAGVNVINDRPEYKFEIGKGIELKEGNDVTLFATGIMVDVAIEAVEALAKEGINARLINIHTIKPIDSELILKAAKETGAIVTLEEHNIIGGLGSAVAEVVGGEYPVPVVRVGVKDTFGESGKPDQLLKAYGLTSEEAVKAAKKAMSLKR

SEQ ID NO: 13017 - protein, 466 aa, Clostridium perfringens str. 13
MFLCCFYLLELNARRVGSFAYFYTLPLKKFVEGKDMKLFGSMKVEENELYVGGVKASALSKEYGTPLYVIDEELVRSNCRRYYNAMKCEEIGNRVTYAGKAFINMSMCNLVNEENLYLDVVSGGELYTAYKAGFPLERIYFHGNNKSDYEIDLGVRLGIGRFIVDNIHELEVLNSIAQEYGRVQKVYLRITPGVEAHTHEYIKTGQLDSKFGFPVIGDTVYDAIKRAMELEYIELNGLHCHIGSQIFDLEPFEDTTEIMLNLINDIKETLGYEIKELDLGGGFGIYYTEGDKPKEIEEYCSVIINKADEICRKLNMNVPILSIEPGRSIVGNAGLTLYTVGAIKEIPNIRKYVSVDGGMSDNIRPALYSANYESLIANRVFDNSKEIVTVAGKCCESGDVLLNSIEMPRMETGDILAIMSTGAYGHSMANNYNRIPKAAVVSVSNGISKVMCKRETYEDLLRNECF

SEQ ID NO: 13018 - protein, 248 aa, Clostridium perfringens str. 13
MENVWNGFRQLEIFKIEEEAKDIKSFYLRATDGKPLKEYKCGQFLPLKIETDDEVIKKEMRRYSLSGDPKKNYYRLTIKRVPNGKVSGYFHESINVGDTILAMPPFGNFTLTEDSNKPLVLLSGGIGITPILSMLYGAKEQSRDIYFVEAVLNSDNLALNSDVQGIKKVKNFKEIKIFSEPLESDIKGKDFDEEGFITKEWIKNNLPLNGEFFFCGPTLFMKSIRNSLKDLGVKEDNINFEFFGKEEF

SEQ ID NO: 13019 - protein, 293 aa, Clostridium perfringens str. 13
MKKFRTIENIFKGPEPHMVGDGFRVSQYIPTGIKSMERLSPFLLLDYNEPYYFKPSETRLGVGAHPHRGFETVTIAYDGKVEHHDNKGNHGIIGPGDVQWMTAASGIMHKEYHEAEFSKNGGIFHMVQLWVNLPKDKKMIEPKYQPLLKEEMGVLKLDNDKGEISIIAGEVNGVKGPANTFTHINLYNINLKNYGNTTLSEPKNFNTAILILKGEAKVNEDKICKEGDFIIFDNVEGEILLESLTEESLFLVLSGEPINEPVVSHGPFVMNTLGEILDAYEDFRNNKFGTENF

SEQ ID NO: 13020 - protein, 246 aa, Clostridium perfringens str. 13
MLKDKVAIVTGGTRGIGRAIALKLADQGANIVINYRNSDKEAEELKAILEEKGVKVLTVKCDISNFEDSKNLMDKCKEVFGKIDILVNNAGITKDTLIMRMKEEDFDNVIDVNLKGTFNCAKHASAIMLKQRFGKIINMTSVVGIAGNAGQVNYSASKAGVIGLTKSLAKELGSRGITVNAVAPGFINTDMTASLSEKVKEEASKNIPLKRLGDPEDVANLVGFLASDAANYITGQVINVDGGMVM

SEQ ID NO: 13021 - protein, 431 aa, Clostridium perfringens str. 13 [sequence omitted]

SEQ ID NO: 13022 - protein, 821 aa, Clostridium perfringens str. 13
MNKFLKKEVFLLILNIYLIYNRSTMLNKNGENLDMLIGLFNNLGIKEKTLKRIAIVTVILLSLFFIKGLNLICALNRDLFKDVSVVYAAEEIIVMTQIILCIMILSICFIYYRGLKRKEFFSISLVYVSIITEMIFIVLTGKIVENQVYDLNLFSLLFRGILLLLAVLCLENFDAFIRKYKKLTLVFVILVTIILQILNVNYNIGIYTYNFIYNLTLVLIVLTYISCIIFCLVRIFQFREITYLVIMISASLMLLKLVYGLSLSITNNNLIKINIVFFNFISFMSFVFGMFFDLLQVIKNKNFMQEELSAFFNLIEFDCNSEVVVLSNNLKVLYANEKCRSKRISPKNRENKTYIDLEKQIKGFLYDKNIICIESVLRNSKEWKGIIKLNEEDEVVKVNLQRIKKEKNLYYVLRINDITEEYKMEKNLKLEEQRLRGVTENIKDLIFTIDVEGKISYVNKAVIDVLGYSEEELIGKNYYDLLLVESNLNIIDSKYFNEDKILTIDKVRSKKGLVQLESISSRIKDNKNNTLGWVRVARNIEDVREIEILKNKFEEIKQYDKVRSEFFANLSHELRTPINIIYSCIQLLNTSKKNKANFANLYDKYEKTLKQNCFRMLRLVNNLIDITKIDSGFIKMDFINYDIIKLTEDITMSVIPYVESKNIDIIFDTDYEELEIRCDPDKIERIILNLLSNAIKFTEPGGKIEVSIFADEAWVDIRVKDTGIGIPSHMKEFIFERFIQNDKSLNRNKEGSGIGLSLVKSLVELHEGKVFLRESNESGSEFSILLPNVKLENDVCENGSLDYKTEVEKISIEFADIYEIY

SEQ ID NO: 13023 - protein, 169 aa, Clostridium perfringens str. 13
MFKNLKYDIENVMKNDPAARTKLEVLLLYQSIHVLIFYRIAHGLYKIKLFFLARLISQLGRFFTGIEIHPGAKIGKGLFIDHGMGVVIGETAEIGDNVTIYHGVTLGGTGKDKGKRHPTIGNNVIIGCGAKILGPISIGDGAKIGANSVVLKNVPKGKTAVGIPAVIKN

SEQ ID NO: 13024 - protein, 279 aa, Clostridium perfringens str. 13
MKNLNLKNGVIIADGAMGTRIMELGVNLKETPSELLNIKKPELIEKIHREYIESGANLILSNTFMCNIINAKRNNYNLEEIIEAGISIAKKACGYHGLVALDIGPLSYYIEENDSSFKEIVYENTERIINASKDKFDLVIFETLGSLKEGEFAVKKAKTLTDKKVICSFTLAYKKDIPNFIKNMVSTLEPLGVDALGINCTGYEEILMALDILKENTNLPIMIKANLGIPKKVGEELVYDKTLEEFKNLSKRALEKGVNIIGGCCGTTPEYIRAICNLK

SEQ ID NO: 13025 - protein, 1093 aa, Clostridium perfringens str. 13
MNIKKLVIRYAFLSLILILIQGKNVFALGESEVRFNNLTLKDGLSQSTVNKIIQDNKGYMWFGTSDGLNKYNGHEFVIFRELVNDKKSINSSFISALIEYDNDNILVGTSKGISKINVITNEVSRMFEDEEGKSKLSNNNIWDILKHSDGTIWIATRKGLNIYNPKTGDMYQIFKDTEPKGLKSNVVTSLCEDKYGNVWVGTSEGLSVINTKTKEIQPINDILDNDNSAICNIYRDRDDNIWIVTDNHIMLVSSNYKDITYFDKELESFKISPDSVNAIYEDKYNNLWISTQNGLLEYNKENKKMHLFESRYYDDTSLVNDNVLTAYEDRSGLLWFGTYNGISLLNPKQPFKHYRREPDKENTISDNSMSGIYKDSDGMLWLGTNSAGLNKLNTMTGEVTNFYSNNSDENTLSSNVVWQICEADKDNLWVATQGGVNKINKKSGNVERLKYPENMRERNKMDARNVFVDKDGLLWIGARGGLQSYDDKTGTFTDYSNVFKAVGIVENAVTSISQDEEGFLWITIGIDGGVVKFDKDKGVLKSYLNNSFDSNSLINNGVRCLEKDSKGNVWIGTEAGLSKLDPKTDKFTNYTVVNGLANNFIYGILIDEEDNLWISTNDGLSRFDQKTNKFINYTAMDGLQSNEFNGRSYFKSKDGEMFFGGINGVTAFYPKDVLKLSDNRNKSKVVIDEIKVNNKTYPYYGGTLSLKYNENNISIDFFLPDYLNTTKTTYEYKLEGVDEEWTFANKRNNANYATLDSGTYKVLIRARDNHGDLTPVTALDLKIAPPPWRTPTAYLIYFSSAVIVIFLMWSYVTALEKTVKKRAEQLKKEAKEKEKLYIEKEKLYKEAADLKDEMIKRQKFKNDYFVNLSHELRTPLNVILATVQLIKLKNKEDCLGKYQVEDYTNTLRNNADHLLKIINDIIDSSKIESGAYKLNIEKQDIVSLVEDTALSLKAYIEENNLDIIIDPEIEELDVECDKNEIERCVINLLSNAIKYTHGHGTIEVFIRECENETVEIAIKDTGVGISKEQQKIIFDRFVQADSISKKQYRSSGIGLTLVKSIIELHHGTIRVESELNKGSTFIITLPIRQEKSK

SEQ ID NO: 13026 - protein, 384 aa, Clostridium perfringens str. 13
MKRISILGVTGSIGTQTLDVLRFHKEDFELVGITANRNIELTLDIIKEFSPKYVAINHEESYKKLVDLVKSEGLKCEVIYGMEGLVKVATLDEIDIVVTSVVGMIGLKPTVEAIRKGKDIALANKETLVVAGELVMREAKENGVKILPVDSEHSAIFQSLQGNAHNKIDKILLTASGGPFRGFTIEDLKSVTPERALKHPKWNMGQKISIDSSTLMNKGLEVIEAHWLFDCSYKDIEVVVHPQSIIHSMVQYTDGAVIAQLGVPDMKLPIQYALNYPNREGNISEKLDLFKIRELTFEKPDLDTFKCLKLAYEAGEKGKLMPTILNGANEVCVELFLNKKITYLQIPEIIEECMNTFDYNKEVTLDNVINLDKEVRQYIYEKYN

SEQ ID NO: 13027 - protein, 395 aa, Clostridium perfringens str. 13
MKDKKCVVVGVSGGVAVYKALDVISRLRKKDVEVHVIMTKSATEFVTPLSFQSLSQNMVITDMFAEPKAWEIQHISLAKKADLMLIVPATANIIGKVANGIADDMLSTTIMATKAPVVFCPAMNTNMYENPIVQRNISLLKELGYEFIEPASGRLACGDEGKGKLQDTEIIAEETLRRLHSTKDLLGKKVVVTAGPTIVPIDPVRILTNRSSGKMGYSIAEEARDRGAEVVLISGPTSLRKPNGIKVIDIKTNEDMFNAIKNEFKDADIVIKSAAVADYKAKNYSNEKIKKTGDDLNLIFERDRDILKTLGDMKENQILVGFAAESSNLKENAKGKLDRKNLDYIVANDISKSETGFASDENKVTIISKSGEEVSLEKMSKREVAKNIFDIIKGR

SEQ ID NO: 13028 - protein, 571 aa, Clostridium perfringens str. 13
MKKRIIIFTTLIITFFLAIMTSMYLVISNHKYLEESKNVLNEYNKVIALLLENDNGNIKSELERIESNNDMKNIRITYISKDGNVIFDTHKKLINDNESYLKRQEIIEAIESGLGSSVRYSNDLHQNMIYSALKLKDGSIVRTSIAVENAKILDSINSNYLLVGVILSLVIALLLTVKITNIILNPLKELEQLTSTIASGNFHKRVKINSKDDEIQRLGKSFNYMAEQLEITMERFKDKQNGLEAILKSMGSGVIAFDRDMNVLMINPYAKKIFGISGEIIGNKLLDYITDKEVLKAFFDEKDRVEIEVNYNDDPKILKIRKASIINEPEIIGTVVVIQDITDIKKLENMRSQFVANISHELKTPLTSIKGFAETLRYVEDDETRNKFLSIIDEESDRLARLLEDILCLYEIEQKRSTILEEFNVDEEIEKVYMLLNDQAKKKGVEIFLDTNSNCVLMGDKDKFKQMLLNLVSNSVKYTEKGGKVRVESYNRDMNLILVIEDNGIGISAEDLPRIFERFYRVDKARSRESGGTGLGLAIVKHIVRLFDGEINVTSELGVGTKIVITIPINI

SEQ ID NO: 13029 - protein, 270 aa, Clostridium perfringens str. 13
MRKGITSKGLISIMMINKVEICGVNTAKLPVLKEKEMKELLLQMQNGDTSAREKFIKGNLRLVLSVIQRFNNRGENVDDLFQVGCIGLMKSIDNFDLSQNVKFSTYAVPMIIGEIRRYLRDNNTIRVSRSLRDIAYKALLVRDKLVNENNKEPTVSQIAKELKIPREDVVFALDAIQDPVSLFEPIYHDGGDAIYVMDQISDSKNQDDSWLENIAIKEAMKKLNDREKLILNLRFFNGRTQMEVADEIGISQAQVSRLEKIALKHMRKYV

SEQ ID NO: 13030 - protein, 619 aa, Clostridium perfringens str. 13
MSEVLQRITDPKEIKDLDEKELEILAEDLREFLIESVSNTGGHFASNLGVIDLTVALFKNFDFSEDRIIWDVGHQSYAYKILTGRKDKFNTLRQYGGLCGFPKRTESEYDFFATGHSSTSLSSAAGMARAQRLLGKDNKVIAVIGDGALTGGMALEALNDIGYRKDNLIIILNDNQMSICKNVGGLATYLNKLRMGVGYNKLKSDIGSTLDTTSLGKRVKNSLSKLKDGIKKIVVPSMYFEDIGLKYFGIVDGHNIRELNEVLSIAKNIKGPVIIHTVTKKGKGYELAEKNPNKYHGVSPFDLGEGVISKFSSRNYSSTFGEEMIKLAKNDDKVVAITAAMPDGTGLKDFREEFPDRFFDVGIAEQHAVTLAAGMAAEGLKPFFAVYSTFLQRAYDQVLHDVCIQKLPVTLCLDRAGLVGEDGETHQGIFDISFLSPMPNMTIVAPKCIDEMEVILKWASNFNAPLAIRYPRGGDIDVNLKPLSKIEYGKWEKVQEGEKIAIVATGKMVQHAMIAAQKIKEEKNIDILIINATFIKPIDKELLNSLSKDGFKIVTIEDNIKKGGFGEGVLEYLNEIGHKEKIVTLAFNDKFIEHGKPDILYKINGLDAEGIKNTLIELL

SEQ ID NO: 13031 - protein, 248 aa, Clostridium perfringens str. 13
MEKKLLGKIVYITGASKGIGRGIAREFGKSGAFVLVGYNSDLEGANETLNMIKELGGSGEILGGNVANKDERNNIVSSIKNKFGKLDVLVNNAGISKIGLFMDASDEEIDSIMNVNLIGAMKLTRDSMDLLREGSNSSIINISSIWGNVGASCEVLYSTTKGGMNLFTKALAKEIAPWGIRVNCIAPGVINTEMNSWLSKEEKEGLEEEIPMNRFGEVEEIGRVAKFLASEDSSYLTGQILTVDGGML

SEQ ID NO: 13032 - protein, 144 aa, Clostridium perfringens str. 13
MLDQKTIDIIKSTVPVLKSNGLEITKTFYKNMFEQNPEVKPLFNMNKQESEEQPKALAMAILAVAQNIDNLEAIKPVVNRIGVIHCNAKVQPEHYPIVGKHLLGAIKEVLGDGATEDIINAWAKTYGVIAEVFINNEKEMYASR

SEQ ID NO: 13033 - protein, 373 aa, Clostridium perfringens str. 13
MAEGGNKMKAKTTKAKKGEGKEKVDKMVLVKRLIDKGKKSGSLTYKEIMDELDEIELNPEQIEKIYEVLESMGIEVISEIEQEEEEEEELDLSVPEGIAIDDPVRMYLKEIGKVPLLSSEDEIELAKKIEEGSNYAKKKLAEANLRLVVSIAKRYVGRGMLFLDLIQEGNLGLIKAVEKFDYRKGYKFSTYATWWIRQAITRAIADQARTIRIPVHMVETINKLIRIQRQLVQELGRDPLPEELSKQMDMPVDKVREILKIAQEPVSLETPIGEEEDSHLGDFIPDDDAPAPAEAAAFTMLKEQLINVLDTLTPREEKVLRLRFGLDDGRARTLEEVGKEFNVTRERIRQIEAKALRKLRHPSRSKKLKDYLD

SEQ ID NO: 13034 - protein, 876 aa, Clostridium perfringens str. 13
MEKKQYVYLFNEGNASMKNLLGGKGANLSEMTILGIPVPQGFTVTTEACNKYYEDDKKISQDIIEEIENKMSELEKITGKKFGSLENPLLVSVRSGARVSMPGMMDTILNLGLNDESVEAMAKLTNNPRFAYDSYRRFIQMFADVVMGVEKRLFEDLLDEVKEEKGYKIDTDLTAEDLKDLVVKFKALYKKEKGEDFPSNPKEQLIEAVTAVFRSWNNPRAIVYRRLNDIPGEWGTAVNVQEMVFGNKGETSGTGVAFSRNPANGDNELYGEYLMNAQGEDVVAGIRTPEPISHLEAQNPTIYKQFTDIVNTLEKHYRDMQDMEFTIEDGKLYFLQTRNGKRTAQAALKIAVDLVEEGMLTKEEAILKVEPKQLDTLLHPAFASDGLKEAKIVAKGLPASPGAACGKIAFTAEEAKERKANGEKVVLVRLETSPEDIEGMIAAEGILTVRGGMTSHAAVVARGMGTCCVAGCGELKVNEEARTLEVNGQVLTFDDYISIDGSTGHIYAEQVKTVSPEITGHFATFMGWADEIRKLKVRTNADTPRDTKQAVEFGAEGIGLCRTEHMFFAEDRILAVREMILAKNEDSRRVALEKLLPMQREDFIGIYEALEERPATIRFLDPPLHEFLPSEEEDINALAKEIGVSPAEIKNVVAELHEFNPMMGHRGCRLAVSYPEIAEMQTRAVIEAAIEVKKNKGYNIVPEIMIPLIGEIKELKYVKNVVVETAKTVMEEKGVQLDYKVGTMIEIPRAALTADKIAEEAEFFSFGTNDLTQMTFGFSRDDAAKFLKDYYEKGIYEQDPFAKLDQEGVGELMRIACEKGKATRPDIKLGICGEHGGDPSSVEFCHNLGLNYVSCSPYRVPLARLAAAQAQVKNKR

SEQ ID NO: 13035 - protein, 251 aa, Clostridium perfringens str. 13
MDISSIEKDNFNYDKNTTLIVMAKEGNKEAMNKLIEVNTPLVSSICKRFTNRGYDYEDIFQIGSMGLVKAINNFNDSFNVKFSTYAVPMIIGEIKRFLRDDGIIKVSRSTKTLAKKLHYNKEELIKKLNRDPTVDELAEYSGVDKEEVIVALESASSMQYLYDTIHHDEGTPVLLIDKLSEKGEDDDMVNKIALREAISSLDSKGKQIIMLRYFKDKTQIQVAKMLGISQVQVSRIEKKVLKIMKEKLEED

SEQ ID NO: 13036 - protein, 464 aa, Clostridium perfringens str. 13
MLFGKNELGSQFETPIFGTVESNESIPKYELAKKSIAPQVAYRLIKDDLLDEGNARQNLCTFCQTYMDDEAVKLMAETLEKNAIDKSEYPQTTDLENRCVNILADLWHAPKDESFMGTSTVGSSEACMLGGMAMKFRWRNRAKALGMDVTSRKPNLVISSGYQVCWEKFCVYWDIEMRLVPMDEEHMSINVDKVLDYVDDYTIGVVGILGITYTGKYDDIKALDKKLEEYNKTAKLTVPMHIDAASGGMFAPFIEPELEWDFRLKNVVSISTSGHKYGLVYPGIGWVLWRDKEYLPQELVFDVSYLGGKIPTMAINFSRSASQIIGQYYNFLRYGFEGYRQIHQRTKDVAMFLASELEKTGLFQIYNNGENLPIVCYKLRDDVNVDWTLYDLADRLLMKGWQVPAYPLPADLQDTIIQRIVCRADLSHNLAELYLRDLKAAIEDLNNARVLNQKSKTGVQGFTH

SEQ ID NO: 13037 - protein, 430 aa, Clostridium perfringens str. 13
MKNLNLKGNPNRGLIGATLGFFIGFAAVSLYGPTSAVFKEAFVNLNPVLLALLIAAPNLSGSLLRIPFSAWVDTTGGRKPLIVLLLLSIIGMGGLYIVLAFFSDNLNQYYYLLFALGLLSGCGIATFSVGVSQASYWFPKSKQGVALGIYGGVGNLAPGIFALLIPNLALPLLGLPGSYLAWLIFLIVGTVIYIKIGQNAWYFQLVDKGINKDEAKEIASKEYGQELFPKGKASETLLISAKSWKTWALVFIYFTTFGGFLALTGWFPNYWMTYFGLNMKVAGLLTALYSILTSLTRIYGGKVADKNGGEITTIVSLGIALIGAICMTFASTMTLAIIGIILLAIGMGVANAAVFKIVPNAVPEAMGGASGWIGGLGALGGFLIPPVMASFLNRSGFAGYSQGFSVFIVLIIVAIGVIALFQALQKKSAK

SEQ ID NO: 13038 - protein, 484 aa, Clostridium perfringens str. 13
MARILKTAYTFDDVLLVPNKSEVLPNEVSLKTQLTKKIQLNIPLMSASMDTVTESKMAIAMAREGGIGIIHKNMTIEDQAREVDRVKRQENGVITDPIFLSEDHTVREALDLMAQYRISGVPVTREGKLVGIITNRDIVFETNYDKKVSEVMTKSPLVTAKEGTTLTEALEILKQHKIEKLPLVDDENNLKGLITIKDIEKAKAFPNAAKDEKGRLLCGASIGVTNDMMERVDAVVKAKVDVIVLDTAHGHSKGVIEGVKRIKAKYPELQVIAGNIATPEAVRDLAEAGADCVKVGIGPGSICTTRIVAGVGVPQLTAVMDCAEEGKKLGIPVIADGGLKYSGDIVKALAAGACAAMMGSIFAGCEEAPGAIEIYQGRSYKVYRGMGSLGAMAKGSSDRYFQNGTKKFVPEGVEGRIAYKGHLADTIYQLIGGIKSGMGYLGAPTLENLYENANFVVQTSAGFRESHPHDINITKEAPNYSVNQ

SEQ ID NO: 13039 - protein, 539 aa, Clostridium perfringens str. 13
MKKGIAASKGYAIGTVFIQEHEEIIISDAKVSDIAAEKEKLSKALAQSKEQLEAIKEKTANEIGEHEAQVFEAHLMLLDDVEFTGQMEMTIENDQLNAMKAVQNVTDTFVMIFDSMDDPYMRERAADIKDVSKRIIANLAGKGGNGMENVGANTVVVAHDLTPSDTAQLDRSKVIGFLTNIGGRTSHSAIMARTLEIPAVVGLGDITTSVKNGDTVIVDGIEGVAIINPDEATINEYKARLEKFKAEQEELKKLIDVKTTTKSGRRIEVCGNIGKPEDIDQVLANGGDGVGLFRTEFLYMDRDEAPTEDEQFEAYKYVLEKADGKQVVIRTLDIGGDKTLPYLPLPEEMNPFLGYRAIRLCLDRKDIFRVQIRALLRASVYGNLAVMFPMISGLEEFQQAKAFVEECKAELKAEGIAYSDSIQWGIMVEIPAAAVYADELAKHVDFFSIGTNDLIQYTLAADRMSEKVSYLYNPMHPAVLRLIKMTIDGAHKHGKWVGMCGEMAGDERAIPTLVEYGLDEFSMSATSILTAKKIIMEQE

SEQ ID NO: 13040 - protein, 469 aa, Clostridium perfringens str. 13
MRCRGLVPKLILTLSVTICITFFIVGIILSSLFREEYYQERLKTLSGEAEVIEQVVNSFMNSETTLGELDKSISFIGDSLKADIYLIDSYGYIYSVSNEKYDYLKRTKIDDNDMKTLKENIPIEQKKKNEFIYSKPIFYKGVFTGAVSIVTPLSALSDSLVRINQIVWMCVAIAIIFSGLAIYFISKKIIIKPLKVINNAAKKIANGEIGNRVNVSYDDEVGELAESFNIMATSIEEAELNRREFISNVSHELRSPMTSIKGFITAILDGVIPKDKEEYYLVIVNDEISRLTRLINDLLDLSAMQAGKLEFNISELELNRIIETTVLKMNQKAASKNIKIEVLLESEKLYVYGDNDRLIQVVTNLVDNAIKYCDENGEVKISTKTKGSKIIVSIFNTSKGIDEYDLTHIWDIFYKVDKARSNKTSTGLGLSIVRNIILQLEEDIWAENVKDKNGEIKGVRFNFTLTKVK

SEQ ID NO: 13041 - protein, 284 aa, Clostridium perfringens str. 13
MGSCASCANKDKCSSASKDGGCSSSVPAKLGTNYGNIKNVIGVISGKGGVGKSTVTGILATQLAKKGYKVGVLDADITGPSMPRFFGINEKRADIVAMDSEGKQVKFVPVKTELGIKVISMNLLMEVEDDPVIWRGPMVTGVLNQMFKDTDWEELDYLLIDMPPGTSDITLTVMQTFPIKELVIVSTPQDMVSMIVKKLVTMAHKMNVCVRGVVENMAYIECECGKKMRVFSKKSSEEHAEYLGLPLIGELPINLDLTEALENGKAEEYVAENPLYSLIFEGLY

SEQ ID NO: 13042 - protein, 477 aa, Clostridium perfringens str. 13
MVNLMILSGIVLLTCIISSKIFYKWGVPVLLVFIIIGMLFGSDGIGGIYFDNYNITYSLSSIALVFIMFYGGFCTEWKKARSVAIPSIMLSTLGVIITAGLTGLFCHFVLKTSIFEGLLLGCIVASTDAASVISILRSRNLKLKNNIDTLVEFESGSNDPTAYMLTSVMLIFITSNESVGIGLLGMIFKQIVFGVTVGLFLSKLAVFILRKVEFEIEGLYPIFTITVAILAYSISEFLGGNGYLSVFIAGIVMGNSKIPHKKSLNHFFDGLSWIMQIILFFMLGLLAFPSQLPSIAFEGIAISIFLILVGRPIAVFTILSWFKVPIKEQMFISWVGLRGAGSLVFAIYAITKTSAIENDIFHIIFFIALFSVAIQGTLIPWFAKKLDLICYEDDNHEDNMKNNIKDYIFEVKVGENNKIVNKAIMDSEIPDEILIVMIKRDNKVVIPKGFTIIKPNDTLVLTSKNNEIMNSFLDEIR

SEQ ID NO: 13043 - protein, 419 aa, Pyrobaculum aerophilum str. IM2 [sequence omitted]

SEQ ID NO: 13044 - protein, 305 aa, Pyrobaculum aerophilum str. IM2
MIVASIGNLNFDIYLKVSELPGPDENVEALDLYTGGGGSAANFAVAIAKMGLSARFIGAVGEDPLGEISLRELRAEGVDVSFVKRVRGVRSGVVVVLVHPDGVKRMVSYRGANLGLTPADLTVDKFAGVKHIHLATGRTELILKAKEIAREIGASISVDGGTALARKGLEIVRAAVEGVDVVFMNHVEAQLVANAGDHKSAVEKLARELKVGELVVTLGPIGAVAFKNGRLLHVDAFKVNAVDTTGAGDCFAAAYITMYLRGRDLYERLLFANAAAAIKVTRPSARASPRYDEVVAFLESLGYKI

SEQ ID NO: 13045 - protein, 226 aa, Pyrobaculum aerophilum str. IM2
MGYVSNKAKILAKYVSPDAYIYGPSVIGAGSFIDAAVIGYPARQKILSGFKSPDEVSNGARIGEEVIIRSGVVIYEDVEIGDRAEFGHGVLVRELTRIGRGVRIGTSAIIERDVKIGDRAWIQSMVYIPNGTVIEEDVFIGPNAVITNDKYPPSKRLAPVVIRRGAVIGANATLIAGIEVGEGAVVAAGAVVTRDVPPGVVVAGVPARVIGKAEEYMRKRAAYEQS

SEQ ID NO: 13046 - protein, 721 aa, Pyrobaculum aerophilum str. IM2
MNMISYALLGVILGISGVIYAVYLAVWVLRQDPGNEKMRFISQAIATGARAYLFRQYRTLAVLLVILAVLILVAIDMPRRTFGLTALAFIVGALGSMLAGYLGMYVTTRSASRVAQAAATGGMGKALLVSWRAGAVMGLSLASIALLLISGFYLVFRSVLPDDWAVPLVALGFGASLVTLFMRVGGGIYTKAADLGADLVGKVEAGIPEDDPRNPGVIADNVGDNVGDVAGMAADVYESYIVTVTAAIFLAAILGLPTQFIEAIILFAALALVATFAGVNLLKTTGVKHPLSSISLAIYATIGLSVVLFFIGAFTLGLDSTKALALAATTSLGAVIAPLIVKITDYYTSYNYGPVRKIAEQAKISPATVIITGYGVGLMSAIPVIAVIVAVLGISYMIGYYTVPVSGFGELSKYLAGIFGTAMASVGLLVVAGIIITADSYGPVSDNAGGVVEMAGLPDEVREITDVLDSVGNTTKATTKGYAIASAALAALVLFIALIFEIVYSASKILGKGIVDMISESLSGLQLINANVLIGAFLGVALVYFFSSRTLEAVGRTAMEIVEEIRRQFREKPGILEWKEQPDYARVVDIATRRALGEFLIPGLAAIVLPLITGLLLGWNALAGLIMGAIVAGVPRALLMANAGGAWDNAKKYIEIQGLKKTEMHKAAVIGDTVGDPMKDTVGPSLNPLIKVLNTLSVVFTYVIVSTNIALGIWPSGLLPF

SEQ ID NO: 13047 - protein, 314 aa, Pyrobaculum aerophilum str. IM2
MLDIESLTPREALGKALADLGDLRSDVVVLVADTGETTRAKLFAERHPERFFNVGIAEQSLVGIAAGLALAGFMPYALTFAAFMTRGWEQARNSVDRLALPVRLVGTHAGFADAYDGPSHQALEDIALFRVLPNFTVMAPADSCEVYKAVTASATLKGPAYIRVGRDFHIPVTCGLYDKFEIGKAYVVLDGSDVAIFTTGVVLPFAIEAAQFLKDRGISAAVVHFPTIKPLDYAAVEKYASVTGAVLTVEEHMVYGGFGSAIAEYLSQTRPTKMAIMGLKSYGRTAKSPQELYQYFGLTPENIAARAEELVKLK

SEQ ID NO: 13048 - protein, 243 aa, Pyrobaculum aerophilum str. IM2
MPVAVVTGGSTGIGAAVVKTLAKRGYDVAFTYLKSERVAEAVAKEAESHGVRILYRRADATSWEEMRAFADEVRRVFGKVDALVANAGGLPQRRNLDESDLDYWKTLIDLNLTSAYIATKLFVPMMEKGVVVYVSSIAAYTGGGRGAFAYAAAKAGLLGLTRALAKELGPRGIRVVAVLPGLINTPFHEKAQTGDIDAWARNMVYMRRVGKPEEVAEVIAFLVSDGASYINGAFIDVNGGWYG

SEQ ID NO: 13049 - protein, 205 aa, Pyrobaculum aerophilum str. IM2
MARSGRYKVPFRRRREGLTNYRKRRKLLLSKKPRLVVRKTNKHIIAQIVVAKPQGDVTIVGADTRILAKFGWRGDENNVAAAYLLGLVVGYKARARRVEEAILDIGLHRPAPGARVFAVLKGALDAGLKIPHGEEVLPDEDRIKGKHVAEYAEKLKEENPEAYKARFSRYLQRGLEPEKLPEHFEEVKKKIVEYYEKKLAKVAAQ

SEQ ID NO: 13050 - protein, 811 aa, Pyrobaculum aerophilum str. IM2
MRFIKWLDEIGKKDILLAGGKGANLGEVAKMVQVPPGFVITTEAYLHFLNVTGLKDRINEVLKEFISKGEPDEYEKASTVIRGLIESSPLPSDLEKELLEAYKKLGEIVGMANVPVAVRSSATAEDIPEASFAGQQDTYLNVKGAENVIYYAKKVWSSLYTPRALYYRDKMGIPHEKSLMAVVVQKLVNARSAGVIFTLDPTTGDRSKVVIEASWGLGEGVVKGIVTPDEFVVDKSSLKIVERRISPKKVAVVRDEAGLVKEVQLPPEKVNAPALSDEEVVELAKMAIKLEEYYGHPVDIEFAVDADMEYPRNLFILQVRPETVWSRKAERPAKAAEEAPVGTVVVKGIPASPGIAVGQAKICLTLEDAKRKLKKGDILVTKMTDPDWVPYMRLASAIVTDEGGRTSHAAIVSRELGIPAVVGAGNATSVLKDGETYTVDGSKGIVMVGAVVKKEEAKAVEVGVAAPPKEIILHIYRAVPTATKVYMNLGEPDKIDEYKDLPFDGIGLMRIEFVISSWVGQHPLYLLSIGQEHKFVNKMAEGIAKVASAIYPRPVVVRFSDFKTNEYRGLEGGEKFEPEERNPMLGWRGVSRYISPQYERAFRLELKAIKKARQEMGLNNIWVMAPFVRTVWESEKFAKLLEEEGLYRDRDFKVWAMAQVPSIAFMVQEFSEYFDGFSIGSNDLTQLVLGVDRDNDFLVRINPKYFDEREAPVLRAIYELIKRAHKMGRTVSICGQGPSVYPQLVEFLVRGGIDSISVNPDAVLQTRVLVASVELKVLRERLDAIYNALYKPDESSEFYDILKKVFGQVRY

SEQ ID NO: 13051 - protein, 478 aa, Pyrobaculum aerophilum str. IM2
MIIVKNYINGEFIEVEERRPKHSPIDGSVIAETPVSKREDAKAAIDAAYDALKAWSQLPAIKRAEYLYKLYEIIKSREEELINILMVEGGGIYKKAWGEVVFTERLVRNAAELARHYGGKTLQSDAEGVVSMVFKRPKGVVGVITPWNYPLSISMKKIAHALATGNTIVYKPASETPVTGFKIAEMIHQAGFPKGVFNLVVGPGSTVGDEIVVNKKVSHVTFTGESATGREIASKAGGALKTVTLELGGSDPLIILDDADLNLAVRIAVFGAFFHQGQICTSSKRIIVHERVYDVFVKKFVERVSQLKVGDPRDRTVEQGPLISPRQADEMERFYQDAVSRGGRALTGGKRAGAYFWPTVFVDVDRNFRIMREEVFGPIRPVVPVKNDDEAVEVANDTEYGLSAAVVTTNINRAFKIAEAIESGMVHINDVTMLEESHVPFGGIKASGFGREGGEWSFHETTYDRWLTITLRERKYPI

SEQ ID NO: 13052 - protein, 320 aa, Pyrobaculum aerophilum str. IM2
MANMAKAINMALHEEMERDERVVVLGEDVGKKGGVFLVTEGLYERFGPERVIDTPLNEGGILGFAMGMAMAGLKPVAEIQFVDFIWLGADELLNHIAKLRYRSGGNYKAPLVVRTPVGSGTRGGLYHSQSPEAIFVHTPGLVVVMPSTPYNAKGLLKAAIRGDDPVVFLEPKILYRAPREEVPEGDYVVEIGKARVAREGDDVTLVTYGAVVHKALEAAERVKASVEVVDLQTLNPLDFDTVLKSVSKTGRLIIAHDSPKTGGLGAEVAALVAEKALDRLTAPVIRLAGPDVPQSPIAHDAAYAPTVERIIKAIEYVMRY

SEQ ID NO: 13053 - protein, 289 aa, Pyrobaculum aerophilum str. IM2
MEIELLLKGLWTRDGAGVRLYRVFGDPTLAELTDPFLLLDHFGSRYPHEYLAGFPWHPHRGIQTITYLLKGEVHHEDSEGNRGVLGPGDLQWMNAGSGIFHSEMPRPYRQDPEVSGFQLWVNLPRAKKMSDPFYKNLKSGSMPKLRTDEGATVRLISGRLREPGTGVVEGPVKELPIPVIYMDVELPAGVEFAFEVEEGWRTLVYNFGGPAVVQKKRIEDKSLVIMSTDGGVLTVRGPTRFLLLSGRPIGEPIAWRGPIVMNTWEEIRQAFLELERGTFIKKRASVEDI

SEQ ID NO: 13054 - protein, 461 aa, Pyrobaculum aerophilum str. IM2
MAKLKPDPTFYPTPRDAMRAPPEDIAYVAALYVGTGVNAPDFLAVVDVDPKSPTYGKVIYKLDLPYIGDELHHFGWNACSSAYCPNAKPFLERRYLIVPALRSSRIYIVDTKPDKRRPAVAKIVEPEVAVGRTGYTKYHTVHCGPDAIYISALGGPDGREGPGGIFLLDHDTFEPIGRWEVYRGPQYFAYDFWWNLPSGVMITSEWTVPRCFEEGFSLECLKEGAYGNKLHVWDLAKRRHLYAIDLGQEHRMVLEVRPLHDPTKLMGFVNVVLNTKDLSSSIWLWFYEDGKWQAERVIDIEAQPFEGPLPPVLKDFKMVPPLVTDIDISLDDRFLYVSLWGLGELRQYDITNPHQPRLAGRVKIGGLYHREPHPSGAEATGAPQMISVSRDGRRVYITNSLYSSWNNQFYPGLRGWMAKVNVNPEGGLELEKEFFVDFGRARAHQVRLWGGDASTDSFCYP

SEQ ID NO: 13055 - protein, 353 aa, Pyrobaculum aerophilum str. IM2
MKIPIKMRAALYKAPGQPLELAETEIPTPGEGEILIKVAATGVCHSDLHILDGEIVPPPEGFILGHEVSGWVVDFGPRCENPHGLSPGDPVVISWIIPCGKCYWCVRGQENYCPYAAARMPGLVGLNGGHAEYMSVPETAVFPIPKEVDVHTAAVISCAYGTAYRALKEAAVGPGTSLVVIGVGGVGLAAVELASALGARPIIAVDVRKHVLEKAAELGATHLINATNGDPLSKIRDILPQGADVVYETKPNPDLKLAVEIVRRGGTIVVTGLGTSTIEIPANHIVMNGIRIIGSLGYKPRTDIPELLTLAASGKIKPQRLISHKYAPNEINEAYKNLRIGLHHRAIIIWNTK

SEQ ID NO: 13056 - protein, 345 aa, Pyrobaculum aerophilum str. IM2
MMLAIGKRRYVRTRQYPARKVKIVSEATELLQKYPYVFLFDLHGLSSRILHEYRYRLRRYGVIKIIKPTLFKIAFTKVYGGIPAEIAEKVRGEVGFFFTSFNPAEVIKIVAENSVRRAAQPGDKAPFDIVVPAGPTNASPGPIISKFGKLKIPTRVQEGKIWIAKDTVVAKAGQEITPEMAEVLRVVGIEPIFEQLRLLGVIWRGQRFVDISELIIDVNKYKELFETASVYARNLALNIVYPTREVLQAVIPAAHMRAVALAAKLGVVTRETLPALLSRAVAEANALAAVVAAKAPDLGISVSLPQTAAPQQTPQPTEAPKEEAQEEKKEGPSEEEIAGSLASLF

SEQ ID NO: 13057 - protein, 437 aa, Pyrobaculum aerophilum str. IM2
MPESRVKDSSLADRGREQLYWAELNMPVLLEIRRRFEKEKPLSGHVIAACLHVTKETGVLVRTLAAGGAEVVLIPSNPLSTQDDVAAALAQEGIHVYAWRGMSEREYYNAIGFALSFNPTITMDDGADLTATIHKIGHGVRDQTIEYVLETAGSLDAAGLFSRIRGGTEETTTGVIRLKALKKSGKLLYPIIAVNESYTKYLFDNRYGTGQSTWDGVMRATNLLIAGKNVVIAGYGWVGRGIAIRARGLGARRVIVVEVDPIRALEAVFDGYEVMPMDKAAEVGDIFITATGNIRAISLGHIFKMKDGAVLANAGHFNVEIDVAGLERVAVAKRRIRPYLEEYTLPNGKRVYLIGEGRLVNLVAAEGHPSEVMDLSFANQALAAEFLAKNKLSVDVYKLPDEIDREVARLKLKTMGIEIEELTEEQRRYISSWELGT

SEQ ID NO: 13058 - protein, 273 aa, Pyrobaculum aerophilum str. IM2
MKRACFKRVGCVPAIGLGTWGIGGGFWIADTSRDAEWIEAIKYAVEKGIKLIDTAEMYGGGHAEELVGRAIRGFARDELFIITKVWPNHARYDDVIKSAEASASRLGTYIDLYLLHWPSDSVPICETIKAFEALVDRGVIRHFGVSNFSLSQLQEAEACAKKYQLAAVQNHYSLYNRRDEVDVIPYAQANGIMYIAYTPLEKGALARDPLLAEIGRKYGITPVQAALAWYVKRGVVPIPKAERKNHIDEIAGALGVELSDEDFARISSGVRRG

SEQ ID NO: 13059 - protein, 915 aa, Pyrobaculum aerophilum str. IM2
MEKYVYSFKEADYRNKKLFGGKGASLIQMTQLGLRVPPGFIITTEACKKFYEPRRREISELEGILLKNPPPEVRDEVIKKLHAIIDSLDLPGEIWSQVVSYMRELEKETGKRFGDPENPLLVSVRSGAAVSMPGMMDTVLNLGLNDETVKGLAKQTGNEWFAYDAYRRFLQMFGKIVLSIDEKLFSTAWEEIKRKYGVKDDPDVQLEGLKEAVERFKEIIVRARGGFPQDPWEQLKLAIKAVFRSWMSPRAIFYRIIEKITPDIADCTAVNVVTMVFGNAGWDSGTGVVFSRDVATGENKLYGEFLPVAQGEDVVAGIRTPMDIEEFRKRFPHLYEELYQGVKLLEKVNKDVQDVEFTVERGKLYFLQTRNAKMTALARVKTAVDMAKEGIITKEEALLMVSPDHVLQLLYPRIDPKAKATLVAQGLPASPGAVSGQVVFHPDDAVRWAAQGKRVILARVETKPDDVHGFYAAVGVLTSRGGMTSHAAVVARAIGKPAVVGAESIEIHEEEKYLKVGTHVIREGDWITIDGHTGNVYIGVVPTIEAELIPELEELLRWADEIRRLGVRANADLPEDAAIARKFGAQGIGLLRIERMFRKPERLELLRRIILAESPEERRPHLEALYKMLKNDFKEVFKIMDGLPVVVRLIDPPLHEFLPKPEEILEQIYQRKMRGDDASELEKLYRRVKALQEANPMLGHRGVRVGVTHPDFYYYLNKAILEAAAELKKEGFNPVVEIMIPQVSDVREIIYVKEKAIIPALKDVEASTGVKLDVKIGTMIETVRACLTIDEIAKHVDFISFGTNDLTQAVFSFSRDDAENKFIPQYLDLKILDADPFETIDIKGVGKLVEYAAKTAKEVNPSIEVGVCGEHGGDPKSIYFFHNKVDYVSASPFRVPLARLSAAQAAIINRQNPHY

SEQ ID NO: 13060 - protein, 355 aa, Homo sapiens
  unsure (1)..(355): unsure at all Xaa locations
MGCTVSAEDKAAAERSKMIDKNLREDGEKAAREVKLLLLGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDXIIKNNLKDCGLF

SEQ ID NO: 13061 - protein, 505 aa, Homo sapiens
MPSGFQQIGSEDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNVLAVLGGSLMGLANAAASYEMLILGRFLIGAYSGLVPMYVGEIAPTHLRGALGTLNQLAIVIGILIAQVLGLESLLGTASLWPLLLGLTVLPALLQLVLLPFCPESPRYLYIIQNLEGPARKSLKRLTGWADVSGVLAELKDEKRKLERERPLSLLQLLGSRTHRQPLIIAVVLQLSQQLSGINAVFYYSTSIFETAGVGQPAYATIGAGVVNTVFTLVSVLLVERAGRRTLHLLGLAGMCGCAILMTVALLLLERVPAMSYVSIVAIFGFVAFFEIGPGPIPWFIVAELFSQGPRPAAMAVAGFSNWTSNFIIGMGFQYVAEAMGPYVFLLFAVLLLGFFIFTFLRVPETRGRTFDQISAAFHRTPSLLEQEVKPSTELEYLGPDEND

SEQ ID NO: 13062 - protein, 721 aa, Crithidia fasciculata
MSNHDVSLSNASHYNHANYTELVPLPTIAQTPTHHFAHDENHVTITENGVTMTTTVSAAAMMTATAPLPVSPVHAFDEAAQRRLLARKTALLEQYRMYPQSADRLAQQRRHHEASHLRDAEDSDGAALSPSLLSPTDCNKTTAAYAQTVAMSPNEKGGADRHTPVAASQDLVDLFFLEGSDAVNGMSFSAYPIYGERTAAERRAAVRAVFEKYGVDMQLPASPAVLAAAPAHRQRRFRTVLPRDSVETREQYWRRLSNVYIQKGVKATMAAAANPTGSNKPAYEAEDPFYMIDLGRVVEQMARWRHELPMVRPHFAVKCNPNLAIMEVLGALGAGFDCASKDEIHLVLDNHLVDSPDDIVFANPCKQLGDLREARACGVTYVTVDNVPEMEKIGRMLPSARAIIRIKTNDAAAKCAFSTKFGAGMDDVESLLQAARQHNVEVYGVSFHVGSGNGDQSAYVSALRDSYRVFQLAAGYGFNCTVLDIGGGYPGTEPIPGSGETSFETIARAMRPVLEELFGGGDVTIISEPGRYFTAATHALAMNVFATRTLRLSDVEKENCQAFQNVVNMDEPEEYQYYVNDGLYHSFNCIVFDHAHPTLLLLNDGDGADDTAEGVANAAVDDVDSEEEGEPTVDGAPTNDSLFVSAWDRRRNLTRRPLRITTIFGPTCDSMDCILKKQPFPEMKLGDWLLAPDMGSYTTAAGCPFNGFATRRREWVSSVAL

SEQ ID NO: 13063 - protein, 294 aa, Sesbania rostrata
MEQYEKVEKIGEGTYGVVYKARDRVTNETIALKKIRLEQEDEGVPSTAIREISLLKEMQHRNIIRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPGILLGSRHYSTPVDIWSVGCIFAEMVNRRPLFPGDSEIDELFKIFRILGTPNEDTWPGVTSLPDFKSTFPKWPPKDLATVVPNLEQAGLNLLSSMLCLDPSKRITARSAVEHEYFKDIKFVP

SEQ ID NO: 13064 - protein, 445 aa, Sesbania rostrata
MASRPIVPQQPRGDAALGAGKQQKKNGAADGRNRKALGDIGNLVTVRGVEVKPNRPITRSFCAQLLANAQAAAAAENNKKQACPNVAGPPPVVEGVAVAKRVAPKPGQKKVTTKPKPEEVIEISPDEEVHKDNNKKKEGDANTKKKSHTYSSVLTARSKAACGLTNKPKEIIDIDAADTANELAAVEYIEDIYKFYKMVENESRPHDYMDSQPEINERMRAILVDWLIDVHSKFDLSLETLYLTINIVDRFLAVKTVPRRELQLVGISAMLMASKYEEIWPPEVNDFVCLSDRAYTHEQILFMEKIILGKLEWTLTVPTPFVFLVRFIKASVPDEALENMAHFLSELGMMHYATLMYCSSMVAASAVYAARCTLNKSPVWNETLKQHTGYSEEQLMDCARLLVSLHSTVGNGKLKVVYRKYSDPERGSVAVLPPAKNLLSEGKSL

SEQ ID NO: 13065 - protein, 112 aa, Herbaspirillum seropedicae
MKQVTAIIKPFKLDEVRESLAEVGVTGLTVTEVKGFGRQKGHTELYRGAEYVVDFLPKVKIEVVVDDKVVEQAVDAIIKAARTGKIGDGKIFVQEVEQVIRIRTGETGPDAV

SEQ ID NO: 13066 - protein, 309 aa, Apium graveolens
MAITLNSGFKMPVLGLGVWRMDRNEIKNLLLSAINLGYRHFDCAADYKNELEVGEAFKEAFDTDLVKREDLFITTKLWNSDHGHVIEACKNSLKKLQLEYLDLYLIHFPMASKHSGIGTTRSILDDEGVWEVDATISLEATWHEMEKLVEMGLVRSIGISNYDVYLTRDILSYSKIKPAVNQIETHPYFQRDSLIKFCQKYGIAITAHTPLGGALANTERFGSVSCLDDPVLKKLSDKHNKSPAQIVLRWGVQRNTIVIPKSSKTKRLEENINIFDFELSKEDMELIKTMERNQRSNTPAKAWGIDVYA

SEQ ID NO: 13067 - protein, 191 aa, Mus sp.
MMGAPLNCPMKSMPLFPSSARIGITPPRQSAPDSFYCAYWGCETTGRAYWKPSSSWDFITVNNNLTSDQAVQNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMR

SEQ ID NO: 13068 - protein, 248 aa, Azoarcus evansii
MQLKDKVAVVTGAGQGIGAAVARAYAREGAKVAVIDIDQATADRMAGQIVEAGGQAIGVACNVADRDHVEAMAAKVNAEWGRIDILVNNAGITRTAMLNKMTPEQWNQVLAVHLTGAFNCLQAVVGGMIERQYGRIIYVTSTAGVLGTIGQINYSAAKAGVLGMTKSTAKELARYGITANAIAPGAATPMTETIRTDERFKEKYLDRIPLGRWAEPEEITPVFVFFASDASSYVTGQILAADGGMTIH

SEQ ID NO: 13069 - protein, 384 aa, Nicotiana tabacum
MGLLCSRNKGYNQADDEENTQTADIERRIEQETKADKHIQKLLLLGAGDSGKSTIFKQIKLLFQTGFDEAELKNYIPVIHANVYQTIKVLHDGSKELAQSELEASKYLLSAENKDIGEKLSEIGGRLDYPHLTKDLVQDIEALRKDPAIQETILRGNELQVPDCAHYFMENLQRFSDINYVPSKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSFMLFLNKFDIFEQKALKVPLNVCEWFKDYQSVSTGKQEIEHAYEFVKKKLEESYFQCTAPDRVDRVFKIYRTTALDQKLVKKTFKLVDETLRRRNLFEAGLL

SEQ ID NO: 13070 - protein, 366 aa, Nicotiana tabacum
NQADDEENTQTADIERRIEQETKADKHIQKLLLLGAGDSGKSTIFKQIKLLFQTGFDEAELKNYIPVIHANVYQTIKVLHDGSKELAQSELEASKYLLSAENKDIGEKLSEIGGRLDYPHLTKDLVQDIEALWKDPAIQETILRGNELQVPDCAHYFMENLQRFSDINYVPSKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSFMLFLNKFDIFEQKALKVPLNVCEWFKDYQPVSTGKQEIEHAYEFVKKKFEESYFQCTAPDRVDRVFKIYRTTALDQKLVKKTFKLVDETLRRRN

SEQ ID NO: 13071 - protein, 366 aa, Nicotiana tomentosiformis
NQADDEENTQTADIERRIEQETKADKHIQKLLLLGAGDSGKSTIFKQIKLLFQTGFDEAELKNYIPVIHANVYQTIKVLHDGSKELAQSELEASKYLLSAENKDIGEKLSEIGGRLDYPHLTKDLVQDIEALWKDPAIQETILRGNELQVPDCAHYFMENLQRFSDINYVPSKEDVLFARIRTTGVVEIQFSPVGENKKSGEVYRLFDVGGQRNERRKWIHLFEGVTAVIFCAAISEYDQTLFEDERKNRMMESKELFEWVLKQPCFEKTSFMLFLNKFDIFEQKALKVPLNVCEWFKDYQSVSTGKQEIEHAYEFVKKKFEESYFQCTAPDRVDRVFKIYRTTALDQKLVKRTFKLVDETLRRRN

SEQ ID NO: 13072 - protein, 1058 aa, Medicago sativa
MAGNDWLNSYLEAILDVGPGLDDAKSSLLLRERGRFSPTRYFVEEVIGFDETDLYRSWVRASSSRSPQERNTRLENMCWRIWNLARQKKQLESEAVQRVTKRRLERERGRREATADMSEDLSEGERGDPVSDVSAHGGESTKARLPRISSADAMETWAHSHKGKKLYIVLISIHGLIRGENMELGRDSDTGGQVKYVVELARALGSMPGVYRVDLLTRQVASPDVDWSYGEPTEMLAPRNTDEFGDDMGESSGAYIIRIPFGPRNKYIPKEELWPYIPEFVDGAIGHILQMSKALGEQIGSGHAVWPVAIHGHYADAGDSAALLSGALNVPMLFTGHSLGRDKLEQLLKQGRLSRDEINTTYKIMRRIEAEELALDGSEIVITSTRQEVEEQWRLYDGFDPVLERKIRARIRRNVSCYGRYMPRVAVIPPGMEFHHIVPQDGDIETEPEGILDHPAPQDPPIWSEIMRFFTNPRKPVILALARPDPKKNITTLVKAFGECRPLRELANLTLIMGNRDGIDEMSSTSSSVLLSVLKLIDKYDLYGQVAYPKHHKQSDVPEIYRLAAKTKGVFVNPAIIEPFGLTLIEAAAYGLPMVATKNGGPVDIHRVLDNGLLVDPHDQKSIADALLKLVSNKQLWAKCRLNGLKNIHLFSWPEHCKTYLSKIATCKPRHPQWQRSEDGGESSESEESPGDSLRDIHDLSLNLKFSLDGERSGDSGNDNSLDPDGNATDRSAKIENAVLSWSKGISKDVRKGGAAEKSGQNSNAGKFPPLRSRNRLFVIAVDCDTTSGLLEMIKVIFEAAGEERADGSVGFILSTSMTISEIQSFLISGGLSPNDFDAYICNSGSDLYYPSLNSEDRLFVGDLYFHSHIEYRWGGEGLRKTLVRWAASTTDKKGESNEQIVSPVEQLSTDYCYAFKVRKPGMAPPLKELRKLMRIQALRCHPIYCQNGTRLNVIPVLASRSQALRYLYVRWGFELSKMVVFVGECGDTDYEGLVGGLHKSVILKGVGSRAISQLHNNRNYPLSDVMPMDSPNIVEATEGSSSADIQALLEKVGYLKG

SEQ ID NO: 13073 - protein, 520 aa, Neurospora crassa
MVHLTIIPKEDEIRDGLDIPLTGALKAVHLQLANDEDRFTTSVYGSKFAAADLPRHEMPDEEMPKEVAYRMIKDELSLDGNPLLNLASFVTTYMEEEAEKLMTESLPKNFIDYEEYPQTADIQNRCVSMIGRLFNAPVKDAEASSAVGTSSVGSSEAIMLGVLAMKKRWKNKRIAEGKPADKPNLIMSSAVQVCWEKATRYFEVEEKFVYCTPDRYVIDPKETVDLVDENTIGICCILGTTYTGEYEDVKAVNDLLVERGLDTPIHVDAASGGFVAPFVVPDLEWDFRLKNVVSINVSGHKYGLVYPGVGWVVWRSAEYLPQELVFNINYLGADQASFTLNFSKGASQVIGQYYQLIRLGKHGYRAIMSNLTRTADYLAESLAALGFIIMSQKSGQGLPLVAFRLKEDPDRTYDEFALAHQLRVRGWIVPAYTMAPKTEGLKMLRIVVREDFSRNRCDGLISDIRSCQGILEQMDKETVKKQQEFIHKHHVVSGKASHNHPKYHILWSESNSSRNQATPE

SEQ ID NO: 13074 - protein, 378 aa, Arabidopsis thaliana
MESDLIDLFEGAKKAADAAALDGVTSSGPEVSQCIDALKQLKKFPVTYDTLVATQVGKKLRSLAKHPVEDIKSVATDLLEIWKKVVIEETAKAKKTEGTNGCKEAKVNKMDVEKPSNPAPVKVQKLQRGDSAKSIKVERKEPDNKVVTGVKIERKVPDIKVTNGTKIDYRGQAVKDEKVSKDNQSSMKAPAKAANAPPKLTAMLKCNDPVRDKIRELLMEALCRVAGEADDYERESVNASDPLRVAVSVESLMFEKLGRSTGAQKLKYRSIMFNLRDSNNPDLRRRVLTGEISPEKLITLSAEDMASDKRKQENNQIKEKALFDCERGLAAKASTDQFKCGRCGQRKCTYYQMQTRSADEPMTTYVTCVNCDNHWKFC

SEQ ID NO: 13075 - protein, 724 aa, Bradyrhizobium sp. ORS278
MPVPLTTPAFGHATLANCEREQIHLAGSIQPHGILLAVKEPDNVVIQASINAAEFLNTNSVVGRPLRDLGGDLALQILPHLNGPLHLAPMTLRCTVGSPPRRVDCTVHRPSNGGLIVELEPATKTTNVAPALDGAFHRITSSSSLIGLCDETATIFREITGYDRVMVYRFDEEGHGEVLSERRRPDLEAFLGNRYPASDIPQIARRLYERNRVRLLVDVNYTPVPLQPRISPLNGRDLDMSLSCLRSMSPIHQKYLQNMGVGATLVCSLMVSGRLWGLIACHHYEPRFVPFDIRAAGEALAETCAIRIAALESFAQSQSELVVRRLEQRLVEAVSRDGEWQAALFDGSQSLLQPLGASGAALLFEGQVMTAGDVPSTQRIRDLATWLDRRRKAPDAPPQGLTVTASLTLDDPSFADIRSIASGLIAAPLSASEGEYLLWFRPEQVRTVTWGGDPLKAVIIGDDPSDLSPRRSFAQWHQLVEGKSEPWSPAELASARLVSETVADVALQLRSVRMVIAQDQLATISAQVLRSEQPVIIADVEGRILLLNEAFEQQLRASHPHIPHLRDLGAYCTAPAEFRANLDDLMRNKRSWRGELTLTGGATPQRPLMVRADPVIAPHDRVLGFVLIFSDLTERKTAEAARARFQEEIDGARRPSLRLDQSASLIYKELAASTVENAQLAALEVTHGAEAGSMPEMLESIRNSTARTLGILEHLVWYRSQSEE

SEQ ID NO: 13076 - protein, 365 aa, Arabidopsis thaliana
MAGDMQGVRVVEKYSPVIVMVMSNVAMGSVNALVKKALDVGVNHMVIGAYRMAISALILVPFAYVLERKTRPQITFRLMVDHFVSGLLGASLMQFFFLLGLSYTSATVSCALVSMLPAITFALALIFRTENVKILKTKAGMLKVIGTLICISGALFLTFYKGPQISNSHSHSHGGASHNNNDQDKANNWLLGCLYLTIGTVLLSLWMLFQGTLSIKYPCKYSSTCLMSIFAAFQCALLSLYKSRDVNDWIIDDRFVITVIIYAGVVGQAMTTVATTWGIKKLGAVFASAFFPLTLISATLFDFLILHTPLYLGSVIGSLVTITGLYMFLWGKNKETESSTALSSGMDNEAQYTTPNKDNDSKSPV

SEQ ID NO: 13077 - protein, 369 aa, Arabidopsis thaliana
MSIEKPFFGDDSNRGVSINGGRYVQYNVYGNLFEVSKKYVPPLRPIGRGASGIVCAAWNSETGEEVAIKKIGNAFGNIIDAKRTLREIKLLKHMDHDNVIAIIDIIRPPQPDNFNDVHIVYELMDTDLHHIIRSNQPLTDDHSRFFLYQLLRGLKYVHSANVLHRDLKPSNLLLNANCDLKIGDFGLARTKSETDFMTEYVVTRWYRAPELLLNCSEYTAAIDIWSVGCILGEIMTREPLFPGRDYVQQLRLITELIGSPDDSSLGFLRSDNARRYVRQLPQYPRQNFAARFPNMSVNAVDLLQKMLVFDPNRRITVDEALCHPYLAPLHEYNEEPVCVRPFHFDFEQPSLTEENIKELIYRESVKFNP

SEQ ID NO: 13078 - protein, 335 aa, Arabidopsis thaliana
MKFCKKYEEYMQGQKEKKNLPGVGFKKLKKILKRCRRNHVPSRISFTDAINHNCSRECPVCDGTFFPELLKEMEDVVGWFNEHAQKLLELHLASGFTKCLTWLRGNSRKKDHHGLIQEGKDLVNYALINAVAIRKILKKYDKIHESRQGQAFKTQVQKMRIEILQSPWLCELMAFHINLKESKKESGATITSPPPPVHALFDGCALTFDDGKPLLSCELSDSVKVDIDLTCSICLDTVFDPISLTCGHIYCYMCACSAASVNVVDGLKTAEATEKCPLCREDGVYKGAVHLDELNILLKRSCRDYWEERRKTERAERLQQAKEYWDYQCRSFTGI

SEQ ID NO: 13079 - protein, 157 aa, Arabidopsis thaliana
MNTIVVAQLQRQFQDYIVSLYQQGFLDNQFSELRKLQDEGTPDFVAEVVSLFFDDCSKLINTMSISLERPDNVDFKQVDSGVHQLKGSSSSVGARRVKNVCISFKECCDVQNREGCLRCLQQVDYEYKMLKTKLQDLFNLEKQILQAGGTIPQVDIN

SEQ ID NO: 13080 - protein, 1057 aa, Arabidopsis thaliana
MNWALNNHQEEEEEPRRIEISDSESLENLKSSDFYQLGGGGALNSSEKPRKIDFWRSGLMGFAKMQQQQQLQHSVAVKMNNNNNNDLMGNKKGSTFIQEHRALLPKALILWIIIVGFISSGIYQWMDDANKIRREEVLVSMCDQRARMLQDQFSVSVNHVHALAILVSTFHYHKNPSAIDQETFAEYTARTAFERPLLSGVAYAEKVVNFEREMFERQHNWVIKTMDRGEPSPVRDEYAPVIFSQDSVSYLESLDMMSGEEDRENILRARETGKAVLTSPFRLLETHHLGVVLTFPVYKSSLPENPTVEERIAATAGYLGGAFDVESLVENLLGQLAGNQAIVVHVYDITNASDPLVMYGNQDEEADRSLSHESKLDFGDPFRKHKMICRYHQKAPIPLNVLTTVPLFFAIGFLVGYILYGAAMHIVKVEDDFHEMQELKVRAEAADVAKSQFLATVSHEIRTPMNGILGMLAMLLDTELSSTQRDYAQTAQVCGKALIALINEVLDRAKIEAGKLELESVPFDIRSILDDVLSLFSEESRNKSIELAVFVSDKVPEIVKGDSGRFRQIIINLVGNSVKFTEKGHIFVKVHLAEQSKDESEPKNALNGGVSEEMIVVSKQSSYNTLSGYEAADGRNSWDSFKHLVSEEQSLSEFDISSNVRLMVSIEDTGIGIPLVAQGRVFMPFMQADSSTSRNYGGTGIGLSISKCLVELMRGQINFISRPHIGSTFWFTAVLEKCDKCSAINHMKKPNVEHLPSTFKGMKAIVVDAKPVRAAVTRYHMKRLGINVDVVTSLKTAVVAAAAFERNGSPLPTKPQLDMILVEKDSWISTEDNDSEIRLLNSRTNGNVHHKSPKLALFATNITNSEFDRAKSAGFADTVIMKPLRASMIGACLQQVLELRKTRQQHPEGSSPATLKSLLTGKKILVVDDNIVNRRVAAGALKKFGAEVVCAESGQVALGLLQIPHTFDACFMDIQMPQMDGFEATRQIRMMEKETKEKTNLEWHLPILAMTADVIHATYEECLKSGMDGYVSKPFEEENLYKSVAKSFKPNPISPSS

SEQ ID NO: 13081 - protein, 444 aa, Lycopersicon esculentum
MAQSNSKPPMSSQNFGVGAVSHVRSLSQSSIFSNSCLPPLSPFPPSEPGMVSGRSSLKDISMEEADVNSQGVGVVSSFTRDGLPPRKGHRRSNSDVPLGFSAMIQSSPQLMPISGQKVLGRAVSLGDSNGKIDERKPKGEVTDELLFSYMNLENIETLNGSGTKDRDKDSIVSGTKVTGSESSNNEAESVMKGNNVSIQPTNLREGTKRSADANIAPAARHFRSLSMDSAIGNFHYGDESPNLPTSLMMRSGQLSPSNSGNESSSKHNLDFGNSEFSEAEMKKIMADERLAEIAVLDPKRAKRILANRLSAARSKERKTRYISELEHKVQKLQTETTTLSTQVTILQKNFVEISSLNSELKFRIQAMEQQAQLRDALHEALTAEVQRLKLAAGEHREEGRLPNNMTQQTPVKHNIFQMQRQQPSQMQQLSVGKASAASATPASA

SEQ ID NO: 13082 - protein, 300 aa, Sorghum bicolor
MGRRACCAKEGVKRGAWTAKEDDVLAAYVKAHGEGKWREVPQKAGLRRCGKSCRLRWLNYLRPNIKRGNISYDEEDLIIRLHKLLGNRSVSVVRAGGGRWSLIAGRLPGRTDNEIKNYWNSTLGRRAGITTGAVGGSRVVVVAPDTGGSHSRATPAASGSCETAGRQKQQGAAAAPPPPRADPDSAGSAAAAAAAGTTTAVWAPKAVRCTAGGRLFFFHRDTTTPTPTTPMAGGGEACAGSSPDDCSSSAASVSPLVGSQQDEPCFSGGDWMDDVRALASFLESDEEWLRCQQTAEEQLA

SEQ ID NO: 13083 - protein, 523 aa, Arabidopsis thaliana
MNCAISGEVPEEPVVSKKSGLLYEKRLIQTHISDYGKCPVTGEPHTLDDIVPIKTGKIVKPKPLHTASIPGLLGTFQTEWDSLMLSNFALEQQLHTARQELSHALYQHDAACRVIARLKKERDESRQLLAEAERQLPAAPEVATSNAALSNGKRGIDDGEQGPNAKKMRLGISAEVITELTDCNAALSQQRKKRQIPKTLASVDALEKFTQLSSHPLHKTNKPGIFSMDILHSKDVIATGGIDTTAVLFDRPSGQILSTLTGHSKKVTSIKFVGDTDLVLTASSDKTVRIWGCSEDGNYTSRHTLKDHSAEVRAVTVHATNKYFVSASLDSTWCFYDLSSGLCLAQVTDASENDVNYTAAAFHPDGLILGTGTAQSIVKIWDVKSQANVAKFGGHNGEITSISFSENGYFLATAALDGVRLWDLRKLKNFRTFDFPDANSVEFDHSGSYLGIAASDIRVFQAASVKAEWNPIKTLPDLSGTGKATSVKFGLDSKYIAVGSMDRNLRIFGLPDDDNTEDSAQDS

SEQ ID NO: 13084 - protein, 383 aa, Arabidopsis thaliana
MRSSQNGGAMGGRAAGTGGGGPSAPVDKEVDYAQYFCTYSFLYHQKDMLSDRVRMDAYFNAVFQNKHHFEGKTVLDVGTGSGILAIWSAQAGARKVYAVEATKMADHARALVKANNLDHIVEVIEGSVEDISLPEKVDVIISEWMGYFLLRESMFDSVISARDRWLKPTGVMYPSHARMWLAPIKSNIADRKRNDFDGAMADWHNFSDEIKSYYGVDMGVLTKPFAEEQEKYYIQTAMWNDLNPQQIIGTPTIVKEMDCLTASVSEIEEVRSNVTSVINMEHTRLCGFGGWFDVQFSGRKEDPAQQEIELTTAPSEQHCTHWGQQVFIMSNPINVEEGDNLNLGLLMSRSKENHRLMEIELNCEIKEASGNPKESFKKTYFIE

SEQ ID NO: 13085 - protein, 573 aa, Arabidopsis thaliana
MEHMMKEGRSLAETPTYSVASVVTVLVFVCFLVERAIYRFGKWLKKTRRKALFTSLEKMKEELMLLGLISLLLSQSARWISEICVNSSLFNSKFYICSEEDYGIHKKVLLEHTSSTNQSSLPHHGIHEASHQCGHGREPFVSYEGLEQLLRFLFVLGITHVLYSGIAIGLAMSKIYSWRKWEAQAIIMAESDIHAKKTKVMKRQSTFVFHHASHPWSNNRFLIWMLCFLRQFRGSIRKSDYFALRLGFLTKHNLPFTYNFHMYMVRTMEDEFHGIVGISWPLWVYAIVCICINVHGLNMYFWISFVPAILVMLVGTKLEHVVSKLALEVKEQQTGTSNGAQVKPRDGLFWFGKPEILLRLIQFIIFQNAFEMATFIWFLWGIKERSCFMKNHVMISSRLISGVLVQFWCSYGTVPLNVIVTQMGSRHKKAVIAESVRDSLHSWCKRVKERSKHTRSVCSLDTATIDERDEMTVGTLSRSSSMTSLNQITINSIDQAESIFGAAASSSSPQDGYTSRVEEYLSETYNNIGSIPPLNDEIEIEIEGEEDNGGRGSGSDENNGDAGETLLELFRRT

SEQ ID NO: 13086 - protein, 168 aa, Cerebratulus cf. lacteus
MSTITKVHARQIYDSRGNPTVEVEVTTGQGTFRAAVPSGASTGIYEALELRDKDKAVHHGKGVNTAVANVINSLGPAVKGMVVKEQTAVDEKMLTLDGSDNKSKFGANAILGVSLAVCKAGAAAKGVPLYRHIADLAENKKVVLPVPAFNVINGGSHAGNKLAMHEFM

SEQ ID NO: 13087 - protein, 161 aa, Dugesia cf. dorotocephala
MSITRIFARQIFDSRGNPTVEVDLTTAKGLFRAAVPSGASTGVHEALELRDNDKHNYHGKGVLKAVENVNKIIAPKLIEKGLHVTHQAEIDNFMIKELDGTPNKAKLGANAILGVSLAVAKAGAAEKGIPLYRHFCDLAGHKEVILPVPAFNVINGGSHAG

SEQ ID NO: 13088 - protein, 170 aa, Echinostoma caproni
MTMAIKSIHARQIFDSRGNPTVEVDVTTAKGLFRAAVPSGASTGVHEALELRDGPPGYMGKGVLKAVSNVNNQIAQVFWKCGIPVTDQAGIDNFMLQLDGTPNKEKLGANAILGVSLAVCKAGAAEKGLPLYKYIASLAGNNDVVIAVPSFNVINGGSHAGNKLAMHEFM

SEQ ID NO: 13089 - protein, 173 aa, Hydra cf. oligactis
MAPITKIHAREILDSTGNPTVEVDLTTPLGTFRAAVPSGASTGIHEALELRDKDPKRYLGKGVTKAVENVNEIIAPYLISKNIDCTKQKEVDQLMIELDGTPNKSKLGANATLGVSLAVSKAGAAQKGVPLYKHLADLAGNENLILPVPAFNVINGGSHAGNKLAMHEFMIGP

SEQ ID NO: 13090 - protein, 168 aa, Hymenolepis diminuta
MSIVKIHARQIFDSRGNPTVEVDLFTDNGMFRAAVPSGASTGVHEAVELRDNDKANYMGKGVLNAVKNVNDIIAPELIKKGFKVTEQEAIDEFMIKLDGTKNKGKLGANAILGVSLAVCKAGAALKGVPLYRHIAELAGNKDVILPVPAFNVLNGGSHAGNKLAMHRI

SEQ ID NO: 13091 - protein, 168 aa, Haematoloechus sp.
MSIKKIHARQIFDSRGNPTVEVDVFTDKGTFRAAVPSGASTGVHEALELRDGGKTYMGKAVLKAISNVNDKIAPELIKANIPVTDQTAIDNFMIKLDGTKNKATLGANAILGVSLAVCKAGAAEKGVPLYRYIASLAGNNDVILPVPSFNVINGGSHAGNKLAMHEFM

SEQ ID NO: 13092 - protein, 168 aa, Stylochus zebra
MSIKKIHGRQIFDSRGNPTVEVDITTEKGMFRAAVPSGASTGVHEALEMRDKAKEYMGKGVLNAVNNVNNVIGPALIAKGFSVVEQENIDNFMLELDGTENKAKLGANAILGVSLAVLKAGAAQKGTPLYRHIADLAGNNEVILPVPAFNVINGGSHAGNKLAMHEFM

SEQ ID NO: 13093 - protein, 166 aa, Tubularia sp.
MSGVTKIHAREILDSRGNPTVEVDLATSRGVFRAAVPSGASTGIYEALELRDKDPKRYLGKGALKAVSNINDIIGPALISKNIDCTQQGEVDKIMLELDGTENKSKLGANAILAVSLAVCKAGAAHKGVPLYKHIADLAGNSKVIMPVPAFNVINGGSHAGNKLAM

SEQ ID NO: 13094 - protein, 170 aa, unidentified pseudophyllidean
MSIQKIHARQIFDSRGNPTVEVDLYTAKGMFRAAVPSGASTGIHEAVELRDDDKKNYMGKGVLHAVKNVNDIIAPAVIKSGLSVTKQKEIDELMIKLDGTPNKGKLGANAILGVSLAACKAGAAEKGVPLYRHIADLAGNKDVVLPVPAFNVINGGSHAGNHKLAMHEFM

SEQ ID NO: 13095 - protein, 323 aa, Homo sapiens [sequence omitted]

SEQ ID NO: 13096 - protein, 323 aa, Homo sapiens [sequence omitted]

SEQ ID NO: 13097 - protein, 201 aa, Arabidopsis thaliana
MGRQLYTTTVLYLVTLLFICRTISAVRFPPEQPTTDDLDFIRTSCNTTLYPDVCYTSLAGYASAVQDNPARLAKLAIGVSLSRAKYTAAYLSKLSRRAASAAVHDCVSNVGDAVDQMRGSLRQLREMNHRRPGDPAFRFQMSNVQTWMSAALTDEETCTDGVTEEMEDGETKTAICDRVADVKRFTSNALALVNTYANNGA

SEQ ID NO: 13098 - protein, 114 aa, Arabidopsis thaliana
MEGDVLSGFGDRHNMDGKLLQSFQKSFVDVQDILDQNRLLINEINQNHESKQPDNLGRNVGLIKELNNNIRRVASLYGDLSHSFARSVDASSEGESSGTLKSDGKANQKRFRSG

SEQ ID NO: 13099 - protein, 226 aa, Arabidopsis thaliana
MSDVPSCSSGNDTNNNDSSNFECNICLDLAQDPIVTLCGHLFCWPCLYKWLHLHSQSKDCPVCKAVIEEDRLVPLYGRGKSSADPRSKSIPGLEVPNRPSGQRPETAQPPDPNHGFAHHHGFGGFMGGFAAPMASARFGNVTLSAAFGGLIPSLFNLHFHGFPDAAMYGAAASGGFPHGFSNPFHGGHSHMHSYQRHTGRQGQQDHHLRILLLIVFVVVVFSLFLS

SEQ ID NO: 13100 - protein, 163 aa, Arabidopsis thaliana
MAETKKMIILKSSDGESFEIEEAVAVKSQTIKHMIEDDCADNGIPLPNVTGAILAKVIEYCKKHVEAAAEAGGDKDFYGSAENDELKNWDSEFVKVDQPTLFDLILAANYLNIGGLLDLTCKAVADQMRGKTPEQMRAHFNIKNDYTPEEEAEVRNENKWAFE

SEQ ID NO: 13101 - protein, 348 aa, Arabidopsis thaliana
MEKAENEKKPSAVSDVGAWAMNVTSSVGIIMANKQLMSSSGFGFSFATTLTGFHFALTALVGMVSNATGLSASKHVPLWELLWFSLVANISIAAMNFSLMLNSVGFYQISKLSMIPVVCVMEWVLHSKHYSREVKASVMVVVVGVGICTVTDVKVNAKGFICACTAVFSTSLQQISIGSLQKKYSIGSFELLSKTAPIQAISLLIFGPFVDYFLSGRFISTYKMTYSAMLCILLSCALAVFCNISQYLCIGRFSATSFQVLGHMKTVCVLTLGWLIFDSEMTFKNIAGMVLAVVGMVIYSWAVELEKQRKSKVIPHGKHSMTEDEIKLLKEGIEHMDLKDMELGNNKA

SEQ ID NO: 13102 - protein, 196 aa, Arabidopsis thaliana
MENEQSTHVHFASLSSSSERYNETFEEIKKAMKKSVQLKAELSAKERNLVSVGYKNVISARRASLEILSSIVQKEESKGNEENVKKLKNYRNKVEDELAKICNDILSVINKQLIPSSTTVDSSVLFYNMLADFSSNAESKEATDQSLDAYKRLVWYQQFQLYMTLNWTSVFLNSPESAYQLAKQAFDDAINEFDSK

SEQ ID NO: 13103 - protein, 254 aa, Arabidopsis thaliana
MENEREKQVYLAKLSEQTERYDEMVEAMKKVAQLDVELTVEERNLVSVGYKNVIGARRASWRILSSIEQKEESKGNDENVKRLKNYRKRVEDELAKVCNDILSVIDKHLIPSSNAVESTVFFYKMKGDYYRYLAEFSSGAERKEAADQSLEAYKAAVAAAENGLAPTHPVRLGLALNFSVFYYEILNSPESACQLAKQAFDDAIAELDSLNEESYKDSTLIMQLLRDNLTLWTSDLNEEGDERTKGADEPQDEN

SEQ ID NO: 13104 - protein, 185 aa, Arabidopsis thaliana
MNAPPENELCSICHGHFNAPCQSNCSHWFCGNCIMLVWRHGSTLRPCKCPLCRRPISLLVPSEETVRSRNDATVSEVLHDVETYNRVFGGQSSGLIQRMQDLPFLLRRLLREMMDPQRTLPLVIRARVYIALILSAIYIISPIDIIPEGVLGVIGLLDDLLIALICFLHVAALYRSVLYSRHGGS

SEQ ID NO: 13105 - protein, 187 aa, Arabidopsis thaliana
MTRVYVGNLDPRVTERELEDEFKAFGVLRNVWVARRPPGYAFLEFDDERDALDAISALDRKNGWRVELSHKDKGGRGGGGGRRGGIEDSKCYECGELGHFARECRRGRGSVRRRSPSPRRRRSPDYGYARRSISPRGRRSPPRRRSVTPPRRGRSYSRSPPYRGSRRDSPRRRDSPYGRRSPYANGV

SEQ ID NO: 13106 - protein, 486 aa, Arabidopsis thaliana
MDYERIGKTQVTSSGGGFSPGKLRSMLLLGVDRKKNEEEESTPTMRSGSNQIDDPRVYVASGLDDCKDVDVVSEITDCSTSGIARSISLGLQEYSDYDNVNEIKSVSASSVFEFQKTEKEKVNQRMPIRSFSKPAPSKWDDAQKWIASPTANRPKTGQVQVPGSKKGPSFGRQSSMKIVEVAEHRVVEEPDTKRIDVSQVKKDMGNKFGSWEVDSYTTVDSYVKPVLMVENSIVESATEVNLSRHDSSVATAFAQPPSTARSVSMRDMGTEMTPIASQEPSRNGTPIRATTPIRSPISSEPSSPGRQASASPMSNKELSEKELQMKTRREIMVLGTQLGKFNIAAWASKEDEDKDASTSLKTKASLQTSKSVSEARATAWEEAEKAKHMARFRREEMKIQAWENHQKAKSEAEMKKTEVKVERIKGRAQDRLMKKLATIERKAEEKRAAAEAKKDHQAAKTEKQAEQIRRTGKVPSLLFSCFSFCS

SEQ ID NO: 13107 - protein, 319 aa, Arabidopsis thaliana
MAAAVAAPRLISLKAVAKLGFREISQIRQLAPLHSAIPHFGMLRCRSRQPFSTSVVKAQATATEQSPGEVVQKVESPVVVITGASRGIGKAIALALGKAGCKVLVNYARSAKEAEEVAKQIEEYGGQAITFGGDVSKATDVDAMMKTALDKWGTIDVVVNNAGITRDTLLIRMKQSQWDEVIALNLTGVFLCTQAAVKIMMKKKRGRIINISSVVGLIGNIGQANYAAAKGGVISFSKTAAREGASRNINVNVVCPGFIASDMTAELGEDMEKKILGTIPLGRYGKAEEVAGLVEFLALSPAASYITGQAFTIDGGIAI

SEQ ID NO: 13108 - protein, 200 aa, Arabidopsis thaliana
MSSKKIVLTSSDGESFKVEEVVARKLQIVGHIIEDDCATNKIPIPNVTGEILAKVIEYCKKHVEDDDDVVETHESSTKGDKTVEEAKKKPDDVAVPESTEGDDEAEDKKEKLNEWDAKFMKDFDIKTIFDIILAANYLNVQGLFDLCSKTIADYIKDMTPEEVRELFNIENDFTPEEEEAIRNENAWTFEQDGKQQVPKP

SEQ ID NO: 13109 - protein, 149 aa, Arabidopsis thaliana
MSSNKIVLSSSDGESFEVEEAVARKLKIVEHMIEDDCVVTEVPLQNVTGKILSIVVEYCKKHVVDEESDEFKTWDEEFMKKFDQPTVFQLLLAANYLNIKGLLDLSAQTVADRIKDKTPEEIREIFNIENDFTPEEEAAVRKENAWAFE

SEQ ID NO: 13110 - protein, 170 aa, Arabidopsis thaliana
MSSNKIVLTSSDDESFEVEEAVARKLKVIAHMIDDDCADKAIPLENVTGNILALVIEYCKKHVLDDVDDSDDSTEATSENVNEEAKNELRTWDAEFMKEFDMETVMKLILAVNYLNVQDLLGLTCQTVADHMKDMSPEEVRELFNIENDYTPEEEDAIRKENAWAFEDLK

SEQ ID NO: 13111 - protein, 255 aa, Arabidopsis thaliana
MGRGRVELKRIENKINRQVTFSKRRTGLLKKAQEISVLCDAEVSLIVFSHKGKLFEYSSESCMEKVLERYERYSYAERQLIAPDSHVNAQTNWSMEYSRLKAKIELLERNQRHYLGEELEPMSLKDLQNLEQQLETALKHIRSRKNQLMNESLNHLQRKEKEIQEENSMLTKQIKERENILRTKQTQCEQLNRSVDDVPQPQPFQHPHLYMIAHQTSPFLNMGGLYQEEDQTAMRRNNLDLTLEPIYNYLGCYAA

SEQ ID NO: 13112 - protein, 268 aa, Arabidopsis thaliana
MSSSGSDKERETFVYMAKLSEQAERYDEMVETMKKVARVNSELTVEERNLLSVGYKNVIGARRASWRIMSSIEQKEESKGNESNVKQIKGYRQKVEDELANICQDILTIIDQHLIPHATSGEATVFYYKMKGDYYRYLAEFKTEQERKEAAEQSLKGYEAATQAASTELPSTHPIRLGLALNFSVFYYEIMNSPERACHLAKQAFDEAIAELDTLSEESYKDSTLIMQLLRDNLTLWTSDLPEDGGEDNIKTEESKQEQAKPADATEN

SEQ ID NO: 13113 - protein, 214 aa, Arabidopsis thaliana
MFLRSLNLCTILLFLAISSQVSQSLHFELQSGRTKCISEDIKSNSMTVGKYTVVNPNEAHPSPQSHKISIRVTSSYGNTYHHAEDVESGQFAFTAVESGDYMACYTAVDHKPEVTLSIDFDWRTGVQSKSWSSVAKKSQVEVMEFDVKRLIETVNSIHEEMFYLREREEEMQNLNRATNSKMAWLSFLSLFVCLGVAGMQFVHLKTFFEKKKVI

SEQ ID NO: 13114 - protein, 231 aa, Arabidopsis thaliana
MGCVSSCFRVEDIDEYMNPNSSVYRNCPCIRCLAHNFLNLYISVFRRGETRSLPSSVQATASITSSSSHDNFLSEAFRSTPRPLPYDADPRYFRSLVSRREKGSSHSHEEVEPLRSDSDADSESFGVGGCKWANNKSTLSDKDSKEEYSSKSSLRILRSRSKSIMADSENMYILSEDEDVCPTCLEEYTSENPKIVTKCSHHFHLSCIYEWMERSENCPVCGKVMEFNETP

SEQ ID NO: 13115 - protein, 265 aa, Arabidopsis thaliana
MSSSREENVYLAKLAEQAERYEEMVEFMEKVAKTVDTDELTVEERNLLSVAYKNVIGARRASWRIISSIEQKEESRGNDDHVSIIKDYRGKIETELSKICDGILNLLDSHLVPTASLAESKVFYLKMKGDYHRYLAEFKTGAERKEAAESTLVAYKSAQDIALADLAPTHPIRLGLALNFSVFYYEILNSPDRACSLAKQAFDEAISELDTLGEESYKDSTLIMQLLRDNLTLWNSDINDEAGGDEIKEASKHEPEEGKPAETGQ

SEQ ID NO: 13116 - protein, 417 aa, Arabidopsis thaliana
MEWPWSAIAASSSSSSSCFFASPNSCLSITRRTNLSCVNTSVKSLRHSRFDSKHNLVKRRINGDSVVRRSTTSNNSTEETESSSSSSSVDCVGMGSDVECVNNGEDEENRSSGILSGGEGTFLEWTVLISPFFFWGTAMVAMKEVLPITGPFFVAAFRLIPAGLLLVAFAVYKGRPLPEGINAWFSIALFALVDATCFQGFLAQGLQRTSAGLGSVIIDSQPLTVAVLASFLFGESIGIVRAGGLLLGVAGLLLLEVPSVTSDGNNFSLWGSGEWWMLLAAQSMAIGTVMVRWVSKYSDPIMATGWHMVIGGLPLLAISVINHDPVFNGSLQDLSTNDVIALLYTSIFGSAVSYGVYFYSATKGSLTKLSSLTFLTPMFASIFGYLYLNETFSSLQLVGAAVTLVAIYLVNFPEGND

SEQ ID NO: 13117 - protein, 109 aa, Arabidopsis thaliana
MEGDTISRMMGSGVQMDGKILQTFEKSFVQVQNILDHNRLLINEINQNHESKIPDNLGRNVGLIRELNNNVRRVAHLYVDLSNNFSKSMEASSEGDSSEGRGNRRIRPA

SEQ ID NO: 13118 - protein, 1036 aa, Arabidopsis thaliana; identical to SEQ ID NO: 1205

SEQ ID NO: 13119 - protein, 397 aa, Arabidopsis thaliana
MDFNAGVPMSSLSPLMNQDAMWQMNLSSDETMETGSYPERPGEPDCSYYIRTGLCRFGSTCRFNHPRDRELVIATARMRGEYPERIGQPECEYYLKTGTCKFGVTCKFHHPRNKAGIAGRVSLNMLGYPLRSNEVDCAYFLRTGHCKFGGTCKFNHPQPQPTNMMVPTSGQQSYPWSRASFIASPRWQDPSSYASLIMPQGVVPVQGWNPYSGQLGSVSPSGTGNDQNYRNLQQNETIESGSQSQGSFSGYNPGSSVPLGGYYALPRENVFPERPGQPECQFYMKTGDCKFGTVCKFHHPRDRQAPPPDCLLSSIGLPLRPGEPLCVFYTRYGICKFGPSCKFDHPMRVFTYDNTASETDEVVETSTGKSRRLSVSETRQAATTSSGKDTTIDNTQQ

SEQ ID NO: 13120 - protein, 379 aa, Arabidopsis thaliana
MVLPWRSRGGVAKRRNQLISGDISVVETKIPVQLRSPSRIERIQSPRVLLTPRDAVEISRRLQNAAAREEYAECLEIVSKIKNLGRGGDTNKKCLVQNGSVLALSSCFERFAAARDGHMRLLEEILFVLSSWLPLNRSEGFNKMGSTASLNCLVRFLNGKDAKTRQNAAFCIREVIAVDKRYVYALTDVEGACEGLVKIIRDSVSTSSTKASLMVIYRAISSNDKITEKFVKLGLVELITEMMVNNAEKSVCERSLVVLNATCDNEQGKEDVLRNALIVPLLVKKILRVSDLATQCSVSILWKLWKNKKDGECDDRLLVEALQVGAFEKLLVLLQVGCEDKTKEKASELLRNLNRCRNEIEKTNCVDSSMHLKNVKKSF

SEQ ID NO: 13121 - protein, 315 aa, Arabidopsis thaliana
MANPWWTGQVNLSGLETTPPGSSQLKKPDLHISMNMAMDSGHNNHHHHQEVDNNNNDDDRDNLSGDDHEPREGAVEAPTRRPRGRPAGSKNKPKPPIFVTRDSPNALKSHVMEIASGTDVIETLATFARRRQRGICILSGNGTVANVTLRQPSTAAVAAAPGGAAVLALQGRFEILSLTGSFLPGPAPPGSTGLTIYLAGGQGQVVGGSVVGPLMAAGPVMLIAATFSNATYERLPLEEEEAAERGGGGGSGGVVPGQLGGGGSPLSSGAGGGDGNQGLPVYNMPGNLVSNGGSGGGGQMSGQEAYGWAQARSGF

SEQ ID NO: 13122 - protein, 848 aa, Arabidopsis thaliana
MSNWKTLLLRIGEKGPEYGTSSDYKDHIETCFGVIRREIERSGDQVLPFLLQCAEQLPHKIPLYGTLIGLLNLENEDFVQKLVESVHANFQVALDSGNCNSIRILLRFMTSLLCSKVIQPASLIVVFETLLSSAATTVDEEKGNPSWQPQADFYVICILSSLPWGGSELAEQVPDEIERVLVGIQAYLSIRKNSSTSGLNFFHNGEFESSLAEKDFVEDLLDRIQSLASNGWKLESVPRPHLSFEAQLVAGKFHELRPIKCMEQPSPPSDHSRAYSGKQKHDALTRYPQRIRRLNIFPANKMEDVQPIDRFVVEEYLLDVLFYLNGCRKECASYMANLPVTFRYEYLMAETLFSQILLLPQPPFKTLYYTLVIMDLCKALPGAFPAVVAGAVRALFEKISDLDMESRTRLILWFSHHLSNFQFIWPWEEWAFVLDLPKWAPKRVFVQEILQREVRLSYWDKIKQSIENATALEELLPPKAGPNFMYSLEEGKEKTEEQQLSAELSRKVKEKQTARDMIVWIEETIYPVHGFEVTLTIVVQTLLDIGSKSFTHLVTVLERYGQVFSKLCPDNDKQVMLLSQVSTYWKNNVQMTAVAIDRMMGYRLVSNQAIVRWVFSPENVDQFHVSDQPWEILGNALNKTYNRISDLRKDISNITKNVLVAEKASANARVELEAAESKLSLVEGEPVLGENPAKMKRLKSTVEKTGEAELSLRESLEAKEALLNRALSETEVLLLLLFQSFLGVLKERLPDPTKVRSVQDLKSIGAEDDKPSAMDVDSENGNPKKSCEVGEREQWCLSTLGYLTAFTRQYASEIWPHMEKLESEVFSGEDVHPLFLQAISSALQFPLH

SEQ ID NO: 13123 - protein, 367 aa, Arabidopsis thaliana
MGKKKKRATEKVWCYYCDREFDDEKILVQHQKAKHFKCHVCHKKLSTASGMVIHVLQVHKENVTKVPNAKDGRDSTDIEIYGMQGIPPHVLTAHYGEEEDEPPAKVAKVEIPSAPLGGVVPRPYGMVYPPQQVPGAVPARPMYYPGPPMRHPAPVWQMPPPRPQQWYPQNPALSVPPAAHLGYRPQPLFPVQNMGMTPTPTSAPAIQPSPVTGVTPPGIPTSSPAMPVPQPLFPVVNNSIPSQAPPFSAPLPVGGAQQPSHADALGSADAYPPNNSIPGGTNAHSYASGPNTSGPSIGPPPVIANKAPSNQPNEVYLVWDDEAMSMEERRMSLPKYKVHDETSQMNSINAAIDRRISESRLAGRMAF

SEQ ID NO: 13124 - protein, 196 aa, Arabidopsis thaliana
MAGMLPGVECARRRRFHGGAPPIESSNTASVAAAAGHVWTRRPSFSLYTTNHESHQAHVSFSERSVRNKSYGEDNDEKLDGAAKEAKQRLNKRLRIPPRTRQNGKDKGNKLEQGKGKPLGDLPTEVVGLKKSRGRLMEWFKRRVREQQDCAICLDRFKKGETLVHLPCAHKFHSICLLPWLDTNVYCPYCRTDIWN

SEQ ID NO: 13125 - protein, 278 aa, Arabidopsis thaliana
MVTGVASAMAERLKEDGNNCFKKERFGAAIDAYTEAIALSPNVPAYWTNRALCHMKRKDWTKVEEDCRKAIQLVHNSVKAHYMLGLALLQKKEFTNGVKELQRALDLGRCSNPTGYMVEEIWEELSKAKYMEWELVSAMRSWELNSLKETCEAALNQQRALDMSRTEESSDEAYTAHTERLKALERVFKKAAEEDKPTEVPDYLCCNITLEIFRDPVISPSGVTYERAAILEHLKKVGKFDPITREKIDPANLVPNLAIKEAVAAYLEKHVWAYKMGC

SEQ ID NO: 13126 - protein, 589 aa, Arabidopsis thaliana
MEAKIVKVLDSSRCEDGFGKKRKRAASYAAYVTGVSCAKLQNVPPPNGQCQIPDKRRRLEGENKLSAYENRSGKALVRYYTYFKKTGIAKRVMMYENGEWNDLPEHVICAIQNELEEKSAAIEFKLCGHSFILDFLHMQRLDMETGAKTPLAWIDNAGKCFFPEIYESDERTNYCHHKCVEDPKQNAPHDIKLRLEIDVNGGETPRLNLEECSDESGDNMMDDVPLAQRSSNEHYDEATEDSCSRKLEAAVSKWDETDAIVVSGAKLTGSEVLDKDAVKKMFAVGTASLGHVPVLDVGRFSSEIAEARLALFQKQVEITKKHRGDANVRYAWLPAKREVLSAVMMQGLGVGGAFIRKSIYGVGIHLTAADCPYFSARYCDVDENGVRYMVLCRVIMGNMELLRGDKAQFFSGGEEYDNGVDDIESPKNYIVWNINMNTHIFPEFVVRFKLSNLPNAEGNLIAKRDNSGVTLEGPKDLPPQLESNQGARGSGSANSVGSSTTRPKSPWMPFPTLFAAISHKVAENDMLLINADYQQLRDKKMTRAEFVRKLRVIVGDDLLRSTITTLQNQPKSKEIPGSIRDHEEGAGGL

SEQ ID NO: 13127 - protein, 841 aa, Arabidopsis thaliana
MPPRCPFLRHLFFLLLLLSPWIMSPCGGAADDVTYPIVPSSPGRRSILQIRREPPTEPNTKLVVDRDGKVFLKQQPKETPYWSFSTGSPMHSLYQAPANNNTENATEITRPHIIVEYLNNSKAATTVDGYHNWTVQEFFRQKPLVTDDGVTLGSETTSAYLVDGRSGRLIHVYKSTGDTKITNALVKPASTEDFVNEPLLIRRTDSKLEHFSKTTGKLVWNLTVSHFRAALLCDPVFNSGYDLGPKLQTGIYMPLLCGSQIDVRGPEIVIRVLHDQPMNVKMLPSPSLNHFESENSIMPFGKARESRKLQEQHKQKYTYLFGQWSPVKLLAPLVLLGVVVSVFIKKFSSRGSDVSLKAGPSKKKKNRKSAKDTNRQSVPRGQDQFELIEGGQMLLGFNNFQSGATDGRKIGKLFLSSKEIAKGSNGTVVFEGIYEGRPVAVKRLVRSHHEVAFKEIQNLIASDQHTNIIRWYGVEYDQDFVYLSLERCTCSLDDLIKSYLEFSMTKVLENNDSTEGVAAYKIQLDSLEGVIKGNNFWKVGGHPSPLMLKLMRDIVCGIVHLHELGIVHRDLKPQNVLISKDMTLSAKLSDMGISKRMSRDMSSLGHLATGSGSSGWQAPEQLLQGRQTRAVDMFSLGCVIFYTITGCKHPFGDDLERDVNIVKNKVDLFLVEHVPEASDLISRLLNPDPDLRPSATEVLLHPMFWNSEMRLSFLRDASDRVELENREADSEILKAMESTAPVAIGGKWDEKLEPVFITNIGRYRRYKYDSIRDLLRVIRNKLNHHRELPPEIQELVGTVPEGFDEYFAVRFPKLLIEVYRVISLHCREEEVFRKYFKCDII

SEQ ID NO: 13128 - protein, 154 aa, Arabidopsis thaliana
MPVPLAPYPTPPAPALAPSYNTPPANGSTSGQSQLVCSGCRNLLMYPVGATSVCCAVCNAVTAVPPPGTEMAQLVCGGCHTLLMYIRGATSVQCSCCHTVNLALEANQVAHVNCGNCMMLLMYQYGARSVKCAVCNFVTSVGGSTSTTDSKFNN

SEQ ID NO: 13129 - protein, 323 aa, Arabidopsis thaliana
MNGDELPFESGFEVYAKGTHKSEFDSNLLDPRSDPIWDAIREEAKLEAEKEPILSSFLYAGILAHDCLEQALGFVLANRLQNPTLLATQLLDIFYGVMMHDKGIQSSIRHDLQAFKDRDPACLSYSSAILHLKGYHALQAYRVAHKLWNEGRKLLALALQSRISEVFGIDIHPAARIGEGILLDHGTGVVIGETAVIGNGVSILHGVTLGGTGKETGDRHPKIGEGALLGACVTILGNISIGAGAMVAAGSLVLKDVPSHSVVAGNPAKLIRVMEEQDPSLAMKHDATKEFFRHVADGYKGAQSNGPSLSAGDTEKGHTNSTS

SEQ ID NO: 13130 - protein, 394 aa, Arabidopsis thaliana
MAETQGKVITCKAAVVWGPKVPLVIQEICVDPPQKMEVRVKILYSSICHTDLGCWNGTNEAERAFPRILGHEAVGIVESVGEGVKDVKEGDYVIPTFNGECGECKVCKREESNLCERYHVDPMKRVMVNDGGTRFSTTINKDGGSSQSQPIYHFLNTSTFTEYTVLDSACVVKIDPNSPLKQMSLLSCGVSTGVGAAWNIANVKEGKSTAVFGLGSVGLAVAEGARARGASRIIGVDANASKFEKGKLMGVTDFINPKDLTKPVHQMIREITGGGVDYSFECTGNVDVLREAFLSTHVGWGSTVLVGIYPTPRTLPLHPMELFDGRRITGSVFGGFKPKSQLPNFAQQCMKGVVKLEPFITNELPFEKINDAFQLLRDGKSLRCILQISKLLKR

SEQ ID NO: 13131 - protein, 527 aa, Arabidopsis thaliana
MENQEEDEVVLAKVTSEVEDNFEDEGLVSNSTLEKVAAAKKYIENHYNRRMRHIQQRKERRWVLEQKIASLDVSEKEQLELLEDLQRKETEYTRLMRNRLCVDDFDLLSIIGRGAFGEVRLCREKKTGNIYAMKKLKKSEMLSRGQVEHVRAERNLLAEVASDCIVKLYYSFQDPEYLYLIMEYLSGGDVMTLLMREETLTETVARFYIAQSVLAIESIHKHNYVHRDIKPDNLLLDKYGHMKLSDFGLCKPLDCRNISAMNVNEPLNDENINESIDGDENCSIGRRGRRWKSPLEQLQHWQINRRKLAYSTVGTPDYIAPEVLLKKGYGVECDWWSLGAIMYEMLVGYPPFYSDDPVTTCRKIVSWRTHLVFPEGARLTPEARDLICRLLCDSEHRLGSHGAGAEQIKAHTWFKDVEWEKLYEMDAAFKPVVNGELDTQNFMKFDEVECPKPARTGSGPSWKVSITPQNINFVGYTYRNFDAVRGSRHSLDIKGSVSPPRSSTDSTRSDSAIDYTKLSTGGDGSQQ

SEQ ID NO: 13132 - protein, 335 aa, Arabidopsis thaliana
MAPVSKADKKAAVDAAAWMFNVVTSVGIIIVNKALMATYGYSFATTLTGLHFATTTLMTLVLRCLGYIQPSHLPFTELLRFILFANFSIVGMNVSLMWNSVGFYQIAKLSMIPVSCLLEMVFDKIRYSRDTKLSIGLVLVGVGVCTVTDVSVNTKGFVAAFVAVWSTALQQYYVHYLQRKYSLNSFNLLGHTAPAQAATLLVVGPFLDYWLTEKRVDMYDYNLVSVLFITLSCTIAIGTNLSQFICIGRFTAVSFQVLGHMKTILVLIMGFFFFGREGLNLHVVVGMIIAVLGMIWYGNASSKPGGKERRNYSLPTTRQQKLGAASDSDDNEDKA

SEQ ID NO: 13133 - protein, 241 aa, Arabidopsis thaliana
MENERAKQVYLAKLNEQAERYDEMVEAMKKVAALDVELTIEERNLLSVGYKNVIGARRASWRILSSIEQKEESKGNEQNAKRIKDYRTKVEEELSKICYDILAVIDKHLVPFATSGESTVFYYKMKGDYFRYLAEFKSGADREEAADLSLKAYEAATSSASTELSTTHPIRLGLALNFSVFYYEILNSPERACHLAKRAFDEAIAELDSLNEDSYKDSTLIMQLLRDNLTLWTSDLEEGGK

SEQ ID NO: 13134 - protein, 248 aa, Arabidopsis thaliana
MDTRKRGRPEAGSFNSNGGGYKKSKQEMESYSTGLGSKSKPCTKFFSTSGCPFGENCHFLHYVPGGYNAVSQMTNMGPPIPQVSRNMQGSGNGGRFSGRGESGPGHVSNFGDSATARFSVDASLAGAIIGKGGVSSKQICRQTGVKLSIQDHERDPNLKNIVLEGTLEQISEASAMVKDLIGRLNSAAKKPPGGGLGGGGGMGSEGKPHPGSNFKTKICERFSKGNCTFGDRCHFAHGEAELRKSGIV

SEQ ID NO: 13135 - protein, 267 aa, Arabidopsis thaliana
MAAPPASSSAREEFVYLAKLAEQAERYEEMVEFMEKVAEAVDKDELTVEERNLLSVAYKNVIGARRASWRIISSIEQKEESRGNDDHVTTIRDYRSKIESELSKICDGILKLLDTRLVPASANGDSKVFYLKMKGDYHRYLAEFKTGQERKDAAEHTLTAYKAAQDIANAELAPTHPIRLGLALNFSVFYYEILNSPDRACNLAKQAFDEAIAELDTLGEESYKDSTLIMQLLRDNLTLWTSDMQDESPEEIKEAAAPKPAEEQKEI

SEQ ID NO: 13136 - protein, 172 aa, Arabidopsis thaliana
MRILCDACESAAAIVFCAADEAALCCSCDEKVHKCNKLASRHLRVGLADPSNAPSCDICENAPAFFYCEIDGSSLCLQCDMVVHVGGKRTHRRFLLLRQRIEFPGDKPNHADQLGLRCQKASSGRGQESNGNGDHDHNMIDLNSNPQRVHEPGSHNQEEGIDVNNANNHEHE

SEQ ID NO: 13137 - protein, 311 aa, Arabidopsis thaliana
MMKRLSSSDSVGGLISLCPTTSTDEQSPRRYGGREFQSMLEGYEEEEEAIVEERGHVGLSEKKRRLSINQVKALEKNFELENKLEPERKVKLAQELGLQPRQVAVWFQNRRARWKTKQLEKDYGVLKTQYDSLRHNFDSLRRDNESLLQEISKLKTKLNGGGGEEEEEENNAAVTTESDISVKEEEVSLPEKITEAPSSPPQFLEHSDGLNYRSFTDLRDLLPLKAAASSFAAAAGSSDSSDSSALLNEESSSNVTVAAPVTVPGGNFFQFVKMEQTEDHEDFLSGEEACEFFSDEQPPSLHWYSTVDHWN

SEQ ID NO: 13138 - protein, 381 aa, Arabidopsis thaliana
MELKNVKDAFDRVTKKQKLCYSKTHEVVDKMSQEIDKALKTIQEDNHESVVADLKKTFEEIAPINLLEASQKEINGVLTKYPKALDKTLNPDISTAYRNVKFDTHTVHQILAQFFYRQGMYDVGDCFISETGEVKPESSVTKAFMEMNMILEAMKERDLGPALKWVASNSDKLKEAKSDLELKLHSLHFLEIAKDKTSEEAINYARKHFATYSADSCCFPEIQKLMCSLLWIRNLNKSPYSEFLSPVLWTNAAKELTRQYCILLGESPESPLSVTVAAGSQVLPTFLKYLNVLPEKRKEWQTMEQLLVPVELSEEYRFYSVFVCPVSKEHSSEDNPPMRLACGHVLCKQSINRMSRNGSRSFKCPYCPTDIDASQCKQLYF

SEQ ID NO: 13139 - protein, 888 aa, Arabidopsis thaliana
MPLKEDDCCLFAEEYDGPPLSYNIPCAVPINVEKIPVAAVVSPVCISDNMSFPVIQPILSVESKKFLIDSVSPTSVIANCGSNQLELVSDSITVSPTSVIEHTEEEEEEEGGDGEDCELSSSGELLLRSCSVKESLDLNESSSNPLVPDWESNESVLSMDYPSSRVTGDCVSETNGDGKKQPVVTFLGIASDDGFEEEESCSNLRRVRVVPVKKQPQTKGKKGSCYRCFKGSRFTEKEVCLVCDAKYCNSCVLRAMGSMPEGRKCVTCIGFPIDESKRGSLGKCSRMLKRLLNDLEVKQIMKTERFCEANQLPAEYVYVNGQPLYPEELVTLQTCSNPPKKLKPGDYWYDKVSGLWGKEGEKPYQIISPHLNVGGPISPEASNGNTQVFINGREITKVELRMLQLAGVQCAGNPHFWVNEDGSYQEEGQKNTKGYIWGKAGTKLLCAVLSLPVPSKSTANASGEQLYSANSRSILDHLEHRTLQKILLVGNSGSGTSTIFKQAKILYKDVPFLEDERENIKVIIQTNVYGYLGMLLEGRERFEEEALALRNTKQCVLENIPADEGDAKSNDKTVTMYSIGPRLKAFSDWLLKTMAAGNLGVIFPAASREYAPLVEELWRDAAIQATYKRRSELGLLPSVASYFLERAIDVLTPDYEPSDLDILYAEGVTSSSGLACLDFSFPQTASEENLDPSDHHDSLLRYQLIRVPSRGLGENCKWIDMFEDVGMVVFVVSMSDYDQVSEDGTNKMLLTKKLFESIITHPIFENMDFLLILNKYDLLEEKVERVPLARCEWFQDFNPVVSRHRGSNNGNPTLGQLAFHFMAVKFKRFYSSLTGKKLFVSSSKSLDPNSVDSSLKLAMEILKWSEERTNICMSEYSMYSTEPSSFSN

SEQ ID NO: 13140 - protein, 379 aa, Arabidopsis thaliana
MCGGAIISDFIPPPRSLRVTNEFIWPDLKNKVKASKKRSNKRSDFFDLDDDFEADFQGFKDDSAFDCEDDDDVFVNVKPFVFTATTKPVASAFVSTGIYLVGSAYAKKTVESAEQAEKSSKRKRKNQYRGIRQRPWGKWAAEIRDPRKGSREWLGTFDTAEEAARAYDAAARRIRGTKAKVNFPEEKNPSVVSQKRPSAKTNNLQKSVAKPNKSVTLVQQPTHLSQQYCNNSFDNSFGDMSFMEEKPQMYNNQFGLTNSFDAGGNNGYQYFSSDQGSNSFDCSEFGWSDHGPKTPEISSMLVNNNEASFVEETNAAKKLKPNSDESDDLMAYLDNALWDTPLEVEAMLGADAGAVTQEEENPVELWSLDEINFMLEGDF

SEQ ID NO: 13141 - protein, 541 aa, Arabidopsis thaliana
MKQKHLLLLGFLLAYCFSSVFVINAEDPYLFFTWTVTYGTRSPLGVPQQVILINGQFPGPPIEGVTNNNIVVNVINKLDEPFLITWNGIKQRKMSWQDGVLGTNCPIQPKSSWTYHFQLKDQIGTYAYFASTSMHRASGAFGALNVNQRSVIFVPYPKPDADFTLLVSDWYKMGHKELQRRLDSSRALPPPDGLLINGASKGLVFTGQHGKIYRFRISNVGISTSINFRIQGHMMTLVEVEGSHTLQEVYESLDIHVGQSVTVLVTLKAPVKDYFIVASTRFTKPILTTTGILSYQGSKIRPSHPLPIGPTYHIHWSMKQARTIRLNLTANAARPNPQGSFHYGTIPINRTFVLANGRAMINGKLRYTVNRVSYVNPATPLKLADWFNIPGVFNFKTIMNIPTPGPSILGTSVFDVALHEYVEFVFQNNEGSIQSWHLDGTSAYVVGYGSGTWNMAKRRGYNLVDAVSRHTFQVYPMSWTSILVSLDNKGMWNLRSQIWSRRYLGQELYVRVWNNEKSLYTESEPPVNVLFCGKAKHPRLI

SEQ ID NO: 13142 - protein, 340 aa, Arabidopsis thaliana
MADRSKGFMRAEFVTYAYILLYIALSSGQIFFNKWVLSSKEINFPYPLGLTLLHMIFSSVLCFLLTKVLKIVKVEEGMTLEIYVTSVIPIGAMFAMTLWLGNTAYLYISVAFAQMLKAIMPVAVFILGVAAGLEMMSCRMLLIMSIISFGVLVASYGELNINWIGVVYQMGGVVGEALRLIFMELLVKRKGIKLNPISLMYYVSPCSAICLFVPWIFLEKSKIDGNGPWNFHFVVLTLNSLCTFALNLSVFLVISHTSALTIRVAGVVKDWVVVLVSALLFADTKLTIINLFGYAIAIAGVAAYNNHKLKKEASKVVTTETPGDAESIPLVSQGNTNTER

SEQ ID NO: 13143 - protein, 486 aa, Arabidopsis thaliana
MRQRNMMTGSDMEQNSQSFVPHPEPRIGTNYLYPDIPPVNTVPHLEAHSLQEPYDNNSMFYGPPQYHHQHASNLGSGMSTAPNFYVPYVNYEAPPSFLLSHGSNDAVVGVTSTEHERNAHFMDHGFKRKSSEVIPGNSQYPVAPCSFPQLNTSETAPFSFPHFGTYPQPLDQRSVRNRAGAATMDPLLSHGHNNFSQGNYAAHPFPPLGSIWYDQHCNGNRSDGSSSLWSQAPAVPYMHGNIATGSIESGNVCFPRYHETSSSRNPTPSVYQRNHYISHHPVPPPPIVYPHMPSASYAETLHPASYSHMGQVQSTGFRINQYPGEDFVPAAILRHRELPHFRAMPANENAFWEVGDFYNAVNYVDHHQDMRLDIEDMSYEELLALSDQIGTVKTGLSSEDVKELLKRRTSTRINLEEGPSTDLETDSCTICQENYKNEDKIATLDCMHKYHAECLKKWLVIKNVCPICKSEALVIEKKKKLRLSSR

SEQ ID NO: 13144 - protein, 163 aa, Arabidopsis thaliana
MAETKKMIILKSSDGESFEVEEAVAVESQTIKHMIEDDCVDNGIPLPNVTGAILAKVIEYCKKHVEAAAEAGGDKDFYGSTENHELKTWDNDFVKVDHPTLFDLLRAANYLNISGLLDLTCKAVADQMRGKTPAQMREHFNIKNDYTPEEEAEVRNENRWAFE

SEQ ID NO: 13145 - protein, 127 aa, Arabidopsis thaliana
MTNIGKCMQGYLDEQFMELEELQDDANPNFVEEVSALYFKDSARLINNIDQALERGSFDFNRLDSYMHQFKGSSTSIGASKVKAECTTFREYCRAGNAEGCLRTFQQLKKEHSTLRKKLEHYFQASQ

SEQ ID NO: 13146 - protein, 375 aa, Arabidopsis thaliana
MAKMINKTLVLTYIYLLIYIILSSGVILYNKWVLSPKYFNFPLPITLTMIHMGFAGFVAFLLIRVFKVVAPVKMTFEIYATCVVPISAFFASSLWFGNTAYLHISVAFIQMLKALMPVATFIMAVVCGTDKPRCDVFSNMLLVSVGVVISSYGEIHFNIVGTVYQVTGIFAEALRLVLTQVLLQKKGLTLNPITSLYYIAPCSFVFLALPWYVLEKPTMEVSQIQFNFWIFFSNALCALALNFSIFLVIGRTGAVTIRVAGVLKDWILIALSTVIFPESTITGLNITGYAIALCGVVMYNYIKVRDVKASQPTADSLPDRINKEYKMEKKSSDKFNPNDSVEIPRVGGEVNDEEAPLITSRLSHIGRTQLGNHAA

SEQ ID NO: 13147 - protein, 510 aa, Arabidopsis thaliana
MDPHKKVALETEFFTEYGEASRYQIQEVIGKGSYGVVASAIDTHSGEKVAIKKINDVFEHVSDATRILREIKLLRLLRHPDIVEIKHVMLPPSRREFRDIYVVFELMESDLHQVIKANDDLTPEHYQFFLYQLLRGLKFIHTANVFHRDLKPKNILANSDCKLKICDFGLARVSFNDAPSAIFWTDYVATRWYRAPELCGSFFSKYTPAIDIWSIGCIFAEMLTGKPLFPGKNVVHQLDIMTDLLGTPPPEAIARIRNEKARRYLGNMRRKPPVPFTHKFPHVDPLALRLLHRLLAFDPKDRPSAEEALADPYFYGLANVDREPSTQPIPKLEFEFERRKITKEDVRELIYREILEYHPQMLQEYLRGGEQTSFMYPSGVDRFKRQFAHLEENYGKGEKGSPLQRQHASLPRERVPAPKKENGSHNHDIENRSIASLVTTLESPPTSQHEGSDYRNGTSQTGYSARSLLKSASISASKCIGMKPRNKSEYGESNNDTVDALSQKVAALHT

SEQ ID NO: 13148 - protein, 449 aa, Arabidopsis thaliana
MLDLNLNADSPESTQYGGDSYLDRQTSDNSAGNRVEESGTSTSSVINADGDEDSCSTRAFTLSFDILKVGSSSGGDESPAASASVTKEFFPVSGDCGHLRDVEGSSSSRNWIDLSFDRIGDGETKLVTPVPTPAPVPAQVKKSRRGPRSRSSQYRGVTFYRRTGRWESHIWDCGKQVYLGGFDTAHAAARAYDRAAIKFRGVDADINFTLGDYEEDMKQVQNLSKEEFVHILRRQSTGFSRGSSKYRGVTLHKCGRWEARMGQFLGKKAYDKAAINTNGREAVTNFEMSSYQNEINSESNNSEIDLNLGISLSTGNAPKQNGRLFHFPSNTYETQRGVSLRIDNEYMGKPVNTPLPYGSSDHRLYWNGACPSYNNPAEGRATEKRSEAEGMMSNWGWQRPGQTSAVRPQPPGPQPPPLFSVAAASSGFSHFRPQPPNDNATRGYFYPHP

SEQ ID NO: 13149 - protein, 654 aa, Arabidopsis thaliana
MAKSEKHKLAQTLIDSINEIASISDSVTPMKKHCANLSRRLSLLLPMLEEIRDNQESSSEVVNALLSVKQSLLHAKDLLSFVSHVSKIYLVLERDQVMVKFQKVTSLLEQALSIIPYENLEISDELKEQVELVLVQLRRSLGKRGGDVYDDELYKDVLSLYSGRGSVMESDMVRRVAEKLQLMTITDLTQESLALLDMVSSSGGDDPGESFEKMSMVLKKIKDFVQTYNPNLDDAPLRLKSSLPKSRDDDRDMLIPPEEFRCPISLELMTDPVIVSSGQTYERECIKKWLEGGHLTCPKTQETLTSDIMTPNYVLRSLIAQWCESNGIEPPKRPNISQPSSKASSSSSAPDDEHNKIEELLLKLTSQQPEDRRSAAGEIRLLAKQNNHNRVAIAASGAIPLLVNLLTISNDSRTQEHAVTSILNLSICQENKGKIVYSSGAVPGIVHVLQKGSMEARENAAATLFSLSVIDENKVTIGAAGAIPPLVTLLSEGSQRGKKDAATALFNLCIFQGNKGKAVRAGLVPVLMRLLTEPESGMVDESLSILAILSSHPDGKSEVGAADAVPVLVDFIRSGSPRNKENSAAVLVHLCSWNQQHLIEAQKLGIMDLLIEMAENGTDRGKRKAAQLLNRFSRFNDQQKQHSGLGLEDQISLI

SEQ ID NO: 13150 - protein, 198 aa, Arabidopsis thaliana
MTGVNDDDDKNFKEEPEIQVLSDDDSDEEQVKDVGEEVSDEDDDDGSEGDDDDDEEEEEDDDDDDDVQVLQSLGGPPVQSAEDEDEEGDEDGNGDDDDDDGDDDDDDDDDEDEDVEDEGDLGTEYLVRPVGRAEDEEDASDFEPEENGVEEDIDEGEDDENDNSGGAGKSEAPPKRKRAPEEDEEDSGDEDDDRPPKR

SEQ ID NO: 13151 - protein, 202 aa, Arabidopsis thaliana
MDKRWSLKGMTALVTGGASGIGYAIVEELAGFGARIHVCDISEAKLNQSLSEWEKKGFQVSGSVCDVASRPEREELMQTVSSQFDGKLNILVSNVGVIRSKPTTEYTEDDFAFHISSNVEAAYHFSQLSHPLLKASGYGSIIFVSSIAGVISFDAGSIYGLTKGALIQLAKNLACEWAKDGIRANAVAPNVINTPLSQSVIN

SEQ ID NO: 13152 - protein, 878 aa, Arabidopsis thaliana
MLFILTRCTRLLQFHKESWGQEEDAVQLRQSGVLHSADKRDPTGEVRDGKGSSTANALKVPSTKKAYSQEQRGLNWIEGFFVRPAPLSSPYNETSKDSESPANIDKMSSWKRLPSPASKGVQEAAVSKEQNDRKVEPPQVVKKLVAISDDMAVAKLPEVSSAKASQEHMSKNRHNISWGYWGHQSCISEESSIICRICEEEIPTTHVEDHSRICALADKYDQKGVGVDERLMAVAVTLEKITDNVIQKDSLAAVESPEGMKISNASLTEELDVLSPKLSDWSRRGSEDMLDCFPETDNSVFMDDMGCLPSMSCRTRFGPKSDQGMATSSAGSMTPRSPIPTPRPDPIELLLEGKGTFHDQDDFPQMSELADIARCAANAIPVDDQSIQLLLSCLEDLRVVIDRRKFDALIVETFGTRIEKLIQEKYLQLCELMDDEKGTIIDEDAPLEDDVVRSLRTSPVHLRDRISIDDFEVMKSISRGAFGHVILARKNTTGDLFAIKVLRKADMIRKNAVESILAERDILINARNPFVVRFFYSFTCSENLYLVMEYLNGGDFYSMLRKIGCLDEANARVYIAEVVLALEYLHSEGVVHRDLKPDNLLIAHDGHVKLTDFGLSKVGLINNTDDLSGPVSSATSLLVEEKPKLPTLDHKRSAVGTPDYLAPEILLGTGHGATADWWSVGIILYEFLVGIPPFNADHPQQIFDNILNRNIQWPPVPEDMSHEARDLIDRLLTEDPHQRLGARGAAEVKQHSFFKDIDWNTLAQQKAAFVPDSENAFDTSYFQSRYSWNYSGERCFPTNENEDSSEGDSLCGSSGRLSNHHDEGVDIPCGPAEFETSVSENYPFDNFSFKNLSQLAYINYNLMSKGHKDETQPSLQRR

SEQ ID NO: 13153 - protein, 238 aa, Arabidopsis thaliana
MKIQCDVCEKAPATLICCADEAALCAKCDVEVHAANKLASKHQRLFLDSLSTKFPPCDICLEKAAFIFCVEDRALLCRDCDEATHAPNTRSANHQRFLATGIRVALSSTSCNQEVEKNHFDPSNQQSLSKPPTQQPAAPSPLWATDEFFSYSDLDCSNKEKEQLDLGELDWLAEMGLFGDQPDQEALPVAEVPELSFSHLAHAHSYNRPMKSNVPNKKQRLEYRYDDEEEHFLVPDLG

SEQ ID NO: 13154 - protein, 203 aa, Arabidopsis thaliana
MARNLKSMMLCGFGLLCFLMIVDRAYAREFTVGGATGWTVPSGSQVYSQWAEQSRFQIGDSLLFVYQSNQDSVLQVTRDAYDSCNTDSPTAKFADGKTSVTLNHSGPYYFISGNKDNCKKNEKLVVIVMADRSGNKNTASSPPSPAPAPSGESAPSPPVSGTFEMTPAPTPTTSEDTPNSAASSLSFVAALLGAALASTLFLH

SEQ ID NO: 13155 - protein, 300 aa, Arabidopsis thaliana
MGAPKQKWTQEEESALKSGVIKHGPGKWRTILKDPEFSGVLYLRSNVDLKDKWRNMSVMANGWGSREKSRLAVKRTFSLPKQEENSLALTNSLQSDEENVDATSGLQVSSNPPPRRPNVRLDSLIMEAIATLKEPGGCNKTTIGAYIEDQYHAPPDFKRLLSTKLKYLTSCGKLVKVKRKYRIPNSTPLSSHRRKGLGVFGGKQRTSSLPSPKTDIDEVNFQTRSQIDTEIARMKSMNVHEAAAVAAQAVAEAEAAMAEAEEAAKEAEAAEAEAEAAQAFAEEASKTLKGRNICKMMIRA

SEQ ID NO: 13156 - protein, 628 aa, Arabidopsis thaliana
MALSVFAFPSYINRNPSLKYLKPSSMSSTKYSKVRATTFSEKGEYYSNRPPTPLLDTINHPMHMKNLSIKELKVLSDELRSDVIFNVSKTGGHLGSNLGVVELTVALHYIFNTPHDKILWDVGHQSYPHKILTGRRGKMKTIRQTNGLSGYTKRRESEHDSFGTGHSSTTLSAGLGMAVGRDLKGMNNSVVSVIGDGAMTAGQAYEAMNNAGYLHSNMIVILNDNKQVSLPTANLDGPTQPVGALSCALSRLQSNCGMIRETSSTLFEELGFHYVGPVDGHNIDDLVSILETLKSTKTIGPVLIHVVTEKGRGYPYAERADDKYHVLKFDPETGKQFKNISKTQSYTSCFVEALIAEAEADKDIVAIHAAMGGGTMLNLFESRFPTRCFDVGIAEQHAVTFAAGLACEGLKPFCTIYSSFMQRAYDQVVHDVDLQKLPVRFAIDRAGLMGADGPTHCGAFDVTFMACLPNMIVMAPSDEAELFNMVATAAAIDDRPSCFRYHRGNGIGVSLPPGNKGVPLQIGRGRILRDGERVALLGYGSAVQRCLEAASMLSERGLKITVADARFCKPLDVALIRSLAKSHEVLITVEEGSIGGFGSHVVQFLALDGLLDGKLKVYRTWITNGSTS

SEQ ID NO: 13157 - protein, 153 aa, Arabidopsis thaliana
MSTKKIILKSSDGHSFEVEEEAARQCQIIIAHMSENDCTDNGIPLPNVTGKILAMVIEYCNKHHVDAANPCSDDDLKKWDKEFMEKDTSTIFDLIKAANYLNIKSLFDLACQTVAEIIKGNTPEQIREFFNIENDLTPEEEAAIRRENKWAFE

SEQ ID NO: 13158 - protein, 152 aa, Arabidopsis thaliana
MSTKKIILKSSDGHSFEVEEEAACQCQTIAHMSEDDCTDNGIPLPEVTGKILEMVIEYCNKHHVDAANPCSDEDLKKWDKEFMEKYQSTIFDLIMAANYLNIKSLLDLACQTVADMIKDNTVEHTRKFFNIENDYTHEEEEAVRRENQWGFE

SEQ ID NO: 13159 - protein, 532 aa, Arabidopsis thaliana
MGSVPDPGELTELAQPSFEEFQKQTSLMTSCTLLWQELSDHFTSLEQNLMKKSEALKQMIETLDNQTQTSLESLKRREVTIDHSVEIVAGKVGERARAALESLEKARDGCGDGSNDDSGDVDDEEGLLSALKSLCLKMDARGFWNFVTARKKELENLRSKIPAALVDCVDPAMLVLEAISEVFPVDTRGDKVSNDYGWACVVILESLTPVIVDPVIGKSRLLVTPSVKEKAKEIAETWKKSLEERGRIENVKTPDVHTFLQHLVTFGIVKSEDLALYRKLVVGSAWRKQMPKLAVSVGLGDQMPDMIEELISRGQQLDAVHFTYEVGLVDKFPPVPLLKAYLRDAKKSAASIMEDSSNTGRATHLVARKEQSALKAVLKCIEEYKLEEEFPPENLKKRLDQLEKTKTEKRKPAAVPANKRTRASYNGPMPPAKAGRITNAYVSSFPFIRSPSHSPQYASPAAYPSPPTTVYSNRSPPYPYSPEIIPGSYQGSPIGYPAYNGYCNGPVPAPAPPVYHPHHHQHHQFHHQQHYY

SEQ ID NO: 13160 - protein, 347 aa, Arabidopsis thaliana
MGSFVKEETSSLMTDFLEKCGGYAVVDGGFATELQRHGADINDPLWSAKCLITSPHLVTKVHLDYLESGANIIITASYQATIQGFVAKGLSVGEAENLLRRSVEITYEAREIFYNRCTKGSWDFAYAGKASRRPILVAASVGSYGAYLADGSEYSGIYGDSVSKETLKDFHRRRVQILAKSGADLIAFETIPNKLEAEAYADLLEEEDIDIPAWFSFTSKDGVSVPRGDSVVECAKVADSCKNVVAIGINCTAPRYIHALIISLRQMTRKPIVVYPNSGEVYDGLNKKWIKSEGESEEDFVSYVSKWRDAGASLFGGCCRTTPNTIRAIAKVLSDEPSAASKPKFGQ

SEQ ID NO: 13161 - protein, 568 aa, Arabidopsis thaliana
MEAKIVKVSDSSYKDGLGKKRKHPGNYTPYDSGRSYAKLQWVLSPNSSTQKLEKRRNLDGENKVIVSENHVEKSLVRYFSYYKKTGVPKRVMFHENGEWIDLPDHILCDIRNDLEAKRATIEFNWCGRHFLLDFLHMYRLDLETGVKTQLAWIDIAGKCFFPETFDTLERDGCHHIRGEDPEQHDQREIKLHIEIDVNSGELPRLNLNVVTDESGDNMDDFQAVQRSSNGPNDEASEDSCSRELDDAVEKWDKTETDRFSGVKPAEEELDKDAVKQMFALGAATLGHVESLDVYQFSSEIAKARLSLFQKQADITKKHRGDANIRYAWVPAKKEVLSAVMMHGLGVGGAFIKKSMYGVGVHAANCPYFSARYCDIDDNGVRHMVLCRVIMGNMEPLRGDNTQYFTGGEEYDNGVDDVESPKHYLIWNMNMNTHIYPEFVVSFKLSIPNAEGNILPTTQSRHESSGLTLEGPKGSPSNEPGRVSNGGSGSEKNSSSSRRPRSPIMPFPLLFKAISSKIARKDMDLIIAGYQELREKKVSRKEFYKTLSMIVGDDDLLISTITGLQRSLG

SEQ ID NO: 13162 - protein, 115 aa, Arabidopsis thaliana
MVKSTSKDAQDLFHSLHSAYTATPTNLKIIDLYVCFAVFTALIQVAYMALVGSFPFNSFLSGVLSCIGTAVLAVCLRIQVNKENKEFKDLAPERAFADFVLCNLVLHLVIINFLG

SEQ ID NO: 13163 - protein, 422 aa, Arabidopsis thaliana
MERLTSPPRLMIVSDLDHTMVDHHDPENLSLLRFNSLWEHAYRHDSLLVFSTGRSPTLYKELRKEKPLLTPDITIMSVGTEITYGNSMVPDHGWVEALNNKWDLGIVKQEASNFPELKLQAETEQRPHKVSFYVEKSKAQEVTKELSQRFLKRGLDVKIIYSGGMDLDILPQGAGKGQALAYLLKKLKTEGKLPVNTLACGDSGNDAELFSIPDVYGVMVSNAQEELLKWHAENAKDNPKVIHAKERCAGGIIQAIGHFKLGPNLSPRDVSDFLEIKVENVNPGHEVVKFFLFYERWRRGEVENSEAYTASLKASVHPGGVFVHPSGTEKSLRDTIDELRKYHGDKQGKKFRVWADQVLATDTTPGTWIVKLDKWEQDGDERRCCTTTVKFTSKEGEGLVWEHVQQTWSKETMVKDDSSWII

SEQ ID NO: 13164 - protein, 295 aa, Arabidopsis thaliana
MYSAIRSLPLDGGHVGGDYHGPLDGTNLPGDACLVLTTDPKPRLRWTTELHERFVDAVTQLGGPDKATPKTIMRTMGVKGLTLYHLKSHLQKFRLGRQAGKESTENSKDASCVGESQDTGSSSTSSMRMAQQEQNEGYQVTEALRAQMEVQRRLHDQLEVQRRLQLRIEAQGKYLQSILEKACKAFDEQAATFAGLEAAREELSELAIKVSNSSQGTSVPYFDATKMMMMPSLSELAVAIDNKNNITTNCSVESSLTSITHGSSISAASMKKRQRGDNLGVGYESGWIMPSSTIG

SEQ ID NO: 13165 - protein, 380 aa, Vitis vinifera
MSGTAGQVICCKAAVAWEAGKPLVIEEVEVAPPQAMEVRLKILYTSLCHTDVYFWEAKGQTPLFPRIFGHEAGGIVESVGEGVTDLKPGDHVLPIFTGECKDCAHCKSEESNLCDLLRINTDRGVMIHDGKSRFTIKGKPIYHFLGTSTFSEYTVVHVGCVAKINPLAPLDKVCVLSCGISTGLGATLNVAKPTKGSTVAVFGLGAVGLAAAEGARIAGASRIIGVDLNPKRYEGAKKFGVTDFVNPKDHEKSVQEVIVEMTGGGVDRSLECTGNVNAMISAFECVHDGWGVAVIVGVPNKDDVFKTHPINLLNERTLKGTFFGNYKPRSDIPAVVEKYMNKELEVEKFITHSVPFSEINKAFEYMLKGEGLRCIIHMEP

SEQ ID NO: 13166 - protein, 547 aa, Arabidopsis thaliana
MEATRNLVSSSPSFQTKTHLKSSYSSPSSVVMLHDQTTTPVVNSRHLNSLSRHFPASVLSQEPREESRPLSHALRDDRTSQLTLERRQFDELVSSREDEKFEQQLLHSTGLWNLLISPLTSETKLPAVVSPLADAELCDVVALAQKALSASKQAALLVDDTEANPSDNIKDSLSTSSSMSLPEKGNIVRSKRQLERRAKNRRAPKSNDVDDEGYVPQKTSAKKKYKQGADNDDALQLFLWGPETKQLLTAKEEAELISHIQHLLKLEKVKTKLESQNGCEPTIGEWAEAMGISSPVLKSDIHRGRSSREKLITANLRLVVHIAKQYQNRGLNFQDLLQEGSMGLMKSVEKFKPQSGCRFATYAYWWIRQSIRKSIFQNSRTIRLPENVYMLLGKVSEARKTCVQEGNYRPSKEELAGHVGVSTEKLDKLLYNTRTPLSMQQPIWSDQDTTFQEITPDSGIETPTMSVGKQLMRNHVRNLLNVLSPKERRIIKLRFGIDGGKQRSLSEIGEIYGLSKERVRQLESRALYRLKQNMNSHGLHAYADLLV

SEQ ID NO: 13167 - protein, 379 aa, Arabidopsis thaliana
MPLSRSLLSRRISNSFRFHQGETTTAPESESIPPPSNMAGSSSWSAMLPELLGEIIRRVEETEDRWPQRRDVVTCACVSKKWREITHDFARSSLNSGKITFPSCLKLPGPRDFSNQCLIKRNKKTSTFYLYLALTPSFTDKGKFLLAARRFRTGAYTEYIISLDADDFSQGSNAYVGKLRSDFLGTNFTVYDSQPPHNGAKPSNGKASRRFASKQISPQVPAGNFEVGHVSYKFNLLKSRGPRRMVSTLRCPSPSPSSSSAGLSSDQKPCDVTKIMKKPNKDGSSLTILKNKAPRWHEHLQCWCLNFHGRVTVASVKNFQLVATVDQSQPSGKGDEETVLLQFGKVGDDTFTMDYRQPLSAFQAFAICLTSFGTKLACE

SEQ ID NO: 13168 - protein, 311 aa, Arabidopsis thaliana
MAAPIRFFELNTGAKLPCVGLGTYAMVATAIEQAIKIGYRHIDCASIYGNEKEIGGVLKKLIGDGFVKREELFITSKLWSNDHLPEDVPKALEKTLQDLQIDYVDLYLIHWPASLKKESLMPTPEMLTKPDITSTWKAMEALYDSGKARAIGVSNFSSKKLTDLLNVARVTPAVNQVECHPVWQQQGLHELCKSKGVHLSGYSPLGSQSKGEVRLKVLQNPIVTEVAEKLGKTTAQVALRWGLQTGHSVLPKSSSGARLKENLDVFDWSIPEDLFTKFSNIPQEKFCRATEFAHETHGFYKTIEELWDGEI

SEQ ID NO: 13169 - protein, 301 aa, Arabidopsis thaliana [sequence omitted]

SEQ ID NO: 13170 - protein, 177 aa, Arabidopsis thaliana
MSSNKIVLTSSDGESFQVEEVVARKLQIVKHLLEDDCVINEIPLQNVTGNILSIVLEYCKKHVDDVVDDDASEEPKKKKPDDEAKQNLDAWDAEFMKNIDMETIFKLILAANYLNVEGLLGLTCQTVADYIKDKTPEEVRELFNIENDFTHEEEEEAIRKENAWAFEADTKHEDPKP

SEQ ID NO: 13171 - protein, 558 aa, Arabidopsis thaliana
MGSHMVWFLFLVSFFSVFPAPSESMVRHYKFNVVMKNVTRLCSSKPTVTVNGRYPGPTIYAREDDTLLIKVVNHVKYNVSIHWHGVRQVRTGWADGPAYITQCPIQPGQVYTYNYTLTGQRGTLWWHAHILWLRATVYGALVILPKRGVPYPFPKPDNEKVIVLGEWWKSDTENIINEALKSGLAPNVSDSHMINGHPGPVRNCPSQGYKLSVENGKTYLLRLVNAALNEELFFKVAGHIFTVVEVDAVYVKPFKTDTVLIAPGQTTNVLLTASKSAGKYLVTASPFMDAPIAVDNVTATATVHYSGTLSSSPTILTLPPPQNATSIANNFTNSLRSLNSKKYPALVPTTIDHHLFFTVGLGLNACPTCKAGNGSRVVASINNVTFIMPKTALLPAHYFNTSGVFTTDFPKNPPHVFNYSGGSVTNMATETGTRLYKLPYNATVQLVLQDTGVIAPENHPVHLHGFNFFEVGRGLGNFNSTKDPKNFNLVDPVERNTIGVPSGGWVVIRFRADNPGVWFMHCHLEVHTTWGLKMAFLVENGKGPNQSILPPPKDLPKC

SEQ ID NO: 13172 - protein, 383 aa, Arabidopsis thaliana
MSSPERALLNLLTDIALSFDGAILGLTLAVSAVGSALKYASTNAALKKIKDAPEVSISDLRSLLPASEDKSETNDNRKSNDQRIVVVRGVVKPKISGDEGYKNNNVLISPETGDKALIIQRTQTYVYSGWKRLFQSTGHRFMLERSLRKHGADFTRTVPFVIVGKDQQSNSSFVAVNMDGSRQPLPLTTVYNRLQPINSSFLQAFLYPDYPVGLLDIEKILPPGKDITAVGIYSFNNGVPEIKSCQDLPYFLSEMTKDKMIEDLMEQTNFIFLGSVILGIVSVGILSYAAVRTWNKWKQWNHQRELPQRPNDSVVDDEPEDADEIPDGELCVICVSRRRVPAFIPCGHVVCCRRCASTVERELNPKCPVCLQSIRGSMRVYYS

SEQ ID NO: 13173 - protein, 141 aa, Arabidopsis thaliana; identical to SEQ ID NO: 615

SEQ ID NO: 13174 - protein, 221 aa, Arabidopsis thaliana
MALYCRDTLIIIFQKLTVADLARASCVCKVWNSVATEDDLVVSAFTAPWRIKELVGRPASVSFWRDNGIWKFAISHRICRGDSVTSLAVKYAVQVMDIKRLNNMMSDHGIYSRDRLLIPISNPEILANTTCYVELDKYAKREVAVLYLEGAPKREQPVPGTNQQSNLSADGKRRLIESLRRSMQVDDGTALYYLAIAEGDPRSALSEFSADLRWERQAGLN

SEQ ID NO: 13175 - protein, 592 aa, Arabidopsis thaliana
MEDPDIKRCKLSCVATVDDVIEQVMTYITDPKDRDSASLVCRRWFKIDSETREHVTMALCYTATPDRLSRRFPNLRSLKLKGKPRAAMFNLIPENWGGYVTPWVTEISNNLRQLKSVHFRRMIVSDLDLDRLAKARADDLETLKLDKCSGFTTDGLLSIVTHCRKIKTLLMEESSFSEKDGKWLHELAQHNTSLEVLNFYMTEFAKISPKDLETIARNCRSLVSVKVGDFEILELVGFFKAAANLEEFCGGSLNEDIGMPEKYMNLVFPRKLCRLGLSYMGPNEMPILFPFAAQIRKLDLLYALLETEDHCTLIQKCPNLEVLETRNVIGDRGLEVLAQYCKQLKRLRIERGADEQGMEDEEGLVSQRGLIALAQGCQELEYMAVYVSDITNESLESIGTYLKNLCDFRLVLLDREERITDLPLDNGVRSLLIGCKKLRRFAFYLRQGGLTDLGLSYIGQYSPNVRWMLLGYVGESDEGLMEFSRGCPNLQKLEMRGCCFSERAIAAAVTKLPSLRYLWVQGYRASMTGQDLMQMARPYWNIELIPSRRVPEVNQQGEIREMEHPAHILAYYSLAGQRTDCPTTVRVLKEPI

SEQ ID NO: 13176 - protein, 434 aa, Arabidopsis thaliana
MDLSSQRQSPNGSRGFRLQAPLVDSVSCYCRVDSGLKTVVEARKFVPGSKLCIQPDINPNAHRRKNSKRERTRIQPPLLPGLPDDLAVACLIRVPRAEHRKLRLVCKRWYRLASGNFFYSQRKLLGMSEEWVYVFKRDRDGKISWNTFDPISQLWQPLPPVPREYSEAVGFGCAVLSGCHLYLFGGKDPLRGSMRRVIFYNARTNKWHRAPDMLRKRHFFGCCVINNCLYVAGGECEGIQRTLRSAEVYDPNKNRWSFIADMSTAMVPLIGVVYDKKWFLKGLGSHQLVMSEAYDPEVNSWSPVSDGMVAGWRNPCTSLNGRLYGLDCRDGCKLRVFDESTDSWNKFMDSKAHLGNSKSLEAAALVPLHNKLCIIRNNMSMSLVDVSNPDKNNPRLWENIAVKGQSKSILSNIWSSIAGRALKSHIVHCQVLQA

SEQ ID NO: 13177 - protein, 351 aa, Arabidopsis thaliana
MEEAVVTRYWCHMCSQTVNPVMEAEIKCPFCQSGFVEEMEDDDDHDSSDPADVRANNSLWAPILMELMNDPVRRRRNQSVESVEDNQNEVQTENNEDDGENDLDWQLQEILRRRRRHSAAVLQLLQGIRAGLSVESESTGNGGNNPGRVILINTSNQTITVQNSADMDSVPAGSLGDYFIGPGFEMLLQRLAENDPNRYGTPPAKKEAVEALATVKIEETLQCSVCLDDFEIGTEAKLMPCTHKFHSDCLLPWLELHSSCPVCRYQLPADEAKTDSVTTTSDNNGSSSASATTSHGAENSDGNRRQEEEEEEEEEEEEENENNDGSGFSIPWPFSTLFSSSQDSNAPTDSS

SEQ ID NO: 13178 - protein, 549 aa, Arabidopsis thaliana
MEGRLLTVLVCLVSTVAIVNAGDPYFFHTWNVTYGTASPLGVPQKVILINGQFPGPNLNSTSNNNVVINVFNHLDEPFLLTWSGIQHRKNCWQDGVAGTSCPIPAGQNFTYHFQPKDQIGSYFYYPTTSLHRFAGGFGGLRVNSRLLIPVPYADPEDDYTVLLGDWYTAGHTALKNFLDSGRTLGLPNGVLINGKSGKVGGKNEPLFTMKPGKTYKYRLCNVGFKSTLNFRIQNHKMKLVEMEGSHVIQNDYDSLDVHVGQCFSVLVTANQAAKDYYMVASTRFLKKELSTVGVIRYEGSNVQASTELPKAPVGWAWSLNQFRSFRWNLTSNAARPNPQGSYHYGKINITRSIKLVNSKSVVDGKVRFGFNGVSHVDTETPLKLAEYFQMSEKVFKYNVIKDEPAAKITALTVQPNVLNITFRTFVEIIFENHEKTMQSFHLDGYSFFAVASEPGRWTPEKRENYNLLDAVSRHTVQVYPKSWSAILLTFDNAGMWNIRSENLERKYLGEQLYVSVLSPEKSLRDEYNIPLNTNLCGIVKGLPLPAHYS

SEQ ID NO: 13179 - protein, 328 aa, Arabidopsis thaliana
MSSSRNTHWCHRCQRAVRLHGQEPVCFYCGGGFVEELDMAQASPFDMFRSHRGVVERDQTFDLMDAFSVFMRNRLAERSHDREIRGRTISSGPENFPGLAPLLIFGGQVPYRLTGDNAVEALFNGGSPGIGITRGNTGDYFFGPGLEELFEQLSAGTTRRGPPPAPRSAIDALPTIKIAQRHLRSSDSNCPVCKDEFELGSEAKQMPCNHIYHSDCIVPWLVQHNSCPVCRQELPSASGPSSSQNRTTPTRNYRSSSSSSSSNSRENGNERRNPFSSFWPFRSSGSSSSSTQNRGGTRNSDTSDENHNYHQQQHQQSYMGYSGWPFDY

SEQ ID NO: 13180 - protein, 251 aa, Arabidopsis thaliana
MVNATVARNIAGICGNVISLFLFLSPIPTFITIYKKKKVEEYKADPYLATVLNCALWVFYGLPMVQPDSLLVITINGTGLAIELVYLAIFFFFSPTSRKVKVGLWLIGEMVFVGIVATCTLLLFHTHNQRSSFVGIFCVIFVSLMYIAPLTIMSKVIKTKSVKYMPFSLSLANFLNGVVWVIYALIKFDLFILIGNGLGTVSGAVQLILYACYYKTTPKDDEDEEDEENLSKVNSQLQLSGNSGQAKRVSA

SEQ ID NO: 13181 - protein, 367 aa, Arabidopsis thaliana
MARKYFQREVLPVTALVIMECANVGLNTLFKAATLKGMSFHVFIVYSYGLAALLLLPSLFCSFRSRTLPPMNFSILYKIVLLGIIGCCSNIMGYTGINYSSPTLASAISNLTPAFTFLLAVVFRMESVSFKRTSSVAKMLGTVVSIGGAFIVTLYNGPVVIAKSPPSVSLRSQSTNPNWILGAGFLAVEYFCVPLWYIVQTQIMREYPAEFTVVCFYSIGVSFWTALVTLFTEGNDLGAWKIKPNIALVSIVCSGLFGSCINNTIHTWALRIKGPLFVAMFKPLSIAIAVAMGVIFLRDSLYIGSLIGATVITIGFYTVMWGKAKEVALVEDDNKANHEEANEADLDSPSGSQKAPLLESYKNDEHV

SEQ ID NO: 13182 - protein, 263 aa, Arabidopsis thaliana
MGSGKERDTFVYLAKLSEQAERYEEMVESMKSVAKLNVDLTVEERNLLSVGYKNVIGSRRASWRIFSSIEQKEAVKGNDVNVKRIKEYMEKVELELSNICIDIMSVLDEHLIPSASEGESTVFFNKMKGDYYRYLAEFKSGNERKEAADQSLKAYEIATTAAEAKLPPTHPIRLGLALNFSVFYYEIMNAPERACHLAKQAFDEAISELDTLNEESYKDSTLIMQLLRDNLTLWTSDISEEGGDDAHKTNGSAKPGAGGDDAE

SEQ ID NO: 13183 - protein, 606 aa, Arabidopsis thaliana
MQQDNRKKNNLEMEFFSDYGDANRFKVQEVIGKGSYGVVCSAIDTLTGEKVAIKKIHDIFEHISDAARILREIKLLRLLRHPDIVEIKHIMLPPSRREFKDIYVVFELMESDLHQVIKANDDLTREHYQFFLYQLLRALKYIHTANVYHRDLKPKNILANANCKLKICDFGLARVAFNDTPTTIFWTDYVATRWYRAPELCGSFYSKYTPAIDIWSIGCIFAEVLMGKPLFPGKNVVHQLDLMTDLLGTPSLDTISRVRNEKARRYLTSMRKKPPIPFAQKFPNADPLSLKLLERLLAFDPKDRPTAEEALADPYFKGLAKVEREPSCQPITKMEFEFERRKVTKEDIRELISREILEYHPQLLKDHMNGADKASFLYPSAVDQFRRQFAHLEENSGKTGPVAPLERKHASLPRSTVIHSTAVARGGQPKLMNNTNTLNPETTQNIPFNHATIQAQQRNLSAAKPSTFMGPVAPFDNGRISRDAYDPRSFIRSTNLPFSQQSAATVAMGKQQERRTTMEPEKQARQISQYNRYAPDVAINIDNNPFIMARTGMNKAENISDRIIIDTNLLQATAGIGVAAAAAAAAPGGSAHRKVGAVRYGMSKMY

SEQ ID NO: 13184 - protein, 376 aa, Arabidopsis thaliana
MATPVDPPNGIRNQGKHYFSMWQTLFEIDTKYVPIKPIGRGAYGVVCSSVNRESNERVAIKKIHNVFENRIDALRTLRELKLLRHLRHENVVALKDVMMANHKRSFKDVYLVYELMDTDLHQIIKSSQVLSNDHCQYFLFQLLRGLKYIHSANILHRDLKPGNLLVNANCDLKICDFGLARTSNTKGQFMTEYVVTRWYRAPELLLCCDNYGTSIDVWSVGCIFAELLGRKPVFPGTECLNQIKLIINILGSQREEDLEFIDNPKAKRYIESLPYSPGISFSRLYPGANVLAIDLLQKMLVLDPSKRISVTEALQHPYMAPLYDPSANPPAQVPIDLDVDEDEDLGAEMIRELMWKEMIHYHPEAATINNNEVSEF

SEQ ID NO: 13185 - protein, 227 aa, Arabidopsis thaliana
MSEGDLAVMKPETMKSYIWLQTADGSIQQVEQEVAMFCPMICQEVIQKGVGSSKNHAISLPQRVNPAMFSLILDYCRFHQLPGRSNKERKTYDERFIRMDTKRLCELTSAADSLQLKPLVDLTSRALARIIEGKNPEEIREIFHLPDDLTEEEKLEPLKNSMDDPRIRLLNRLYAKKRKELKERERLKNVEVEEHVDERSVDDLLSFINGRGLFGSKENSVSQITRL

SEQ ID NO: 13186 - protein, 468 aa, Arabidopsis thaliana
MGEIVVLSSDDGMETIKNRVKSSEVVQWEKYLPKTVLRVLLVESDYSTRQIITALLRKCCYKVVAVSDGLAAWEVLKEKSHNIDLILTELDLPSISGFALLALVMEHEACKNIPVIMMSSQDSIKMVLKCMLRGAADYLIKPMRKNELKNLWQHVWRRLTLRDDPTAHAQSLPASQHNLEDTDETCEDSRYHSDQGSGAQAINYNGHNKLMENGKSVDERDEFKETFDVTMDLIGGIDKRPDSIYKDKSRDECVGPELGLSLKRSCSVSFENQDESKHQKLSLSDASAFSRFEESKSAEKAVVALEESTSGEPKTPTESHEKLRKVTSDQGSATTSSNQENIGSSSVSFRNQVLQSTVTNQKQDSPIPVESNREKAASKEVEAGSQSTNEGIAGQSSSTEKPKEEESAKQRWSRSQREAALMKFRLKRKDRCFDKKVRYQSRKKLAEQRPRVKGQFVRTVNSDASTKS

SEQ ID NO: 13187 - protein, 310 aa, Arabidopsis thaliana
MPQRHSKNNNDLAYFTYDEKKKLGYGTQRERLGRDSIKPFDACSLCLKPFIDPMCCHKGHVFCRECILECFLAQKKDIQRRLAAHSSQKKQDKDEEEERLMLQKARELDEFDQQNHSAMPRNSDKNHNEDKNGFHGANSVKTTSFEEEALRTMKAFWLPSATPAASVRVDAPETHTVCPEGKEKLKLKNLFAIRFTEDNSEEEETKTKSASSSSYDKSYICPSCKVTLTNTMSLVALSSCGHVFCKKCAEKFMPVDKVCLVCDKPCKDRNLVGLKKGGTGFAEHDDHLEAKEYKHLGSGSGLGLVRPVKT

SEQ ID NO: 13188 - protein, 501 aa, Arabidopsis thaliana
MNSESLENLHRPLIESSKSFVDYRLETVLTDRELPYFRRIYLAMMIEMKFLFHLAAPAIFVYVINNGMSILTRIFAGHVGSFELAAASLGNSGFNMFTYGLLLGMGSAVETLCGQAHGAHRYEMLGVYLQRSTVVLILTCLPMSFLFLFSNPILTALGEPEQVATLASVFVYGMIPVIFAYAVNFPIQKFLQSQSIVTPSAYISAATLVIHLILSWIAVYRLGYGLLALSLIHSFSWWIIVVAQIVYIKMSPRCRRTWEGFSWKAFEGLWDFFRLSAASAVMLCLESWYSQILVLLAGLLKNPELALDSLAICMSISAISFMVSVGFNAAASVRVSNELGAGNPRAAAFSTVVTTGVSFLLSVFEAIVVLSWRHVISYAFTDSPAVAEAVADLSPFLAITIVLNGIQPVLSGVAVGCGWQAFVAYVNIGCYYVVGIPVGFVLGFTYDMGAKGIWTGMIGGTLMQTIILVIVTLRTDWDKEVEKASSRLDQWEESREPLLKQ

SEQ ID NO: 13189 - protein, 204 aa, Arabidopsis thaliana
MELKNTIFLVILLSITILQSSSATPNRSESDQFIVSSCQTTQYPSLCVHTLSAYATKIRHNNDQDLAQTALIISLARAKSVTIFVAKLTKETPKFKRREYLAIKDCIEVLGNSVDRLAQSVKELARAGHAVASEDFMWKMSNVQTWVSAALTDETTCLDGFSERAMGGKVKRLIRYKVVHVAQVTSNALALVNQFAEKRSVKFP

SEQ ID NO: 13190 - protein, 431 aa, Arabidopsis thaliana
MGLSLRVRRRGGSVSKKEIIPVTSCSEEVEITIPSQFQCPISYELMKDPVIIASGITYDRENIEKWFESGYQTCPVTNTVLTSLEQIPNHTIRRMIQGWCGSSLGGGIERIPTPRVPVTSHQVSEICERLSAATRRGDYAACMEMVTKMTRLGKESERNRKCVKENGAGLVLCVCFDAFSENANASLLLEETVSVLTWMLPIGLEGQSKLTTTSSFNRLVELLRNGDQNAAFLIKELLELNVTHVHALTKINGVQEAFMKSINRDSTCVNSLISIHHMILTNQETVSRFLELDLVNITVEMLVDSENSVCEKALTVLNVICETKEGREKVRRNKLVIPILVKKILKISEKKDLVSVMWKVCKSGDGSEVEEALRLGAFKKLVVMLQVGCGEGTKEKVTELLKMMNKVMKMNGFVDRSYSSSIEFKHVKKPF

SEQ ID NO: 13191 - protein, 294 aa, Arabidopsis thaliana [sequence omitted]

SEQ ID NO: 13192 - protein, 433 aa, Arabidopsis thaliana
MGGSSSKESPRGGGSGRRYERSVSGSSSYSSAWDQSSYYQTPNHPSASPVSSYNSGRQTPKNLERKYSRIADNYRSIDEVTAALSHAGLESSNLIVGIDVTKSNEWTGARSFGRKSLHFIGTTPNPYQQAISIIGKTLSVFDEDNLIPCYGFGDATTHDQDVFSFNPNDTYCNGFEEVLMCYREIVPQLRLSGPTSFAPIIERAMTIVEESGGQYHVLLIIADGQVTRSVDTDNGGFSPQEQQTIDAIVRASEYPLSIVLVGVGDGPWDTMRQFDDNIPARAFDNFQFVNFTDIMSKNIDPARKEAEFALSALMEIPSQYKATLELGLLGQRTGHCPDRIALPPPTYATQSMRNSPRTSRSTSFQNKPYDNGVSSTPPSTTHNESQQQFCPVCLVSAKNMAFNCGHQTCAGCGEDLHVCPICRSSISVRIKLY

SEQ ID NO: 13193 - protein, 619 aa, Arabidopsis thaliana
MAREHAIGEATGKRKKRGRVEEAEEYCNDGIEEQVEDEKLPLEVGMFYYPMTPPSFIVSDALEPDFPLIYVNRVFEVFTGYRADEVLGRNCRFLQYRDPRAQRRHPLVDPVVVSEIRRCLEEGIEFQGELLNFRKDGTPLVNRLRLAPIRDDDGTITHVIGIQVFSETTIDLDRVSYPVFKHKQQLDQTSECLFPSGSPRFKEHHEDFCGILQLSDEVLAHNILSRLTPRDVASIGSACRRLRQLTKNESVRKMVCQNAWGKEITGTLEIMTKKLRWGRLARELTTLEAVCWRKFTVGGIVQPSRCNFSACAVGNRLVLFGGEGVNMQPLDDTFVLNLDAECPEWQRVRVTSSPPGRWGHTLSCLNGSWLVVFGGCGRQGLLNDVFVLDLDAKHPTWKEVAGGTPPLPRSWHSSCTIEGSKLVVSGGCTDAGVLLSDTFLLDLTTDKPTWKEIPTSWAPPSRLGHSLSVFGRTKILMFGGLANSGHLKLRSGEAYTIDLEDEEPRWRELECSAFPGVVVPPPRLDHVAVSMPCGRVIIFGGSIAGLHSPSQLFLIDPAEEKPSWRILNVPGKPPKLAWGHSTCVVGGTRVLVLGGHTGEEWILNELHELCLASRQDSDL

SEQ ID NO: 13194 - protein, 270 aa, Arabidopsis thaliana
MWGFASNVIGSMGLKKSPKDSAQASSQCSDDEVSNISRDEEGLECPICWESFNIVENVPYVLWCGHTLCQNCVFGLQSAVLRLSSQDIRIPFFVSCPWCQLLSFRIVYKGNLKFPRKNFFLLWMVESLNGDRTSHGDRTSHGSLVTDNQQSAPTPRCSMSLGNHSSNNNLVARPLLRNQSTDLLPHHDHSNQPSRQLFSFHKSLDFFISFTSKFPFVIIFLLIVFFAIPGSLIILALYFLLTILFAVPAGLVLYFAYPILERLVNEITSS

SEQ ID NO: 13195 - protein, 423 aa, Arabidopsis thaliana
MERLISHPPLMIVSDLDHTMVDHQDHENLSLLRFNSLWEYAYRRDSLLVFSTARSPVLYKELRKEKPLLTPDIIITSIGTEIAFGNSMVPDHAWVESLNSCKWNREIVLEETSKFPELTLQPKTEQRLHKVSFYIDEGKGEALTKELSQLLEKRGLDVKIIYSWGKNVDVIPRGAGKGEALEYLLKKLQAEGIFPVNTLACGDSEHDAELFSIPDVHGVMVSNSQEELLKWRSENALNNLKVIHSTERCADGIIQAIGHFNLGPDLSPRDVSEFLDRKMDNVNPGHEVVRFYLFYERLRRGEIKNYETYIASFKDSCLHAAVLFHPSGAEKSLRDTIDELKKCYGDKRGKKFWVWVDQVLVTDTIPGKWIVKFDKWEQCEDESQCCKTTVEFTSKGGDLVWEKVKQIWSEESKVKDDNSSWIL

SEQ ID NO: 13196 - protein, 369 aa, Arabidopsis thaliana
MSPIPERAKLHIAMVVFQTGYAGNHVIMRYALNLGVSKLVFPLYRTIVAFSVLAPSAYFLEKKERPAMKISFLIQFFLLGLVGITLNQGFYIFGLDNTSPTFASATENVVPAVSFLMAALLGIEKVEWKRKDGIAKVVGTIVSVAGSLVITLYKGPTIYQPSLNIVNQTIKPEEAEEENKNWTLGCLCLMGHCLCWSSWIVLQSPLLKKYPARFSFVSYSCFFAVIQFFGISAYFERDLERWKIISGGELYALLYTGLVGSAMVFAIQIYVVERGGPLFVSAYLPLQTLIAAVLATLALGEHFYLGGLIGAILIMSGLYLVVMGKSWENQALCQQQQHMISSAASDFGDEEDYHNNKPRSPISQPLISS

SEQ ID NO: 13197 - protein, 185 aa, Arabidopsis thaliana
MNSPPENDLCSICHSHFTAPCQANCSHWFCGNCIMLVWRHGSTLQPCKCPLCRRHISLLVPSEDTIRDRNDATVKEVLGNLETYNRLFGGRSSSLVQRMQDLPFLLRRLLREMMDPQRTLPLVIRARVYIAMILSAVYIISPIDIIPEGVLGVVGLLDDLLIALICFLHVAALYRSVLYFRHAGS

SEQ ID NO: 13198 - protein, 274 aa, Arabidopsis thaliana
MELHEISKLDNKKHPERIVESKMKKRMKPYSLTSLNNLDDGCLMHILSFLSPIPDRYNTALVCHRWRYLACHPRLWLRVDRFVKDLSQPGVFLNIESAVSAARPGDTILIVAGGNYRVSNIQIKKPLCLVGGGEIPDETTLVCARGSDSALELLSTCKLANLTVKAELGCCLLHRSGRLTIDGCVLQCETNPLDHLSCPIVSTAGDEDIENILSHVEVKETVTGKIKANSVTVLQTRIEGGAKAVSTRGDLVLQRVRVMYSKAYLYFWFDVDYE

SEQ ID NO: 13199 - protein, 156 aa, Arabidopsis thaliana
MELHEISKLDNKKHPERIVESKMKKRMKPYSLTSLNNLDDGCLMHILSFLSPIPDRYNTALVCHRWRYLACHPRLWLRVDRFVKDLSQPGVFLNIESAVSAARPGDTILIVAGGNYRVSNIQIKKPLCLVGGGEIPDETTLVCARGSDRFGTHIPS

SEQ ID NO: 13200 - protein, 320 aa, Arabidopsis thaliana
MSSIRNTHWCHRCQRAVWLRARDAVCSYCGGGFVEEIDIGPSRAHRDVERDPTFDLMEAFSAFMRSRLAERSYDREISGRLGSAGSESFSNLAPLLIFGGQAPFRLAGGDNSSVEAFVNGAAPGIGIARGTNAGDYFFGPGLEELIEQLSSGTHHRGPPPAPKSSIDALPTIKITQKHLKSSDSHCPVCKDEFELKSEAKQMPCHHIYHSDCIVPWLVQHNSCPVCRKELPSRGSSSSTQSSQNRSTNGRENSRRRNIFSNLWPFRSSSSSSTQNRRDTNNTATAEEGHYHHHQQQQQQHQHQHQQQQSHMGYSGWPFDY

SEQ ID NO: 13201 - protein, 501 aa, Arabidopsis thaliana
MAIPMPTRQLFIDGEWREPILKKRIPIVNPATEEVIGDIPAATTEDVDVAVNAARRALSRNKGKDWAKAPGAVRAKYLRAIAAKVNERKTDLAKLEALDCGKPLDEAVWDMDDVAGCFEFYADLAEGLDAKQKAPVSLPMESFKSYVLKQPLGVVGLITPWNYPLLMAVWKVAPSLAAGCTAILKPSELASVTCLELADICREVGLPPGVLNVLTGFGSEAGAPLASHPGVDKIAFTGSFATGSKVMTAAAQLVKPVSMELGGKSPLIVFDDVDLDKAAEWALFGCFWTNGQICSATSRLLVHESIASEFIEKLVKWSKNIKISDPMEEGCRLGPVVSKGQYEKILKFISTAKSEGATILHGGSRPEHLEKGFFIEPTIITDVTTSMQIWREEVFGPVLCVKTFASEDEAIELANDSHYGLGAAVISNDTERCDRISEAFEAGIVWINCSQPCFTQAPWGGVKRSGFGRELGEWGLDNYLSVKQVTLYTSNDPWGWYKSPN

SEQ ID NO: 13202 - protein, 389 aa, Arabidopsis thaliana
MADNTDNRRSLWGVPEKLQLHIAMLTLQFGYAGFHVVSRAALNMGISKLVFPVYRNIIALLLLLPFAYFLEKKERPAITLNFLIQFFFLALIGITANQGFYLLGLDNTSPTFASSMQNSVPAITFLMAALLRIEKVRINRRDGISKILGTALCVAGASVITLYKGPTIYTPASHLHAHLLTTNSAVLAPLGNAAPKNWTLGCIYLIGHCLSWSGWLVFQAPVLKSYPARLSVTSYTCFFGIIQFLIIAAFCERDSQAWVFHSGWELFTILYAGIVASGIAFAVQIWCIDRGGPVFVAVYQPVQTLVVAIMASIALGEEFYLGGIIGAVLIIAGLYFVLYGKSEERKFAALEKAAIQSSAEHGIERAPVSRNSIKSSITTPLLHQSTDNV

SEQ ID NO: 13203 - protein, 160 aa, Arabidopsis thaliana
MSAKKIVLKSSDGESFEVEEAVALESQTIAHMVEDDCVDNGVPLPNVTSKILAKVIEYCKRHVEAAASKAEAVEGAATSDDDLKAWDADFMKIDQATLFELILAANYLNIKNLLDLTCQTVADMIKGKTPEEIRTTFNIKNDFTPEEEEEVRRENQWAFE

SEQ ID NO: 13204 - protein, 333 aa, Arabidopsis thaliana
MAMGFDFNEMNKTKKTLIGLGLGQILSLLCTSNAFTSSELARKGINAPTSQTFLSYTLLAVVYGGIMLYRRPTIKGKWYHYFLLALVDVEGNFLVVKANQYTSITSIMLLDCWAIPCVLVLTWMFLKTKYRLMKISGVFICIAGVVMVLFSDVHAGSRAGGSNPVKGDFLVLAGATLYAVSNTTEEFLVKNADTVELMTFMGLFGAIISAIQVAIFEQGELKAIHWSADAVFPFLRFAITMFLFYSLLPILLRTNGSTMFTLSLLTSDMWAVLIRIFAYHEKVDWLYYLAFATTAIGLIIYSMKEKDEEEEREEQRKKLLDEEEGQSLPDTSL

SEQ ID NO: 13205 - protein, 347 aa, Arabidopsis thaliana
MEKPESEKKSAVSDVGAWAMNVISSVGIIMANKQLMSSSGFGFGFATTLTGFHFAFTALVGMVSNATGLSASKHVPLWELLWFSIVANISIAAMNFSLMLNSVGFYQISKLSMIPVVCVLEWILHSKHYCKEVKASVMVVVIGVGICTVTDVKVNAKGFICACTAVFSTSLQQISIGSLQKKYSVGSFELLSKTAPIQAISLLICGPFVDYLLSGKFISTYQMTYGAIFCILLSCALAVFCNISQYLCIGRFSATSFQVLGHMKTVCVLTLGWLLFDSEMTFKNIAGMAIAIVGMVIYSWAVDIEKQRNAKSTPHGKHSMTEDEIKLLKEGVEHIDLKDVELGDTKP

SEQ ID NO: 13206 - protein, 126 aa, Arabidopsis thaliana
MGLSYSGAGVIIAGVILNDFIKSVRSFLDIRRLFGSASSGSTIIDKIPMDDMLPATKFEDISSRVNPPESCRICQDEFDGGDEVRCLRNCVHVYHKTCIDRWIQDDKMTCPLCRTPIVPDFYFFRL

SEQ ID NO: 13207 - protein, 190 aa, Arabidopsis thaliana
MGGCCSSSRKSHLVGTPVYYYCPESFEELVPSGTRAGVGSAFTTGLLVDIGLETSIPDTFCAPAPLPYDLLLGRPQCTDSESIKGRMSGSSFETLATCEDLGESDCKTLASSVILSPRKSDFSKHQGLKILVDEEEDCCPICFEDYDVENPRLTTKCEHEFHLSCLLEWIERSDRCPICDKEVVFDDRLN

SEQ ID NO: 13208 - protein, 154 aa, Arabidopsis thaliana
MSKMVMLLSSDGESFQVEEAVAVQSQTIAHMIEDDCVANGVPIANVTGVILSKVIEYCKKHVVSDSPTEESKDELKKWDAEFMKALEQSSTLFDVMLAANYLNIKDLLDLGCQTVADMITGKKPDEIRALLGIENDFTPEEEEEIRKENQWAFE

SEQ ID NO: 13209 - protein, 336 aa, Arabidopsis thaliana
MEEGSMFRSLLAILQWWGFNVTVIIMNKWIFQKLDFKFPLSVSCVHFICSSIGAYIVIKVLKLKPLIVVDPEDRWRRIFPMSFVFCINIVLGNVSLRYIPVSFMQTIKSFTPATTVVLQWLVWRKYFDWRIWASLVPIVGGILLTSVTELSFNMFGFCAALFGCLATSTKTILAESLLHGYKFDSINTVYYMAPFATMILGIPALLLEGSGILSWFEAHPAPWSALIIILSSGVLAFCLNFSIFYVIHSTTAVTFNVAGNLKVAVAVMVSWLIFRNPISYMNAVGCGITLVGCTFYGYVRHMLSQQTPGTPRTPRTPRSKMELLPLVNNDKLEGKV

SEQ ID NO: 13210 - protein, 245 aa, Arabidopsis thaliana
MENEREKLIYLAKLGCQAGRYDDVMKSMRKVCELDIELSEEERDLLTTGYKNVMEAKRVSLRVISSIEKMEDSKGNDQNVKLIKGQQEMVKYEFFNVCNDILSLIDSHLIPSTTTNVESIVLFNRVKGDYFRYMAEFGSDAERKENADNSLDAYKVAMEMAENSLAPTNMVRLGLALNFSIFNYEIHKSIESACKLVKKAYDEAITELDGLDKNICEESMYIIEMLKYNLSTWTSGDGNGNKTDG

SEQ ID NO: 13211 - protein, 259 aa, Arabidopsis thaliana
MASGREEFVYMAKLAEQAERYEEMVEFMEKVSAAVDGDELTVEERNLLSVAYKNVIGARRASWRIISSIEQKEESRGNDDHVTAIREYRSKIETELSGICDGILKLLDSRLIPAAASGDSKVFYLKMKGDYHRYLAEFKTGQERKDAAEHTLAAYKSAQDIANAELAPTHPIRLGLALNFSVFYYEILNSPDRACNLAKQAFDEAIAELDTLGEESYKDSTLIMQLLRDNLTLWTSDMQDDAADEIKEAAAPKPTEEQQ

SEQ ID NO: 13212 - protein, 358 aa, Arabidopsis thaliana
MACIVEDPQRAGQSNETQIALISGVPDDISKSCLARVPREYHMAMKCVSRRWRDFVCSDEMCDYRNEFNLAESWIYALCRDISGGVFLHMLNPFSSRRSWKRINDYPYIPMREGMGFAVLGKRLFVLGGCGWLEDATDEIYCYDAAMNTWFDVVPPLSTKRCYFACETLDGKIIAIGGLGLNPNAKRTWDIYDPLTRTCKSCSDVNIVPEMEDSFVMDGRIYIRGGVGGSSTAVYSASSGIWERMDDDMASGWRGPAVVVAGDLYVLDQTFGAKLTMWCKDTRMWIHIGKLSQLVMKQPCRLVSIGNSIFVIGKDCSTVVIDVENVRKNKMNGVMVCSSIPKTWDDDIDVISCKSVAI

SEQ ID NO: 13213 - protein, 738 aa, Arabidopsis thaliana
MERKTIDLEQGWDYMQTGITKLKRILEGLNEPAFDSEQYMMLYTTIYNMCTQKPPHDYSQQLYDKYREAFEEYINSTVLPALREKHDEFMLRELFKRWSNHKVMVRWLSRFFYYLDRYFIARRSLPPLNEVGLTCFRDLVYNELHSKVKQAVIALVDKEREGEQIDRALLKNVLDIYVEIGMGQMERYEEDFESFMLQDTSSYYSRKASSWIQEDSCPDYMLKSEECLKKERERVAHYLHSSSEPKLVEKVQHELLVVFASQLLEKEHSGCRALLRDDKVDDLSRMYRLYHKILRGLEPVANIFKQHVTAEGNALVQQAEDTATNQVANTASVQEQVLIRKVIELHDKYMVYVTECFQNHTLFHKALKEAFEIFCNKTVAGSSSAELLATFCDNILKKGGSEKLSDEAIEDTLEKVVKLLAYISDKDLFAEFYRKKLARRLLFDRSANDDHERSILTKLKQQCGGQFTSKMEGMVTDLTLARENQNSFEDYLGSNPAANPGIDLTVTVLTTGFWPSYKSFDINLPSEMIKCVEVFKGFYETKTKHRKLTWIYSLGTCHINGKFDQKAIELIVSTYQAAVLLLFNTTDKLSYTEILAQLNLSHEDLVRLLHSLSCAKYKILLKEPNTKTVSQNDAFEFNSKFTDRMRRIKIPLPPVDERKKVVEDVDKDRRYAIDAAIVRIMKSRKVLGHQQLVSECVEQLSRMFKPDIKAIKKRMEDLITRDYLERDKENPNMFRYLA

SEQ ID NO: 13214 - protein, 351 aa, Arabidopsis thaliana
MSEGEMAIIKPEMMKSYIWLETADGSIQQVEQEVAMFCPMICQEVIQKGVGSSKNYAISLPQRVNPAMLSLIFDYCRFHQVPGRSNKERKVYDEKFIRMDTKRLCELTSAADSLQLKPLVDLTSRALARIIEGKTPEEIREIFHLPDDLTEEEKLEPLKNTMDDPRIRLLNRLYAKKRKELKEREKLKSVEVEEHVDERSVDDLLSFINGRDPKVVKTSKSKKKNKKRKEQKNGSSNGTCEALEKDLHNLDSKSQSAEIVDNTASCLGDVSNLPSMEDDIFTPKTEFEDGYIDDEIDPALKELLDREVEDFARRLNSSWVLSIGQERQPVNFSINGNGTSRRLTGPAAGHK

SEQ ID NO: 13215 - protein, 326 aa, Arabidopsis thaliana
MDLDSMDCTSTMDVTDDEEIHQDRHSYASVSKHHHTNNNTTNVNAAASGLLPTTTSVHELLECPVCTNSMYPPIHQCHNGHTLCSTCKARVHNRCPTCRQELGDIRCLALEKVAESLELPCKHMSLGCPEIFPYYSKLKHETVCNFRPYSCPYAGSECSVTGDIPFLVAHLRDDHKVDMHSGCTFNHRYVKSNPREVENATWMLTVFHCFGQYFCLHFEAFQLGMAPVYMAFLRFMGDETEARNYNYSLEVGGYGRKLIWEGTPRSVRDSHRKVRDSHDGLIIQRNMALFFSGGDRKELKLRVTGRIWKEQQQSGEGGGACIPNLS

SEQ ID NO: 13216 - protein, 585 aa, Arabidopsis thaliana
MGLRFPPKVLEHILSFIDSNEDRNSVSLVCKSWFETERKTRKRVFVGNCYAVSPAAVTRRFPEMRSLTLKGKPHFADYNLVPDGWGGYAWPWIEAMAAKSSSLEEIRMKRMVVTDECLEKIAASFKDFKVLVLTSCEGFSTDGIAAIAATCRNLRVLELRECIVEDLGGDWLSYFPESSTSLVSLDFSCLDSEVKISDLERLVSRSPNLKSLKLNPAVTLDGLVSLLRCAPQLTELGTGSFAAQLKPEAFSKLSEAFSNCKQLQSLSGLWDVLPEYLPALYSVCPGLTSLNLSYATVRMPDLVELLRRCSKLQKLWVMDLIEDKGLEAVASYCKELRELRVFPSEPDLDATNIPLTEQGLVFVSKGCRKLESVLYFCVQFTNAALFTIARKRPNLKCFRLCVIEPFAPDYKTNEPLDKGFKAIAEGCRDLRRLSVSGLLSDKAFKYIGKHAKKVRMLSIAFAGDSDLMLHHLLSGCESLKKLEIRDCPFGDTALLEHAAKLETMRSLWMSSCFVSFGACKLLSQKMPRLNVEVIDEHPPESRPESSPVERIYIYRTVAGPRMDTPEFVWTIHKNPENGVSHLAIK

SEQ ID NO: 13217 - protein, 594 aa, Arabidopsis thaliana
MQKRIALSFPEEVLEHVFSFIQLDKDRNSVSLVCKSWYEIERWCRRKVFIGNCYAVSPATVIRRFPKVRSVELKGKPHFADFNLVPDGWGGYVYPWIEAMSSSYTWLEEIRLKRMVVTDDCLELIAKSFKNFKVLVLSSCEGFSTDGLAAIAATCRNLKELDLRESDVDDVSGHWLSHFPDTYTSLVSLNISCLASEVSFSALERLVTRCPNLKSLKLNRAVPLEKLATLLQRAPQLEELGTGGYTAEVRPDVYSGLSVALSGCKELRCLSGFWDAVPAYLPAVYSVCSRLTTLNLSYATVQSYDLVKLLCQCPKLQRLWVLDYIEDAGLEVLASTCKDLRELRVFPSEPFVMEPNVALTEQGLVSVSMGCPKLESVLYFCRQMTNAALITIARNRPNMTRFRLCIIEPKAPDYLTLEPLDIGFGAIVEHCKDLRRLSLSGLLTDKVFEYIGTYAKKMEMLSVAFAGDSDLGMHHVLSGCDSLRKLEIRDCPFGDKALLANASKLETMRSLWMSSCSVSFGACKLLGQKMPKLNVEVIDERGAPDSRPESCPVERVFIYRTVAGPRFDMPGFVWNMDQDSTMRFSRQIITTNGL

SEQ ID NO: 13218 - protein, 477 aa, Arabidopsis thaliana
MKSNQKKQKSPNYQNPRRQRGEIEREKEAKIMASIPPPELDNDSLASSPRSEYDSQPRVRFMCTFGGRILPRPPDNQLCYVGGDNRMVAVHRHTTFASLLSKLAKLSGKSNISVKYQLPNEDLDALISVSTDEDVENMMDEYDRVAQNQNPRASRLRLFLFTKNVAGEEDNDSRASSISSLLDSSVNREQWFLDALNLGSSAAATAVSNGGSGRVFERVRSEVSSIVSEVPDYLFGLDNFDETAPPHELRDRDPRAKIQREVSTLSDPGSPRRDVPSPYGSTSSAPVMRISTPELPPPVFIKPESPEPVSTPKSNPQPEQVMQQSNLPVNSQWQYAPGPGQQVHYQGHTIHQSPVYYVPGSVPGNHMVQQGNHMVQPGNHMVQPVQMPGQYLQQYHHVPMGYHQPQTHQMAGPGQVYGGTVRPVMMAVDGMNRTGYYGMKTPGPVQMYQHHTGMVVPGVEEQQQYRTETDSDTGRAS

SEQ ID NO: 13219 - protein, 317 aa, Arabidopsis thaliana
MEEDCEFRHWDELIPDALGLIFSHLPLQEVLTVVPRVCKAWNRAVTGPYCWQEIDIELWSNRFHQSDHLDRMLEMLIPRSAGSLRKLSVTGLRNDSIFSFIAQHAGSLKTLKVPRSGLTNSGVVNVAEKLSSLTFLDLSYCCKIGPEAIQAIGKHCKSLREFCRNMHPLDVASVVSHDDEAYAIANTMPKLKRLEIAYHRVSTEGVLKILSCCVFLEFLELRGCWDVQLDNKFFKEKFPDMKVLGPRVIGFYDMINDWEDCCSDYFSDGSDYLAWEFFEDGVMGEFYEDEFEHGWDDNFYAENAVLDMEPHIWPPSP

SEQ ID NO: 13220 - protein, 267 aa, Arabidopsis thaliana
MATPGASSARDEFVYMAKLAEQAERYEEMVEFMEKVAKAVDKDELTVEERNLLSVAYKNVIGARRASWRIISSIEQKEESRGNDDHVSLIRDYRSKIETELSDICDGILKLLDTILVPAAASGDSKVFYLKMKGDYHRYLAEFKSGQERKDAAEHTLTAYKAAQDIANSELAPTHPIRLGLALNFSVFYYEILNSPDRACNLAKQAFDEAIAELDTLGEESYKDSTLIMQLLRDNLTLWTSDMQDDVADDIKEAAPAAAKPADEQQS

SEQ ID NO: 13221 - protein, 258 aa, Arabidopsis thaliana
MVFAHLNLLRKIVGIIGNFIALCLFLSPTPTFVRIVKKKSVEEYSPIPYLATLINCLVWVLYGLPTVHPDSTLVITINGTGILIEIVFLTIFFVYCGRQKQRLIISAVIAAETAFIAILAVLVLTLQHTTEKRTMSVGIVCCVFNVMMYASPLSVMKMVIKTKSVEFMPFWLSVAGFLNAGVWTIYALMPFDPFMAIPNGIGCLFGLAQLILYGAYYKSTKRIMAERENQPGYVGLSSAIARTGSEKTANTNQEPNNV

SEQ ID NO: 13222 - protein, 448 aa, Halomonas halodenitrificans
MQHLEGVTRPQQYRALGLSTLAFTTCFAVWTIFSIIGIQIKQDLGLNETQFGILVATPILTGSISRIFLGIWTEQFGGHRVFSVLMLLTAACVFLLSYVESYAMFLVAALGIGLAGGAFIVGIAYTSYWFEKDKQGTALGIFGAGNAGAAVTNFGAPFLLLALGWERTAVVYAVVLAAVAVGFWVFATEDPLTRARRRGQGAQATSARAQLEPLRHLRVWRFALYYFFVFGAFVALASYLPRYYVGAYGVSIAVAGSLAALYTLPASVFRALGGWMADRYGARAVMYLTFIASLVCLFLLAYPETRYVVQGKEGEIAFTLAMPLWGVVVLTVLLGFFMSLGKAAVFKHIPVYYPENVGSVGGLVGMIGGLGGFFLPILFGIVLDLTGIWTSSYMVIFMLVAVSLIWMHTAIRRMERKNVPELGEERYRYLPEIQEPAEEHARRHGPRP

SEQ ID NO: 13223 - protein, 449 aa, Arabidopsis thaliana
MSQRWSRKKSRLPLAGLLFILVVTFMILFNERSIQQIHHHAASHTQNLREPSTFDFVKPNVPRINYLGAHEVLDRFSKCNSTKEYSGKKIGWVDPFEDHPGQVTKEEQKCDVFSGKWVFDNSSSYPLHKESQCPYMSDQLACQKHGRKDLEYQHWRWQPHACNLKRWNAIEMWEKLRGKRLMFVGDSLNRGQWISMVCLLQSVIPRDKQSMSPNAHLTIFRAEDYNATVEFLWAPLLVESNSDDPVNHRLSERIIRPDSVLKHASKWQHADILIFNTYLWWRQDSVKLRWSSEEKGSCEEVKSAEGMEMAMDSWGDWVANNVDPNKKRVFFVTMSPTHQWSREWNPGSEGNCYGEKKPIEEESYWGSGSDIPTMRMVKRVLERLGPKVSVINITQLSEYRKDGHPSVYRKFWEPLNEDRLKNPASYSDCTHWCVPGVPDVWNQLLFHFL

SEQ ID NO: 13224 - protein, 426 aa, Arabidopsis thaliana
METPGASHDSFRGSPRRNSILSASNIIQAPISTLLEYSGLFRARPSPSHEAETLVSDDSSGLSNGEVAIRIIGNTEQDAETDTNALREPGHSELLGSSATQVDPMGGASEGASQAAPGDPAAGDAASRDSPYQRYDIQQAARWIEQILPFSLLLLVVFIRQHLQGFFVAIWIAAVMFKSNDILKKQTALKGERHISALIGISVAFTAHVVGVYWWFRKDDLLYPLIMLPPKSIPPFWHAIFIIVVNDTLVRQASMIFKCFLLMYYKNSRGRNYRKQGQLLTLVEYFMLLYRSLLPTPVWYRFFLNKDYGSLFSSLMTGLYLTFKLTSVVEKVQSFFTALKALSRKEVHYGSYATTEQVNAAGDLCAICQEKMHTPILLRCKHMFCEDCVSEWFERERTCPLCRALVKPADLKSFGDGSTSLFFQIF

SEQ ID NO: 13225 - protein, 245 aa, Mus musculus
MDKNELVQKAKLAEQAERYDDMAACMKSVTEQGAELSNEERNLLSVAYKNVVGARRSSWRVVSSIEQKTEGAEKKQQVAREYREKIETELRDICNDVLSLLEKFLIPNASQPESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDDAEAGEGGEN

SEQ ID NO: 13226 - protein, 727 aa, Arabidopsis thaliana
MNANEEGEGSRYPITDRKTGETKFDRVESRTEKHSEEEKTNGITMDVRNGSSGGLQIPLSQQTAATVCWERFLHVRTIRVLLVENDDCTRYIVTALLRNCSYEVVEASNGIQAWKVLEDLNNHIDIVLTEVIMPYLSGIGLLCKILNHKSRRNIPVIMMSSHDSMGLVFKCLSKGAVDFLVKPIRKNELKILWQHVWRRCQSSSGSGSESGTHQTQKSVKSKSIKKSDQDSGSSDENENGSIGLNASDGSSDGSGAQSSWTKKAVDVDDSPRAVSLWDRVDSTCAQVVHSNPEFPSNQLVAPPAEKETQEHDDKFEDVTMGRDLEISIRRNCDLALEPKDEPLSKTTGIMRQDNSFEKSSSKWKMKVGKGPLDLSSESPSSKQMHEDGGSSFKAMSSHLQDNREPEAPNTHLKTLDTNEASVKISEELMHVEHSSKRHRGTKDDGTLVRDDRNVLRRSEGSAFSRYNPASNANKISGGNLGSTSLQDNNSQDLIKKTEAAYDCHSNMNESLPHNHRSHVGSNNFDMSSTTENNAFTKPGAPKVSSAGSSSVKHSSFQPLPCDHHNNHASYNLVHVAERKKLPPQCGSSNVYNETIEGNNNTVNYSVNGSVSGSGHGSNGPYGSSNGMNAGGMNMGSDNGAGKNGNGDGSGSGSGSGSGNLADENKISQREAALTKFRQKRKERCFRKKVRYQSRKKLAEQRPRVRGQFVRKTAAATDDNDIKNIEDS

SEQ ID NO: 13227 - protein, 292 aa, Arabidopsis thaliana
MYSAIRSSLPLDGSLGDYSDGTNLPIDACLVLTTDPKPRLRWTSELHERFVDAVTQLGGPDKATPKTIMRTMGVKGLTLYHLKSHLQKFRLGRQSCKESIDNSKDVSCVAESQDTGSSSTSSLRLAAQEQNESYQVTEALRAQMEVQRRLHEQLEVQRRLQLRIEAQGKYLQSILEKACKAIEEQAVAFAGLEAAREELSELAIKASITNGCQGTTSTFDTTKMMIPSLSELAVAIEHKNNCSAESSLTSSTVGSPVSAALMKKRQRGVFGNGDSVVVGHDAGWVMPSSSIG

SEQ ID NO: 13228 - protein, 532 aa, Arabidopsis thaliana
MESSPDPGELIKSSQPSFFEFQKQASLMTSCNLLWKELSEHFTSMEQNLMKKSEALRQMIETLDNQTQSSIELLKHREVTIDHSVEIAEGKVEERVRAALDSLEKARDCGDEDTGEVDDGDGLLSALKSLCLKMDARGFWGFVIARKKELENLRSQIPVALVDCVDPPKLVLEAVSEVFPVDKRGGGEKVSNDFGWACVVILESLIPVMVDPVMGKSRLLVTPSVKEKAKEIAETWKASLEERGGIENVKTPDVHTFLQHLVTFGIVKKDDLALYRKLVVGSAWRKQMPKLAVSVGLGDQMPDMIEELIIRGQQLDAVHFTFEVGLVHLFPPVPLLKAYLRDAKKATALITDDSNNSGRSAHLVARKEQSALRAVLKCIEEYKLEEEFPPENLKKRLDQLEKTKTEKRKPAVIPANKRTRASYSGPMPPAKAGRITNAYVSSFPPPPPTFIRSQSHSPQYGVPAYTTSPPTIYSNRSPPYQYSPEAVHGSYQTSPVSYPTAYGTYCSPVAAPPPPVYHPHPHHHHHIQHAYY

SEQ ID NO: 13229 - protein, 166 aa, Arabidopsis thaliana
MRLLLSSDPQPELTSTCTSHSCGWKPYSHSNDFAANAFLLLIILFCSFICVLSLHAAIRCCLRPVLQHVPKPDPDLEATHPDAPPTLVYSPGLNLAGNEAECIICLSEFQDGDTLRVLERCKHGFHVYCIQKWLSSSHSSCPTCRTNIFSSPPQLHSQSLPLTSTP

SEQ ID NO: 13230 - protein, 188 aa, Arabidopsis thaliana
MLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDRLLVL

SEQ ID NO: 13231 - protein, 985 aa, Arabidopsis thaliana
MMESRSPICNTCGEEIGVKSNGEFFVACHECSFPICKACLEYEFKEGRRICLRCGNPYDENVFDDVETKTSKTQSIVPTQTNNTSQDSGIHARHISTVSTIDSELNDEYGNPIWKNRVESWKDKKDKKSKKKKKDPKATKAEQHEAQIPTQQHMEDTPPNTESGATDVLSVVIPIPRTKITSYRIVIIMRLIILALFFNYRITHPVDSAYGLWLTSVICEIWFAVSWVLDQFPKWSPINRETYIDRLSARFEREGEQSQLAAVDFFVSTVDPLKEPPLITANTVLSILALDYPVDKVSCYVSDDGAAMLSFESLVETADFARKWVPFCKKYSIEPRAPEFYFSLKIDYLRDKVQPSFVKERRAMKRDYEEFKIRMNALVAKAQKTPEEGWTMQDGTSWPGNNTRDHPGMIQVFLGYSGARDIEGNELPRLVYVSREKRPGYQHHKKAGAENALVRVSAVLTNAPFILNLDCDHYVNNSKAVREAMCFLMDPVVGQDVCFVQFPQRFDGIDKSDRYANRNIVFFDVNMRGLDGIQGPVYVGTGTVFRRQALYGYSPPSKPRILPQSSSSSCCCLTKKKQPQDPSEIYKDAKREELDAAIFNLGDLDNYDEYDRSMLISQTSFEKTFGLSTVFIESTLMENGGVPDSVNPSTLIKEAIHVISCGYEEKTEWGKEIGWIYGSITEDILTGFKMHCRGWRSIYCMPLRPAFKGSAPINLSDRLHQVLRWALGSVEIFLSRHCPLWYGCSGGRLKLLQRLAYINTIVYPFTSLPLVAYCTLPAICLLTGKFIIPTLSNLASMLFLGLFISIILTSVLELRWSGVSIEDLWRNEQFWVIGGVSAHLFAVFQGFLKMLAGLDTNFTVTSKTADDLEFGELYIVKWTTLLIPPTSLLIINLVGVVAGFSDALNKGYEAWGPLFGKVFFAFWVILHLYPFLKGLMGRQNRTPTIVILWSILLASVFSLVWVRINPFVSKTDTTSLSLNCLLIDC

SEQ ID NO: 13232 - protein, 507 aa, Arabidopsis thaliana
MDVSNETVERTDLRTPLVDPADTEVKPLPEVGLESVLTESSLSYRRRVYLGACIELKVLFRLALPAILIYLVNSGMGISARVFAGHVGSQELAAASIGNSCFNLVYGLMLGMGSAVETLCGQAYGAHRYEMLGIYLQRATIVLALVGLPMTLLYTFSYPILILLGEPKTVSYMGSKYIAGLIPQIFAYAVNFTAQKFLQAQSVVAPSAFISAAALILQILLTWITVYVMDMGFMGIAYVLTISWWVIVGSQCFYIAVSPKFRHTWTGLSWRSLQGLWSFFKLSAGSAVMICLEMWYSQILVLLAGLLENPARSLDSLSICMSISALSFMVSVGFNAAVSVRTSNELGAGNPKSAWFSTWTATFVSFVISVTEALAVIWFRDYVSYIFTEDADVAKAVSDLCPFLAITIILNGIQPVLSGVAVGCGWQTYVAYVNVGCYYVVGIPVGCILGFTFDFQAKGIWTGMIGGTLMQTLILLYVTYRTDWDKEVEKARKRLDLWDDKKEPLQN

SEQ ID NO: 13233 - protein, 389 aa, Arabidopsis thaliana
MEKTSMFSIHEGKPIRCKAAVSRKPGEALVIEEIHVDPPQAYEVRIKIICTSLCHTDVSFSKIDSGPLARFPRILGHEAVGVIESIGEHVNGFQQGDVVLPVFHPHCEECRDCKSSKSNWCARFADDFLSNTRRYGMTSRFKDSFGEDIYHFLFVSSFSEYTVVDIAHLVKISPDIPVDKAALLSCGVSTGIGAAWKVANVEKGSTVAVFGLGAVGLAVGEGARLRGAGKIIGVDLNPEKFELGKKFGFTDFINSTLCGENKISEVIKEMTGGGVDYSFECVGLPSLLTEAFSSTRTGSGKTVVLGIDKHLTPVSLGSFDLLRGRHVCGSLFGGLKPKLDIPILVDHYLKKELNLDSFITHELKFEEINKAFDLLVQGKSLRCILWMNK

SEQ ID NO: 13234 - protein, 515 aa, Arabidopsis thaliana
MDGADGTVRVKPGRGFETETDVAVSSPVTRQKAAAAKQFIENHYKNYLQGLHERMERRREFQRKVQEAQLPVEEQDEMMRNLARRETEYMRLQRRKIGIDDFELLTVIGKGAFGEVRLCRLRSTSEVYAMKKLKKTEMLSRGQVEHVRSERNLLAEVDSRYIVKLFYSFQDSECLYLIMEYLPGGDIMTLLMREDILSEDVARFYIAESILAIHSIHQHNYVHRDIKPDNLILDKSGHLKLSDFGLCKPLDDKYSSLLLEDDEMLSQDSENQSGKSDADKAPWQMPKEQLLQWKRNRRALAYSTVGTLDYMAPEVLLKKGYGMECDWWSLGAILYEMLVGYPPFCSDDPRITCRKIINWRVCLKFPEEPKISDEARDLICRLLCDVDSRLGTRGVEEIKSHPWFKGTPWDKLYDMEAAYRPIVDGELDTQNFEKFPEVEGSPSEAPQVGPWRKMLTSKDTNFIGFTFKKSDITRSMESSGADMKSNGSGEAPSLISLLGRINMEEGEGGELNHKT

SEQ ID NO: 13235 - protein, 248 aa, Arabidopsis thaliana
MAATLGRDQYVYMAKLAEQAERYEEMVQFMEQLVTGATPAEELTVEERNLLSVAYKNVIGSLRAAWRIVSSIEQKEESRKNDEHVSLVKDYRSKVESELSSVCSGILKLLDSHLIPSAGASESKVFYLKMKGDYHRYMAEFKSGDERKTAAEDTMLAYKAAQDIAAADMAPTHPIRLGLALNFSVFYYEILNSSDKACNMAKQAFEEAIAELDTLGEESYKDSTLIMQLLRDNLTLWTSDMQEQMDEA

SEQ ID NO: 13236 - protein, 665 aa, Arabidopsis thaliana
MKREGEEEEDNNQLSLQEEEPDTEEEMSGRTIEPWTKQITVRGVFVSIVIGVVFSVIAQKLNLTTGIVPNLNSSAALLAFVFVQTWTKILKKSGFVAKPFTRQENTMIQTSAVACYGIAVGGGFASYLLGLNHKTYVLSGVNLEGNSPKSVKEPGLGWMTAYLFVVCFIGLFVLIPLRKVMIVDLKLTYPSGLATAVLINGFHTQGDAQAKKQVRGFMKYFSFSFLWGFFQWFFSGIEDCGFAQFPTFGLKAWKQTFFFDFSMTFVGAGMICSHLVNLSLLLGAILSYGLMWPLLDKLKGSWFPDNLDEHNMKSIYGYKVFLSVALILGDGLYTFVKILFVTIANVNARLKNKPNDLDDVGHKKQRKDLKEDENFLRDKIPMWFAVSGYLTFAAVSTVVVPLIFPQLKWYYVIVAYIFAPSLAFCNAYGAGLTDINMAYNYGKIGLFVIAAVTGRENGVVAGLAGCGLIKSVVSVSCILMQDFKTAHYTMTSPKAMFASQMIGTVVGCIVTPLSFFLFYKAFDIGNPNGEFKAPYALIYRNMAILGVQGFSALPLHCLQMCYGFFGFAVLVNVVRDLTPAKIGRFMPLPTAMAVPFLVGAYFAIDMCVGTLIVFVWEKMNRKKAEFMVPAVASGLICGEGLWTLPAAVLALAGVKPPICMKFLAS

SEQ ID NO: 13237 - protein, 168 aa, Arabidopsis thaliana
MQEQATSSLAASSLPSSSERSSSSAPHLEIKEGIESDEEIRRVPEFGGEAVGKETSGRESGSATGQERTQATVGESQRKRGRTPAEKENKRLKRLLRNRVSAQQARERKKAYLSELENRVKDLENKNSELEERLSTLQNENQMLRHILKNTTGNKRGGGGGSNADASL

SEQ ID NO: 13238 - protein, 216 aa, Arabidopsis thaliana
MNSFSAFSEMFGSDYESPVSSGGDYSPKLATSCPKKPAGRKKFRETRHPIYRGVRQRNSGKWVCELREPNKKTRIWLGTFQTAEMAARAHDVAAIALRGRSACLNFADSAWRLRIPESTCAKEIQKAAAEAALNFQDEMCHMTTDAHGLDMEETLVEAIYTPEQSQDAFYMDEEAMLGMSSLLDNMAEGMLLPSPSVQWNYNFDVEGDDDVSLWSY

SEQ ID NO: 13239 - protein, 216 aa, Arabidopsis thaliana
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 13240 - protein, 213 aa, Arabidopsis thaliana
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTNHGLDMEETMVEAIYTPEQSEGAFYMDEETMFGMPTLLDNMAEGMLLPPPSVQWNHNYDGEGDGDVSLWSY

SEQ ID NO: 13241 - protein, 536 aa, Arabidopsis thaliana
MEAALAACALPSLRILNTKPRFRCSFSNPSLPISPNSLITRKSSRFTTAVSSPPSSSAATSTNSPPEPEALFEPGSDKFDWYANWYPVMPICDLDKKVPHGKKVMGIDLVVWWDRNEKQWKVMDDTCPHRLAPLSDGRIDQWGRLQCVYHGWCFNGSGDCKLIPQAPPDGPPVHTFKQACVAVYPSTVQHEIIWFWPNSDPKYKNIIETNKPPYIPELEDPSFTKLMGNRDIPYGYDVLVENLMDPAHVPYAHYGLMRFPKPKEKIDREGGKPLEINVKKLDNKGFFSKQEWGYSNFIAPCVYRSSTDPLPEQEHEYPAPAASDKAALSKRRLSLIFICIPVSPGRSRLIWTFPRNFGVFIDKIVPRWVFHIGQNTILDSDLHLLHVEERKILERGPENWQKACFIPTKSDANVVTFRRWFNKYSEARVDWRGKFDPFLLPPTPPREQLFDRYWSHVENCSSCKKAHKYLNALEVILQIASVAMIGVMAVLKQTTMSNVARIAVLVAAVLSFAASKWLSHFIYKTFHYHDYNHAVV

SEQ ID NO: 13242 - protein, 298 aa, Arabidopsis thaliana
MLTTPTRFVALRIPFRSSNKIPISIAPSPKVFPRKPVIRVPASLRFVATMSTPAAAVNATVTVTDAGRGSITHVIFDMDGLLLDTEKFYTEVQEKILARYNKTFDWSLKAKMMGRKAIEAARLFVDESGISDSLSAEDFIVERESMLQDLFPTSDLMPGASRLLRHLHGKGIPICIATGTHTRHFDLKTQRHRELFSLMHHVVRGDDPEVKEGKPAPDGFLAASRRFEDGPVDPRKVLVFEDAPSGVQAAKNAGMNVIMVPDSRLDKSYCNVADQVLASLLDFKPEEWGLPSFQDSHN

SEQ ID NO: 13243 - protein, 489 aa, Arabidopsis thaliana
MAAVTQFLSQPSSIRGTLNQYQLNQTSLSRIPFLSLKSTLKPLKRLSVKAAVSQNSTKTLTKESASSFDHCFKKSSDGFLYCEGTKVQDIMETVEKRPFYLYSKPQITRNLEAYKEALEGVRSVIGYAIKANNNLKILEHLRSLGCGAVLVSGNELRLALLAGFDPTKCIFNGNGKSLEDLVLAAQEGVFVNVDSEFDLNNIVEASRISGKQVNVLLRINPDVDPQVHPYVATGNKNSKFGIRNEKLQWFLDEVKAHPKELKLVGAHCHLGSTITKVDIFRDAAVLMIEYIDEIRRQGFEVSYLNIGGGLGIDYYHAGAVLPTPMDLINTVRELVLSRDLNLIIEPGRSLIANTCCFVNHVTGVKTNGTKNFIVIDGSMAELIRPSLYDAYQHIELVSPTPPEAEVTKFDVVGPVCESADFLGKDRELPTPPQGAGLVVHDAGAYCMSMASTYNLKMRPPEYWVEEDGSITKIRHAETFDDHLRFFEGL

SEQ ID NO: 13244 - protein, 569 aa, Arabidopsis thaliana
MAMEVGEMSQPEATASLLSLASATQQPYVSELLSFTLDRLHKEPELLRVDAERIQRQMQEVAVGNYRAFITAADALLAIRQEVSSIDKHLESLIGEVPKLTSGCTEFIDSAENILEKRKMNQALLANHSTLLDLLEIPQLMDTCVRNGNFDEALDLEAFVSKLATLHPKLPVIQALAAEVRQTTQSLLSQLLQKLRSNIQLPECLRIIGYLRRIGVFGEYEMRLQFLRCREAWLTGILEDLDQKNAYEYLKGMINCHRMHLFDVVNQYRAIFSDDTSGSEENYDGGLLFSWAMHQITSHLKTLKIMLPKITEGGSLSNILDQCMYCAMGLGGVGLDFRGLLPPLFEEAVLNLFSKNMSTAVENFQLVLDSHRWVPLPSVGFPSSGINEDSKDDVTPPSYLMEHPPLAVFINGVSSALNELRPCAPLSLKNVVAHELIKGLQAVSDSLLRYNTTRMLRLSESNLFLSLCRAFVEVVFPHCATCFGRCYPGGATIVMDAKSAYEGLGRILAASSSQEPSNKSPKVISTDTKDASENGVASQPEEKQAENPNAKEEDNSPIPLQTPEITPES

SEQ ID NO: 13245 - protein, 254 aa, Arabidopsis thaliana
MSSSIQIVVEEKQVDVLPLQDQDEKKTPQVFNELSFGNHGGCCAICLDTIPLQETAMVKGCEHAYCVTCILRWASYKEKPTCPQCKLPFDFLNVHRALDGSVEDFMFEESVCLLLRASWFQPLEAVERVSDNDNFNYDFDIPPEYEEEDEDDDDLDEFYMQGSSLRLGNRRWGDNGFVRAGRQEARPVQHKNRGGQASGSEPASSSSCEPKEKTSSAITGRRAKRAMKREAANKAAEAVAAAKHEALLVRLGRK

SEQ ID NO: 13246 - protein, 442 aa, Arabidopsis thaliana
MLKIKRVPTVVSNYQKDDGAEDPVGCGRNCLGACCLNGARLPLYACKNLVKSGEKLVISHEAIEPPVAFLESLVLGEWEDRFQRGLFRYDVTACETKVIPGKYGFVAQLNEGRHLKKRPTEFRVDKVLQSFDGSKFNFTKVGQEELLFQFEAGEDAQVQFFPCMPIDPENSPSVVAINVSPIEYGHVLLIPRVLDCLPQRIDHKSLLLAVHMAAEAANPYFRLGYNSLGAFATINHLHFQAYYLAMPFPLEKAPTKKITTTVSGVKISELLSYPVRSLLFEGGSSMQELSDTVSDCCVCLQNNNIPFNILISDCGRQIFLMPQCYAEKQALGEVSPEVLETQVNPAVWEISGHMVLKRKEDYEGASEDNAWRLLAEASLSEERFKEVTALAFEAIGCSNQEEDLEGTIVHQQNSSGNVNQKSNRTHGGPITNGTAAECLVLQ

SEQ ID NO: 13247 - protein, 471 aa, Arabidopsis thaliana
MAFSLLSPIPTSASLFFTLSAITASNNASSSSLSRLYSLYHPKGTLRTRTATSFFGASGNLRIVSMAENRQLVCRIGGGAGAELDDMDEGEIQRIGNEDEDDDEFIQVHANNSSAASPERWDVLGLGQAMVDFSGVVDDEFLKKLGLEKGTRKLINHEERGKLLQAMDGCSYKAAAGGSLSNTLVALARLGSQSICDRPLNVAMAGSIGGDPLGSFYGTKLRRANVNFLSAPIKDGTTGTVIVLTTPDAQRTMLAYQGTSSVVNYDSCLASLIAKTNVFVVEGYLFELPDTIRTITKACEEAHRNGALVAVTASDVSCIERHYDDFWDIVGNYADIVFANSDEARAFCHFSAEESPISATRYMSHFVPFVSVTDGINGSYIGVKGEAIYIPPSPCVPVDTCGAGDAYASGILYGILRGVSDLKGMGDMAATIAATVVGQQGTRLRVQDAVELARSHAFRLNGSGVRTDVGS

SEQ ID NO: 13248 - protein, 251 aa, Arabidopsis thaliana
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGGGGWEGGEQNVTYAHHQAQSQGLYQPLECNPTLQMGYDNPVCSEQITATTQAQAQQGNGYIPGWML

SEQ ID NO: 13249 - protein, 268 aa, Arabidopsis thaliana
MSSDSSREENVYLAKLAEQAERYEEMVEFMEKVAKTVETEELTVEERNLLSVAYKNVIGARRASWRIISSIEQKEDSRGNSDHVSIIKDYRGKIETELSKICDGILNLLEAHLIPAASLAESKVFYLKMKGDYHRYLAEFKTGAERKEAAESTLVAYKSAQDIALADLAPTHPIRLGLALNFSVFYYEILNSSDRACSLAKQAFDEAISELDTLGEESYKDSTLIMQLLRDNLTLWTSDLNDEAGDDIKEAPKEVQKVDEQAQPPPSQ

SEQ ID NO: 13250 - protein, 310 aa, Arabidopsis thaliana
MDGSSFLDISLDLNTNPFSAKLPKKEVSVLASTHLKRKWLEQDESASELREELNRVNSENKKLTEMLARVCESYNELHNHLEKLQSRQSPEIEQTDIPIKKRKQDPDEFLGFPIGLSSGKTENSSSNEDHHHHHQQHEQKNQLLSCKRPVTDSFNKAKVSTVYVPTETSDTSLTVKDGFQWRKYGQKVTRDNPSPRAYFRCSFAPSCPVKKKVQRSAEDPSLLVATYEGTHNHLGPNASEGDATSQGGSSTVTLDLVNGCHRLALEKNERDNTMQEVLIQQMASSLTKDSKFTAALAAAISGRLMEQSRT

SEQ ID NO: 13251 - protein, 488 aa, Arabidopsis thaliana; identical to SEQ ID NO: 1136

SEQ ID NO: 13252 - protein, 518 aa, Arabidopsis thaliana
MFTGYSFGFGDSSEEEVAQHTFFPFLLVSLSPQEYLLCRGLSTLFDRGAQEASLLSLSLSSMPSSATSTYLLSLKQVSLTASSPLLLQLKDRFFHQPKLLNMGFSTGKRKSRDEEEDRVSFFASEFPMDDLNDDVLERVLSWLPTSCFFRMSSVCKRWKSSQTSKSFKLACSQIPTRDPWFFMIDNDSNSSSFVFDSTENSWKNLNRRDFLHHHRQDFIPVASSGGLLCYRCSISGDFLLRNPLTGSSRDIPSQDNNNNKPLQAVAMTTTTVTPSSYTLVTISGEIPNLSFKIYESNADSWSKDQELESVKNNDSSLHDDYDTDSGTVYFLSKQGNVVVASNNLQRSPSKQYSSVITVTDEAEIVYFLSSYGTIVACDLTKRCFTELPKLLLPFLEYSIDLVECEGTMYVILLSEFFESASLRIWRLDNNREWVQVGMLPPALSHELYGKKGDINCVGGAGNKILVCFNASPPEVYCRYFVYDLVAEEWNELPKCFKDGEAVDFVSALSFQPRIEATV

SEQ ID NO: 13253 - protein, 306 aa, Arabidopsis thaliana
MALIGKSERFSADFVMGGAAAIVAKSAAAPIERVKLLLQNQGEMIKTGHLIRPYTGLGNCFTRIYREEGVLSFWRGNQANVIRYFPTQASNFAFKGYFKNLLGCSKEKDGYLKWFAGNVASGSAAGATTSLFLYHLDYARTRLGTDAKECSVNGKRQFKGMIDVYRKTLSSDGIKGLYRGFGVSIVGITLYRGMYFGMYDTIKPIVLVGSLEGNFLASFLLGWSITTSAGVIAYPFDTLRRRMMLTSGQPVKYRNTIHALREILKSEGFYALYRGVTANMLLGVAGAGVLAGYDQLHQIAYKHWVQ

SEQ ID NO: 13254 - protein, 262 aa, Arabidopsis thaliana
MSSLGSSKSLRDEMEVTTADVFPEVNAAAVTENLDRNELVLADGVVSAEERNIEPDNRGERKIESESPPEDDVCPICFGSFTVPCRGNCGHWYCGNCILQYWNYAAISRPCKCPMCVRHITKLSPEPSLQERQEQEVKEVLDKVRRYNRLFVGGLTGFVQKVHELPFLVKRMVWHMMDTDVNNLYFHEVRIFAMFMSTLYTAAEFNFIPTGGFRIVTVFDYAAIAMILILRLVGIYRRRRLAQQVRHLAAAAIEPELEQREL

SEQ ID NO: 13255 - protein, 152 aa, Arabidopsis thaliana
MSSKMIVLMSSDGQSFEVEEAVAIQSQTIAHMVEDDCVADGIPLANVESKILVKVIEYCKKHHVDEANPISEEDLNNWDEKFMDLEQSTIFELILAANYLNIKSLLDLTCQTVADMIKGKTPEEIRSTFNIENDFTPEEEEAVRKENQWAFE

SEQ ID NO: 13256 - protein, 152 aa, Arabidopsis thaliana
MSSKMIVLMSSDGQSFEVEEAVAIQSQTIAHMVEDDCVADGIPLANVESKILVKVIEYCKKYHVDEANPISEEDLNKWDEKFMDLEQSTIFELILAANYLNIKSLFDLTCQTVADMIKGKTPEEIRSTFNIENDFTPEEEEAVRKENQWAFE

SEQ ID NO: 13257 - protein, 214 aa, Ochrobactrum anthropi
TVVATMVLGAIFFNGSDVLSSVMLYPLMICGACVITSIVGTFFVKLSVDGSIMGALYKGLIATGLLSIVGLAVANTLTIGWGEIGTVAGKSITGTNLFICGLIGLIVTGLIVVITEYYTGTNKRPVNSIAQASVTGHGTNVIQGLAVSLESTALPAIVIVGGIISTYQLAGLFGTAIAVTAMLGIAGMIVALDAFGPVTDNAGGIAEMAGLDPE

SEQ ID NO: 13258 - protein, 141 aa, Anaplasma marginale
  unsure (1)..(141): unsure at all Xaa locations
NGSIMGALYKGLIATGLLSIVGLGVANTLTVGWGEIGTVAGKSITGTNLFVCGLIGLIVTGLIVVITEYYTGTNKRPVNSXAQASVTGHGTNVIQGLAVSLESTALPAIVIVGGIIXTYQLAGLFGTAIAVTAMLGIAGMI

SEQ ID NO: 13259 - protein, 106 aa, Narcissus pseudonarcissus
MKGGKSKADTSKKADARLSVKRKAAEKPAKKPVVKKSKAEKDPNKPKRPPSAFFVFMEEFRKQFKEKNPNNKQVSVVGKAAGDKWKSMSATEKAPYEAKAAKRKAE

SEQ ID NO: 13260 - protein, 81 aa, Narcissus pseudonarcissus
TNGDQRTATDAYHFLVNWFERFPQYKFRDFYLAGDSYAGHYVPQLSQLIYRKNKVIQNPFINFKGFMVGNAVTDDYNDLVG

SEQ ID NO: 13261 - protein, 255 aa, Arabidopsis thaliana
MSSVTEIVSEQQVIDGIQDLALQNQDKKKIQEEIHEPSFGNHGGCCAICLSEIPLQETAMVKGCEHTYCVTCILRWASCKESPTCPQCKHPFDFLSVHRALDGSIEDFLFEESVCLLLRASWFVPLDVVEQASYSHGYHDDFDIPYDYEDEDDDLDEFYLHGSSLRIGNRRWGGNGFVRSGRQEARPVQRYSGSGSSSSSSSGSSSSEPKDKQVKTTNTTGRRAKRAMKREAANKAAEVTAAAKHEAHLVRLGRK

SEQ ID NO: 13262 - protein, 118 aa, Arabidopsis thaliana
MATLDSDVTMIPAGEASSSVAASSSNKKAKRFEIKKWSAVALWAWDIVVDNCAICRNHIMDLCIECQANQASATSEECTVAWGVCNHAFHFHCISRWLKTRQVCPLDNSEWEFQKYGH

SEQ ID NO: 13263 - protein, 375 aa, Arabidopsis thaliana
MEGAGETTTSEGHLTSAAAFVEGGIQDACDDACSICLESFCESDPSTLTSCKHEYHLQCILEWCQRSSQCPMCWQSISLKDPTSQELLEAVEQERNFRFNPTRNATIFRHPTLGDFELQHLPVGVDNAEIEERIIQHLAAAAAMGRARHGVRREGHRSRSSSQGHQQFMVFSSQPNASSPPPHPPMPSSPSQRDESDTVSNLPHNALGEGSHQSNTQPPTSSHPRQVSPSASDSNSRPLNQSSPSEQDRAGPSELQSFSESLKSRLNAVSTRYKESISKNTRNWKDRLFSRNTSMADLGSEVKREVSAGIATVSRMMERLETRENSRPSTASVSDVSENHTPETNNEHNRAAAGDEHSVNERGVKETCATGSGSS

SEQ ID NO: 13264 - protein, 337 aa, Arabidopsis thaliana
MFKKMSATTSKTDQKAALDIASWLFNVVTSVGIILVNKALMATYGFSFATTLTGLHFGTTTLLTTFLTWLGYIQPSQLPWPDLLKFVLFANFSIVGMNVSLMWNSVGFYQIAKLSMIPVSCLLEVMLDNVRYSRDTKLSILLVLAGVAVCTVTDVSVNLNGFLAAAIAVWSTALQQYYVHYLQRKYSLGSFNLLAHTAPVQAASLLLVGPFLDYWLTNQRVDAYNFSFVSLFFLILSCSIAVGTNLSQFICIGRFTAVSFQVLGHMKTILVLVLGFTFFGKEGLNLQVVLGMLIAILGMIWYGNASSKPGGKERRSLSIPITKSQKLSETNESDEKV

SEQ ID NO: 13265 - protein, 881 aa, Arabidopsis thaliana
MRGSALLDLILFLLVSPLAHSFKGSEISKFYDKSISNQISQSDRESGYVLVSTVDGSISLVDMSSQKLDWTFHTNEPIYSSYQAPHYHYTTDEERSSVLGDDFYMDCDKDWRLYNSSVRKGKRVNEIVDASEFIGTLPYTSTDRIVLGKKDTSVFLLDWKTGKLVKRYRMDELYSNTVVENDKEKAIVLSKEAPLLFGSGFKKSEDFPELVYIERKDFKIQCISKFGDVLWSVSYAKMEAKLQNHESVQFISGLSSSVGKNQFPLSYTTSVPMVQLRNVKYETLFPRLGFLDEALYLPFQDRKPNQLAIGDGNQLTLPGNKEAEEVLSLPLPETVISQITDIIDGSTKQAGFASKFSGLIVLIFGFCVTMLSVCGLFFYRLRQSIRIKEPYVSEVPIATPKKKKSKKNGTTKAVHKKENGFISGGNKDPSHEENEKRLLTAFPGLNNSSAEGYRVGKLFVSNKEIAKGSNGTVVLEGSYEGRLVAVKRLVQSHHDVAQKEILNLMASDKHSNIVRWYGVDQDEHFIYISLELCACSLNDLIYASSALLESPMASSSIHSIQINPIFENGKGVELWKENGHPSPVLLKLMRDIVAGLVHLHDIGIVHRDLKPQNVLIVKNSSLCAKLSDMGISKRLPADTSALTRNSTGLGSGSSGWQAPEQLRNERQTRAVDLFSLGCVLFFCMTGGKHPYGDNYERDVNVLNDQKDLFLIESLPEAVHLLTGLLNPDPNLRPRAQDVMHHPLFWNSDMRLSFLRDASDRVELENREEGSQLLAALESTAAVTLNGRWDEKLDSIFLDNIGRYRRYKFDSIRDLLRVIRNKLNHYRELPKELQELLGSVPEGFERYFSSRFPKLLIQVYTVLFDYCNNEEFFFKYSKTTVF

SEQ ID NO: 13266 - protein, 667 aa, Arabidopsis thaliana
MWQTWPRQPILLDIFSNPNTLSTTVRSWSVRHPLSIITVKTFARFFLDIFFSPHYYRKNKVLFFALFSFISPLTNILICFVTVSLSLELSSSSSIIDLGFSKLSVCVVIMTSSEEVVEVTVVKAPEAGGGKLSRRKIRKKDAGVDGLVKWERFLPKIALRVLLVEADDSTRQIIAALLRKCSYRVAAVPDGLKAWEMLKGKPESVDLILTEVDLPSISGYALLTLIMEHDICKNIPVIMMSTQDSVNTVYKCMLKGAADYLVKPLRRNELRNLWQHVWRRQTSLAPDSFPWNESVGQQKAEGASANNSNGKRDDHVVSGNGGDAQSSCTRPEMEGESADVEVSARDAVQMECAKSQFNETRLLANELQSKQAEAIDFMGASFRRTGRRNREESVAQYESRIELDLSLRRPNASENQSSGDRPSLHPSSASAFTRYVHRPLQTQCSASPVVTDQRKNVAASQDDNIVLMNQYNTSEPPPNAPRRNDTSFYTGADSPGPPFSNQLNSWPGQSSYPTPTPINNIQFRDPNTAYTSAMAPASLSPSPSSVSPHEYSSMFHPFNSKPEGLQDRDCSMDVDERRYVSSATEHSAIGNHIDQLIEKKNEDGYSLSVGKIQQSLQREAALTKFRMKRKDRCYEKKVRYESRKKLAEQRPRIKGQFVRQVQSTQAP

SEQ ID NO: 13267 - protein, 381 aa, Arabidopsis thaliana
MSASSSSFEQPQVITCNAAVAWRAGEPLVMEEVEVSPPQPLEIRIKVVCTSLCRSDLSAWESQSLLPRIFGHEAAGIVESIGEGVTEFEKGDHVLAVFTGECGSCRHCISGKSNMCQVLGMERKGLMHSDQKTRFSIKGKPVYHYCAVSSFSEYTVVHSGCAVKVDPLAPLHKICLLSCGVAAGLGAAWNVADVQKGSSVVIFGLGTVGLSVAQGAKLRGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKEIMIDEFITHNLSFDEINKAFVLMREGKCLRCVLHMPK

SEQ ID NO: 13268 - protein, 277 aa, Arabidopsis thaliana
MDNHTAKDIGMKRSASELALQEYLTTSPLDPCFDLMNRDYTCELRDSLLWSEGLFPAGPFRDAQSSICENLSADSPVSANKPEVRGGVRRTTSGSSHVNSDDEDAETEAGQSEMTNDPNDLKRIRRMNSNRESAKRSRRRKQEYLVDLETQVDSLKGDNSTLYKQLIDATQQFRSAGTNNRVLKSDVETLRVKVKLAEDLVARGSLTSSLNQLLQTHLSPPSHSISSLHYTGNTSPAITVHSDQSLFPGMTLSGQNSSPGLGNVSSEAVSCVSDIWP

SEQ ID NO: 13269 - protein, 349 aa, Arabidopsis thaliana
MGKGGSLSEGVIKNIIISYTYVAIWIFLSFTVIVYNKYILDKKMYDWPFPISLTMIHMSFCSTLAFLLIKVFKFVEPVSMSRDTYLRSVVPIGALYSLSLWLSNSAYIYLSVSFIQMLKALMPVAVYSIGVLFKKEGFKSETMMNMLSISFGVAIAAYGEARFDVWGVILQLGAVAFEATRLVMIQILLTSKGITLNPITSLYYVAPCCLAFLFIPWIVVEFPILRDTSSFHFDYLIFGTNSFCAFALNLAVFLLVGKTSALTMNVAGVVKDWLLIAFSWSVIKDTVTPINLFGYGIAFLGVAYYNHAKLQALKAKEAQKTAQQVDEETGRLLEEREGNEGGRKNEPED

SEQ ID NO: 13270 - protein, 175 aa, Arabidopsis thaliana
MEEEKRLELRLAPPCHQFTSNNNINGSKQKSSTKETSFLSNNRVEVAPVVGWPPVRSSRRNLTAQLKEEMKKKESDEEKELYVKINMEGVPIGRKVNLSAYNNYQQLSHAVDQLFSKKDSWDLNRQYTLVYEDTEGDKVLVGDVPWEMFVSTVKRLHVLKTSHAFSLSPRKHGKE

SEQ ID NO: 13271 - protein, 1176 aa, Arabidopsis thaliana; identical to SEQ ID NO: 1204

SEQ ID NO: 13272 - protein, 124 aa, Bombyx mori
MSGRGKGGKVKGKVKSRSNRAGLQFPVGRIHRLLRNGNYAERVGAGAPVYLAAVMEYLAAEVLELAGNAARDNKKTRIIPRHLQLAIRNDEELNKLPSGVTIAQGGVLPNIQAVLLPKKTEKKA

SEQ ID NO: 13273 - protein, 255 aa, Arabidopsis thaliana
MSTREENVYMAKLAEQAERYEEMVEFMEKVAKTVDVEELSVEERNLLSVAYKNVIGARRASWRIISSIEQKEESKGNEDHVAIIKDYRGKIESELSKICDGILNVLEAHLIPSASPAESKVFYLKMKGDYHRYLAEFKAGAERKEAAESTLVAYKSASDIATAELAPTHPIRLGLALNFSVFYYEILNSPDRACSLAKQAFDDAIAELDTLGEESYKDSTLIMQLLRDNLTLWTSDMTDEAGDEIKEASKPDGAE

SEQ ID NO: 13274 - protein, 221 aa, Arabidopsis thaliana
MGAFCCCFQVDLFESYVNPNTSITRNCPCLNCFLQSFMDLYASLFSRGGMHPIPSTVETATVMNSTTALDDSLSSVYHSPPTPLPYDADPRYFRFVKGSSHSGEESEPLRGDTEMSSEALGDGGAKWSKSDSEDGSKEVYTKGSSTFTKSKTMPGIEVYYADSDDEDICPTCLDDYTLENPKIITKCSHHFHLSCIYEWMERSETCPVCGKVMAFDENETS

SEQ ID NO: 13275 - protein, 239 aa, Arabidopsis thaliana
MVDAKQVRFIIGVIGNVISFGLFAAPAKTFWRIFKKKSVEEFSYVPYVATVMNCMLWVFYGLPVVHKDSILVSTINGVGLVIELFYVGVYLMYCGHKKNHRRNILGFLALEVILVVAIILITLFALKGDFVKQTFVGVICDVFNIAMYGAPSLAIIKVVKTKSVEYMPFLLSLVCFVNAGIWTTYSLIFKIDYYVLASNGIGTFLALSQLIVYFMYYKSTPKEKTVKPSEVEISATERV

SEQ ID NO: 13276 - protein, 212 aa, Arabidopsis thaliana
MGGCCCCSSSRRADVDNGPAYYYYPRATEERVPLSSAHNRTSSAISTGVVVVDTNLETSSPDAYIPPPLPTPFDVPIGIPQTPASGEEATCVDIREVSVDSANTESAQETVDGITLGVPTTCSHKETDSKIQTEIDLESTEEIDPKLSKAVFIPIEEEEDCPICLEEYDIENPKLVAKCDHHFHLACILEWMERSETCPVCNKEMVFDSTLD

SEQ ID NO: 13277 - protein, 171 aa, Arabidopsis thaliana
MSTVRKITLKSSDGENFEIDEAVALESQTIKHMIEDDCTDNGIPLPNVTSKILSKVIEYCKRHVEAAEKSETTADAAAATTTTTVASGSSDEDLKTWDSEFIKVDQGTLFDLILAANYLNIKGLLDLTCQTVADMIKGKTPEEIRKTFNIKNDFTPEEEEEVRRENQWAFE

SEQ ID NO: 13278 - protein, 350 aa, Arabidopsis thaliana
MENGDIPEDANEHCPGPQSESAGKSDSCAGCPNQEACATAPKGPDPDLVAIAERMSTVKHKILVLSGKGGVGKSTFSAQLSFALAGMDHQVGLMDIDICGPSIPKMLGLEGQEIHQSNLGWSPVYVEDNLGVMSIGFMLPNSDEAVIWRGPRKNGLIKQFLKDVYWGEIDYLVVDAPPGTSDEHISIVQYLLPTGIDGAIIVTTPQEVSLIDVRKEVSFCKKVGVPVLGVVENMSGLSQPLKDVKFMKLATETGSSINVTEDVIACLRKNAPELLDIVACSEVFDSSGGGAERMCREMGVPFLGKVPMDPQLCKAAEQGKSCFEDNKCLISAPALKSIIQKVVPSTVMTE

SEQ ID NO: 13279 - protein, 191 aa, Arabidopsis thaliana
MTEPKRGRVQWDEANIVEIESNKPVRQKITEPKTPYHPMMDDDGSLSPRGRAFDECVDDMQRAEELRNVLNDAAASSSRNSSQGSGGGGWSSSDEEEEEADPMDQDEEGSGSGKNERFNAHRKAHYDEFRKVKELRSSGSFYEEEEEEDDGAKGSKSETTTNSRHTKGGNKELDATKTVSGTSSSSSPELI

SEQ ID NO: 13280 - protein, 609 aa, Arabidopsis thaliana
MEWDSGSDLSADDASSLADDEEGGLFPGGGPIPYPVGNLLHTAPCGFVVTDAVEPDQPIIYVNTVFEMVTGYRAEEVLGGNCRFLQCRGPFAKRRHPLVDSMVVSEIRKCIDEGIEFQGELLNFRKDGSPLMNRLRLTPIYGDDDTITHIIGIQFFIETDIDLGPVLGSSTKEKSIDGIYSALAAGERNVSRGMCGLFQLSDEVVSMKILSRLTPRDVASVSSVCRRLYVLTKNEDLWRRVCQNAWGSETTRVLETVPGAKRLGWGRLARELTTLEAAAWRKLSVGGSVEPSRCNFSACAVGNRVVLFGGEGVNMQPMNDTFVLDLNSDYPEWQHVKVSSPPPGRWGHTLTCVNGSNLVVFGGCGQQGLLNDVFVLNLDAKPPTWREISGLAPPLPRSWHSSCTLDGTKLIVSGGCADSGVLLSDTFLLDLSIEKPVWREIPAAWTPPSRLGHTLSVYGGRKILMFGGLAKSGPLKFRSSDVFTMDLSEEEPCWRCVTGSGMPGAGNPGGVAPPPRLDHVAVNLPGGRILIFGGSVAGLHSASQLYLLDPTEDKPTWRILNIPGRPPRFAWGHGTCVVGGTRAIVLGGQTGEEWMLSELHELSLASYLT

SEQ ID NO: 13281 - protein, 240 aa, Arabidopsis thaliana
MSNPAAVTAGRGSITHVIFDMDGLLLDTEKFYTEVQEIILARFNKKFDWSLKAKMMGRKAIEAARIFVEESGISDSLSAEDFLVERESMLQDLFPTSELMPGASRLIKHLHVKNIPICIATGTHTRHYDLKTQRHRELFSLMHHVVRGDDPEVKQGKPAPDGFLAAARRFKDGPVDSQKVLVFEDAPSGVLAAKNAGMNVVMVPDPRLDISHQDVADQIITSLVDFKPEEWGLPPFEDSN

SEQ ID NO: 13282 - protein, 355 aa, Arabidopsis thaliana
MGFGLESIKSISGGWGAAARSCDACKSVTAAVFCRVDSAFLCIACDTRIHSFTRHERVWVCEVCEQAPAAVTCKADAAALCVSCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSHSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 13283 - protein, 242 aa, Arabidopsis thaliana
MAKLSFKDSLKALEADIQHANTLALDYPREKDGARVQMRLSYSPTAQFFLFLVQWTDCKLAGFLGLLRVLIYMTYADGKTTMSVYERKASIREFQAVILPSLSQLQRGVTDIDDSKQKEVCKMRYRKKDESEMSEIEIEREEECGICMEMNSKVVLPNCTHSLCIKCYRDWRGRSQSCPFCRDSLKRVDSGDLWMFLDQNDTVNLTAIARENQKRLFMYIEKLPLVVPDQVYASSPYDFHVR

SEQ ID NO: 13284 - protein, 495 aa, Arabidopsis thaliana
MCFNNIETGDEVETERQVFGSSEEDEFRVEDTARNTNNVQISQQQQQPLAHVVKWERYLPVRSLKVLLVENDDSTRHIVTALLKNCSYEVTAVPDVLEAWRILEDEKSCIDLVLTEVDMPVHSGTGLLSKIMSHKTLKNIPVIMMSSHDSMVLVFKCLSNGAVDFLVKPIRKNELKNLWQHVWRRCHSSSGSGSESGIHDKKSVKPESTQGSENDASISDEHRNESGSSGGLSNQDGGSDNGSGTQSSWTKRASDTKSTSPSNQFPDAPNKKGTYENGCAHVNRLKEAEDQKEQIGTGSQTGMSMSKKAEEPGDLEKNAKYSVQALERNNDDTLNRSSGNSQVESKAPSSNREDLQSLEQTLKKTREDRDYKVGDRSVLRHSNLSAFSKYNNGATSAKKAPEENVESCSPHDSPIAKLLGSSSSSDNPLKQQSSGSDRWAQREAALMKFRLKRKERCFEKKVRYHSRKKLAEQRPHVKGQFIRKRDDHKSGSEDN

SEQ ID NO: 13285 - protein, 242 aa, Arabidopsis thaliana; identical to SEQ ID NO: 864

SEQ ID NO: 13286 - protein, 210 aa, Arabidopsis thaliana
MVRGKIEMKKIENATSRQVTFSKRRNGLLKKAYELSVLCDAQLSLIIFSQRGRLYEFSSSDMQKTIERYRKYTKDHETSNHDSQIHLQQLKQEASHMITKIELLEFHKRKLLGQGIASCSLEELQEIDSQLQRSLGKVRERKAQLFKEQLEKLKAKEKQLLEENVKLHQKNVINPWRGSSTDQQQEKYKVIDLNLEVETDLFIGLPNRNC

SEQ ID NO: 13287 - protein, 125 aa, Arabidopsis thaliana
MGSMFSGNRMSKEEMEVVVNKAKEIVSAYPVVVFSKTYCGYCQRVKQLLTQLGATFKVLELDEMSDGGEIQSALSEWTGQTTVPNVFIKGNHIGGCDRVMETNKQGKLVPLLTEAGAIADNSSQL

SEQ ID NO: 13288 - protein, 546 aa, Arabidopsis thaliana
MKMASRKTTSLLNHLLLLGALTLLSSLVIVKGESPYKFYTWTVTYGIISPLGVPQQVILINGQFPGPKLEVVTNDNIILNLINKLDQPFLLTWNGIKQRKNSWQDGVLGTNCPIQPNSNFTYKFQTKDQIGTFNYFPSTAFHKAAGGFGAINVYARPGIPIPYPLPTADFTLLVGDWFKTNHKTLQQRLDSGGVLPFPDGMLINGQTQSTFSGDQGKTYMLRISNVGLSSTFNFRIQGHTMKVVEVEGSHVIQTDYDSLDIHVGQSLAVLVTLNQSPKDYYIVASTRFIRSKLSVMGLLRYSNSRVPASGDPPALPPGELVWSMRQARTFRWNLTANAARPNPQGSFHYGMISPTKTFVFSNSAPLINGKQRYAVNGVSYVKSETPLKLADHFGISGVFSTNAIQSVPSNSPPTVATSVVQTSHHDFLEIVFQNNEKSMQSWHLDGYDFWVVGFGSGQWTPAKRSLHNLVDALTRHTTQVYPESWTTILVSLDNQGMWNMRSAIWERQYSGQQFYLKVWNSVQSLANEYNPPDNLQLCGKAVGRHV

SEQ ID NO: 13289 - protein, 909 aa, Homo sapiens
MQALRLRPALMEPGAFSGARPGLGGYSPPPEEAMPFEFDQPAQRGCSQLLLQVPDLAPGGPGAAGVPGAPPEEPQALRPAKAGSRGGYSPPPEETMPFELDGEGFGDDSPPPGLSRVIAQVDGSSQFAAVAASSAVRLTPAANAPPLWVPGAIGSPSQEAVRPPSNFTGSSPWMEISGPPFEIGSAPAGVDDTPVNMDSPPIALDGPPIKVSGAPDKRERAERPPVEEEAAEMEGAADAAEGGKVPSPGYGSPAAGAASADTAARAAPAAPADPDSGATPEDPDSGTAPADPDSGAFAADPDSGAAPAAPADPDSGAAPDAPADPDSGAAPDAPADPDAGAAPEAPAAPAAAETRAAHVAPAAPDAGAPTAPAASATRAAQVRRAASAAPASGARRKIHLRPPSPEIQAADPPTPRPTRASAWRGKSESSRGRRVYYDEGVASSDDDSSGDESDDGTSGCLRWFQHRRNRRRRKPQRNLLRNFLVQAFGGCFGRSESPQPKASRSLKVKKVPLAEKRRQMRKEALEKRAQKRAEKKRSKLIDKQLQDEKMGYMCTHRLLLLGAGESGKSTIVKQMRILHVNGFNGEGGEEDPQAARSNSDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 13290 - protein, 380 aa, Homo sapiens
MGCLGNSKTEDQRNEEKAQREANKKIEKQLQKDKQVYRATHRLLLLGAGESGKSTIVKQMRILHVNGFNGDSEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 13291 - protein, 365 aa, Drosophila melanogaster
MLLARLNHVLSGRPMRLLGQSGCPRLWSSAHPQMNSNSLRTPSLAQGKSVIPKRNMQELGMRKYSRESRDHDRSQLESRTRGPSLKERMMGPPSENAYSMGKGAAAGAALMGLVGLCYYGLGLANQPSIYDNSMVWPQYVRDRIHATYAYFGASCGVTAASAVAFFQSDAMMALMTRSGWVASLVTLGLVMLSGSIAQGLEYQPGFGAKQLAWLVHCAVLGAVLAPMCLLGGPILTKALLYTSGIVGALSTVAACAPSEKFLHMGGPLAIGLGVVFASSLASMWLPPTTAVGAGLASMSLYGGLILFSGFLLYDTQRIVKSAELYPQYSKFPYDPINHALAIYMDALNIFIRIAIILAGDQKRKN

SEQ ID NO: 13292 - protein, 262 aa, Drosophila melanogaster
MSNLYTELKNEWSKHAPNLTHCSRLLDGFKLELVRSNFGTIQTASSSKQKDQLIKSREMLEIAVEHSITIKDYAAFERYMAQLNTYYYDYDKYLESSKHMYKFMGLNLLYMLATNRLADFHIELERLPTALLLHDSFIQPVLALENYYMEGRYNKILQAKKSMPSEIYSNFMDILVNTAREEIASCMEKSYLKMAPKLAAQRLGLRPGSKELFELATKRQWCLDEEGNYDYAGLHTRPMEKVPAKDIATHNLTYAQELEKIV

SEQ ID NO: 13293 - protein, 487 aa, Mustela putorius furo
MATTATCTRFTDDYQLFEELGKCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 13294 - protein, 516 aa, Mustela putorius furo
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSVGRQSSAPASPAASAAGLAGQAAKSLLNKKSDGGVKEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 13295 - protein, 561 aa, Mustela putorius furo
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSVGRQSSAPASPAASAAGLAGQAAKSLLNKKSDGGVKPQSNNKNSLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENREWVRAADILLPAPSPPLPLSLLTFSSSQSPAFPLFDLLGCTLVYAFASLYPEDGLKLTPLKDLLQSPTCTFILQRLCGNTGFTIRVSIPLSLTSFREH

SEQ ID NO: 13296 - protein, 753 aa, Homo sapiens [sequence omitted]

SEQ ID NO: 13297 - protein, 183 aa, Vicia faba
CDASGTMGGACGYGNLYSQGYGTNTAALSTALFNNGLSCGSCYEMRCNDDPRWCKPGSIIVTATNFCPPNPAQANNDGGWCNPPLQHFDMAEPAFLQIAEYRAGIVPVSFRRVPCFKKGGVRFTINGHSYFDLVLVTNVGGAGDVHSISIKGSRTSWQPMSRNWGQNWQSNSYLNGQSLLCGW

SEQ ID NO: 13298 - protein, 533 aa, Lentinula edodes
MLPFVSLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADWFHNTSTELIAAAVAPPADATLINGKGRYLGGPAVPLAVINVQQGKRYRFRMISIACDAYHNFSIDGHRLTVIEVDGENHEPATVDNIQIFPGQRYSFVLTATQPVDNYWVRALSSSGVGFSGFTGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGHSFDVVRSADNTTYNYKNPVRRDVTAVAIGNQTTIRFVTDNPGPWFLHCHIDLHLEFGLAVVMAEAPSLVKATDVTTPAWDELCPIYDSLTPAQLP

SEQ ID NO: 13299 - protein, 548 aa, Lentinula edodes
MFLINVVFGFWLLCVPTSLRLVSGVEIVKSHPRDKIWHEKIDHHDQLFIVNKDIAPDGFQRSTVLAGRTPQDASFPGPLITGRKGDRFTINVTDLLTDPTMDRSTSIHWHGLFQKTTNYADGVAFVSQCPIATNHSFLYDFGVPDQAGTFWYHSHLSVQYGDGLRGPIVIYDPEDPHQDLYDVDDESTIITIADWFHLTSLQLLAALVVPNADATLINGNGRYVGGPDTPLTVINVEHGKRYRFRLIDMSFDAFHGFSIDNHNLTIIEVDGINTLPHTVNFIEIYPAQRYSFVLNANRPISNYRIRALSNTGVGAHNFTNGVNSAILRYVGAPEEEPQTSQPLSSNVMIFREGDLHPLENPGAPGNPYPGGADLVLNFTLGFDAEMVLFSMNGVVFESPTVPVLLQILSGAHHAQDLLPKGGVHTLPPNKVIEINFFGGDAPAGPHPFHLHGHAFDVVRTSDSSEYNFKNPVRRDTTLVAMKNQTTIRFVTDNAGPWFLHCHIDLHLSLGLAVVLAEDTRDTKKDDMIPADWKGLCPIYNSLTPSQLP

SEQ ID NO: 13300 - protein, 630 aa, Oryza sativa (japonica cultivar-group)
MPPYETARAEPASNNKQRPISGETAAGSSRSGPDPMGGEVPEPRRLNRALSFDDWVPDEALHLVMGHVEDPRDREAASRVCRRWHRIDALTRKHVTVAFCYAARPARLRERFPRLESLSLKGKPRAAMYGLIPDDWGAYAAPWIDELAAPLECLKALHLRRMTVTDADIAALVRARGHMLQELKLDKCIGFSTDALRLVARSCRSLRTLFLEECHITDKGGEWLHELAVNNSVLVTLNFYMTELKVAPADLELLAKNCKSLISLKMSECDLSDLISFFQTANALQDFAGGAFYEVGELTKYEKVKFPPRLCFLGLTYMGTNEMPVIFPFSMKLKKLDLQYTFLTTEDHCQIIAKCPNLLILEVRNVIGDRGLEVVGDTCKKLRRLRIERGDDDPGLQEEQGGVSQLGLTAVAVGCRELEYIAAYVSDITNGALESIGTFCKNLYDFRLVLLDRERQVTDLPLDNGVCALLRNCTKLRRFALYLRPGGLSDDGLSYIGQYSGNIQYMLLGNVGESDHGLIRFAVGCTNLQKLELRSCCFSERALSLAVLQMPSLRYIWVQGYRASQTGLDLLLMARPFWNIEFTPPSPESFNHMTEDGEPCVDSHAQVLAYYSLAGRRSDCPQWVIPLHPA

SEQ ID NO: 13301 - protein, 377 aa, Ciona intestinalis
MLDTAGKVITCSAAVAWGPKKPLSIEKIQVAPPKAHEVRIKVMATGVCHTDAFTLSGEDPEAAFPVILGHEGGGIVESVGEGVTEFNESDHVIPLYIPQCKDCNFCRHPKTNLCQKIRTTQGKGFLPDGTSRFTCNGQMVYHYMGTSTFSEYTVVADISLCKVDESAPLDKVCLLGCGIPTGYGAALNTAKVEPGSTCAVWGLGAVGLAVVMGCKAAGATRIIGVDINESKFEIAKQFGATECFNPKESKVSADEAIVALTDGGCDFTFECIGNIHTMRAALQAAHKGWGVSVIIGVAGRGQEISTRPFYLVTGRTWKGTAFGGYKSVEGVPKLVQDYLNKKLKVDEFVTHTMPLCDINKAFDFMHEGKSLRSVINF

SEQ ID NO: 13302 - protein, 377 aa, Ciona intestinalis
MLDTAGKVINCSAAVAWGPKKPLSIEKIQVAPPKAHEVRIKVMATGVCHTDAFTLSGEDPEAAFPVILGHEGGGIVESVGEGVTEFKEGDHVIPLYIPQCKDCNFCRHPKTNLCQKIRTTQGKGFLPDGTSRFTCNGQMVYHYMGTSTFSEYTVVADISLCKVDESAPLDKVCLLGCGIPTGYGAALNTAKVEPGSTCAVWGLGAVGLAVVMGCKAAGATRIIGVDINESKFEIAKQFGATECFNPKESKVSADEAIVALTDGGCDFTFECIGNIHTMRAALQAAHKGWGVSVIIGVAGRGQEISTRPFYLVTGRTWKGTAFGGYKSVEGVPKLVQDYLNKTLKVDEFVTHTMPLCDINKAFDLMHEGKSLRSVINF

SEQ ID NO: 13303 - protein, 274 aa, Trypanosoma brucei
MMTTTDVGGVVRRINVDYKKLKAAYDQNNDSLCLNLVNGLKKQLILLPTFLNPAAASATWLEEVTLTREVLEYAVLVSARLEDLASFELYFNQLSVYYTDIDPTKLKESPLYSLILGLNLVRLLVDDRIAQFHTELEKVPNHIYAPNAYVRFAVLLERYLMEGSYSKLLNSRDQAPSKEYIPIVGMLEKTVRQGVAECIPHSYAKLSFERAQKILMVDSTDAVREIGKQYEWELGKDGASFVFTRREDIAKREVPFQEMLGHHLNFAADLQRIV

SEQ ID NO: 13304 - protein, 440 aa, Hordeum vulgare subsp. vulgare
MVLDLNVESPADSGTSSSSVLNSADAAGAFRFGLLGSPDDDDCSGELAPAAASGFVTRQLFPAPPPAPGVMMGQAPAPPPTAPVWQPRRAEELVVAQRVAPKKKTRRGPRSRSSQYRGVTFYRRTGRWESHIWDCGKQVYLGGFDTAHAAARAYDRAAIKFRGLEADINFNLSDYEEDLKQMRNWTKEEFVHILRRQSTGFARGSSKYRGVTLHKCGRWEARMGQLLGKKYIYLGLFDSEVEAARAYDRAAIRFNGRDAVTNFDSSSYNGDATPDVENEAIVDADALDLDLRMSQPTAHDPKRDNIIAGLQLTFDSPESSTTMVSSQPMSSSSQWPVHQHGTAVPPQQHQRLYPSACHGFYPNVQVQVQERPLEPRPPEPSSFPGWGWHAQAVPPGSSHSPLLYAAASSGFSTAAGANPAPPAVVPRPSPPLLLPRPPDN

SEQ ID NO: 13305 - protein, 323 aa, Rhodococcus fascians
MTSPSTTIRPRPTDADLDAQSPAADLVRVYLNGIGRTALLTAEEEVDLAKRIEAGLYAKQVLENTKRLSAVKKRNLAIIVRDGSAARSHLLEANLRLVVSLAKRYTGRGMPLLDLIQEGNLGLIRAMEKFDYAKGFKFSTYATWWIRQAITRGMADQSRTIRLPVHLVEQVNKLARIKRELHQQLGREATDEELSSESGIAVEKIADLLDHSRDPVSLDMPVGSDEEAPLGDFIEDSEATSAENAVIAGLLHSDVRVVLGTLDEREQQVIRLRYGLDDGQPRTLDQIGKLFGLSRERVRQIEREVMVKLRQGDRAEKLRSYAS

SEQ ID NO: 13306 - protein, 474 aa, Rhodococcus fascians
MVCAGTQPAESEDLSAGNNSGVTPQRLRHERAYVAATDIRQTVDSEPGTATPEPAVKAPAAKAPAKKAPAKRAAAKKAPAKKAAAKKTAAPATGDDVDESTPGIEDIDISEGDLAAAANDVVEGRRRRQPEEDATSEPTAEDKASGDFVWDEEESEALRQARKDAELTASADSVRAYLKQIGKVALLNAEEEVELAKRIEAGLFAVEKMRESAEKGEKLPVAQRRDMTWICRDGNRAKNHLLEANLRLVVSLAKRYTGRGMAFLDLIQEGNLGLIRAVEKFDYTKGYKFSTYATWWIRQAITRAMADQARTIRIPVHMVEVINKLGRIQRELLQDLGREPTPEELAKEMDITPEKVLEIQQYAREPISLDQTIGDEGDSQLGDFIEDSEAVVAVDAVSFTLLQDQLQSVLETLSEREAGVVRLRFGLTDGQPRTLDEIGQVYGVTRERIRQIESKTMSKLRHPSRSQVLRDYLD

SEQ ID NO: 13307 - protein, 560 aa, Xenopus laevis
MRRLSSLMKMAADKQKHHDGRVKIGHYILGDTLGVGTFGKVKVGKHELTGHKVAVKILNRQKIRSLDVVGKIRREIQNLKLFRHPHIIKLYQVISTPTDIFMVMEYVAGGELFDYICKNGKLDEKESRRLFQQILSGVDYCHRHMVVHRDLKPENVLLDAHMNAKIADFGLSNMMADGEFLRTSCGSPNYAAPEVISGRLYAGPEVDIWSCGVILYALLCGTLPFDDDHVPTLFKKICDGIFYTPQYLNPPVISLLKHMLLVDPMKRATIKDIREHEWFKQDLPKYLFPEDPSYSTNMIDDEALKEVCDKCECTEEEVLSCLYSRNHQDPLAVAYHLIIDNRRIMNEAKDFYLATSPPDSFMEEPPISRPHPERVPFLIAESPRQRHTLDELNPQKTKHQVGVRRAKWHLGIRSQSRPNDIMAEVCRAMKQLGYEWKLVNPYYLRVRRKNPVTSMCTKMSLQLYQVDSRTYLLDFRSIDDEVTESKSESATPRRSGSISNYRPPRNDSDPEIQAKSSDGSGPSSLTSSVDSSNADLLPRPGSHTIEFFEMCANLIKILAR

SEQ ID NO: 13308 - protein, 308 aa, Trichoplusia ni
MKLYLLPVALWALVNAISGEPGKAPLKQLNDGNAIPSLALGTFGFGDIPKVRQAVLWAIQAGYRHIDTAALYGNEEEVGKGIADAIQQGLVKREELFVTTKLWNDKHGRHQVVPALRESLTKLGLSYVDLYLIHSPEATNENGDPVDIDVLNTWNGMEEAKKLGLAKSIGVSNFDTALLDRLIAGSNTVPAVNQIEVHPSKTQEKLVADSHERGIEVMAYSPFGFYVSRGSHNNPVKNDRTVADIARKYNKTVNQVLVRYLLERSLIPIPKSTNQQRIRENIDVFDFQLSPEDINAIGKLDKDLSIFD

SEQ ID NO: 13309 - protein, 355 aa, Gibberella zeae
MSRANPPNAAGSRKISFNVSEQYDIQDVVGEGAYGVVCSAIHKPSGQKVAIKKITPFDHSMFCLRTLREMKLLRYFNHENIISILDIQKPRSYESFQEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQVIMW

SEQ ID NO: 13310 - protein, 300 aa, Arabidopsis thaliana
MGAPKQKWTQEEESALKSGVIKHGPGKWRTILKDPEFSGVLYLRSNVDLKDKWRNMSVMANGWGSREKSRLAVKRTFSLPKQEENSLALTNSLQSDEENVDATSGLQVSSNPPPRRPNVRLDSLIMEAIATLKEPGGCNKTTIGAYIEDQYHAPPDFKRLLSTKLKYLTSCGKLVKVKRKYRIPNSTPLSSHRRKGLGVFGGKQRTSSLPSPKTDIDEVNFQTRSQIDTEIARMKSMNVHEAAAVAAQAVAEAEAAMAEAEEAAKEAEAAEAEAEVAQAFAEEASKTLKGRNICKMMIRA

SEQ ID NO: 13311 - protein, 299 aa, Arabidopsis thaliana
MGAPKQKWTPEEEAALKAGVLKHGTGKWRTILSDSEFSLILKSRSNVDLKDKWRNISVTALWGSRKKAKLALKRTPPGTKQDDNNTALTIVALTNDDERAKPTSPGGSGGGSPRTCASKRSITSLDKIIFEAITNLRELRGSDRTSIFLYIEENFKTPPNMKRHVAVRLKHLSSNGTLVKIKHKYRFSSNFIPAGARQKAPQLFLEGNNKKDPTKPEENGANSLTKFRVDGELYMIKGMTAQEAAEAAARAVAEAEFAITEAEQAAKEAERAEAEAEAAQIFAKAAMKALKFRIRNHPW

SEQ ID NO: 13312 - protein, 445 aa, Giardia intestinalis
MEAPSTIKAIKARMIIDSRGTPTTEVELTTQLGVFRAACPSGASTGMHEALELRDKDPSAFRGKGVEQALENIRKIIAPALIGMPVRDQRAIDEKLQELDGTAGKTFSILGANAVLPVSMACCLAAAREEHISLYQYLNRLANSNSSNVTGARDVRLPVPCMNIINGGKHAGNKLGPQEYMIAPTKAKNFMQAMQMGCEVYSKLKEILKDEFGLAATAVGDEGGFAPNVADPEVPLKYITKAIDACGYNGLMGICIDAAASEFYSKNENVYDLNFKDPENPNKVSGAELANIYLGWCRRYPIVSFEDPFDEEDHTTFANFLAALRQEGLPTQVVGDDLTVSQVSHIQKAETYKSCSALLLKINQVGTITGAIDAANLAMSYGWSVMVSHRSGETEDVFIAHLATALGCGQIKSGAPSRSERCAKYNELLRIEDSTKIPYGFEAWK

SEQ ID NO: 13313 - protein, 449 aa, Sorghum bicolor
MGGVLGALLHRRSGGRPPAQGTRNRHLGLTRQPSTYDATAAAAGGHRKAMLSKKYSYIPDTYTSLDQVAAALREQGLESSNLILGIDFTKSNEWTGKQSFGGQSLHRISDDAPNPYEQAISIIGKTLAPFDEDNLIPCFGFGDATTHDNNVFSFHRDNTPCHGFEEVLACYRTVVPHLRLSGPTSFAPIVEAAVDIVDRSGGQYHVLVIVADGQVTRSVDTGDGDLSPQEKRTVDSIVMASSYPLSIVLVGVGDGPWDDMRRFDDKLPARDFDNFQFVNFTSIMSRAATAQQKESAFALAALMEVPIQYKATMELGILGRSTGNAKRVSPAPPPLPNAQRQSSLRRGASNVGAAAAPRDDQVCPICLTNAKDLAFGCGHMVRTDSDISIFHDLITNAMQLQPIETKEKKNLICILIFLCIFVHASNRRAGSVGRASPDARFVDSRYDQS

SEQ ID NO: 13314 - protein, 531 aa, Sorghum bicolor
MERGNNGGSGRPPSPPPTPVERKAAWAWRDGAVTYFHLLFYIAISGGQIFFNKASHAAPHLPTSRSPARSPPGLRPSSPDPPRPWVLSSKEINFPYPVALTLLHMVFSSVVCFAITKVFKYLPELVIFFLLYRSKFICVHAMLVRTHGFIRSLYISSVIPIGAMFAMTLWLGNSAYLYISVAFAQMLKAIMPVAVFLLGAAFGLEEMSYKMLSIMSVISVGVIVASVGEITISWVGVVYQMGGVVAEALRLIFIEIFLKKKGVKLNLISMMYYVSPCSAVCLFIPWLFLEKPKMDDSISWNFPPFTLFLNCLCTFILNMSVFLVISRTSALTARVTGVVRDWSVVLLSAAIFADTQLTFINIIGYAIAIAGVVAYNNHKLKVKPQANPQQDVYAASHDSQPKVPKRILKSSRMEEPDCPEGSVSDRGGERQTASLPLPDAFLEFLSENGLDPAVYSMAATIPRYIRELDLVFFLIPRLKPGMESQITEIESELKCVLEKVSWLPGFYAIPPEIQIAGSKAYQQGKARGIHI

SEQ ID NO: 13315 - protein, 578 aa, Lolium perenne
MAMAISSLLRPWPLAMATMMVLIIQAQGITRHYDFNVQMANVTRLCGTKSIVTVNGQFPGPELIAREGDRVHVRVTNHVAHNMSIHWHGIRQLTTGWADGPAYVTQCPIQTGQTYVYKFTVTGQRGTLWWHAHISWFRATVYGAIVILPKLGVPYPFPAPHEEVPVIFGEWWAADTEDIMSKALKVGGAPNISDAYTINGLPGPLYNCSAKDTFKLKVTPGKTYLLRLINAALNDELFFSVANHTLTVVEVDAVYVKPFTVKTLVISPAMTTNVLLTTSPVYPNANFYMAAAPYSVIRPGTYDNTTVAGILEYHKPGSPSTPGLDKTLPLFKPTLPFFNDTKFVTSFTTKLLSLASKQYPAAVAQSVDRRFFFTIGLGTLPSPKNMTCQGPNGTQFAAAVNNVSLVLPSMALLQSHFTGLSRGVYASNSPAMPLSPFNYTGTPPNNTHVATGTRLLSLPYTTSVELVMQDTSVLGIESHPLHLHGYNFFVVGQGFGNYDPTNDPAKFNLVGPVERNTVGVPAGGWVAIRFLADNPSVWFMHCHLEVHTTWGLRMAWPVQTGPKPNEKLLPPPSDMPKC

SEQ ID NO: 13316 - protein, 579 aa, Lolium perenne
MADMVVLVVAALFLAMGGSINAAVVEHTFLVSEVTLRHLCRDTVATVVNGQLPGPALEVTEGDSVVVHVVNQSPFGVTIHWHGVKQRLTCWADGAGMVTQCPIAPNTTFTYRFDVVGQEGTLWWHAHISTLRATMHGAIIIRPKSGSYPFPKPHQDVPIVIADFWQNDLRQVQKDLELWIADGDHSKDGPASATINGKIGDLYNCSGVSQDDTFVLDVEPGKTYMLRLANAALSNEYYFKVAGHRLTVVGSDANYLRPYNATGDVVAIAPGETLDVLMVADAPPCHSYYMVALGTQSPPPAPQTATRLARGIVRYPDSHGEAMEPQMPDQHDRTTSFHFHGNMTGYPNNPLLPQVRGHVHDKFFLTLGMGTIRNHTVHVANINNVSFHLPQGRSLLEARYHGAELVTATEEMSARPPLEFDYTDPVLINFFNRSAKLLELEPSRRATTMRHIAYNSTVEVVFQSTTLMEDSPNPMHLHGHDFFVLAQGIGNYDAARDTASYNLVDPPVKNTVMVTGLGWAAVRFVADNPGNWFLHCHYEFHMGMGMATVFEVGNGPTPETALPPPPADLPRCDRSIAYE

SEQ ID NO: 13317 - protein, 610 aa, Lolium perenne
MLVVLGEFYTSFDQIYHQIFHFAMQFSPVQSSSPCLMACSSVCYQVQSMRINQLCNSTDIIAVNGQLPGPTIDVFEGDEVVVDVINSSPYNLTIHWHGIMQLRTPWADGPSMVTQCPIQPNSSYIYRFNVTGQEGTLWWHAHSSFLRATVYGAFIIRPRKGNAYPFPMPDQEVPIVLGEWWSQNVVDVENDAVMSGQRPIQSDAYTVNGLTGQLYQCANETFTAVVQPNTTVLLRVINAALNAHLFFKVAGHNFTVVAVDACYTANYTTDTLVLAPGNSVDALIFTDAAPGSYYMAVEPHDTLSPSTVATTDDDSTATGILLYNGTSATATPAMPTMPTNFDTTTANAFYFGLRGLPAAVPSPVDVSITIELGLGQLPCDATQTSCTGKAFAAAMNGVSFRLPTQLSLLEAQFDGKPGVYTADFPDAVPPNGTAMVEGTRVRSLPYNSTVEIVLQNPVALPSENHPIHLHGFNFFVLAQGLGTFTPGNTSAYNLVDPVARNTIAVPTGGWVVIRFLANNPGYWFFHCHLDAHVPMGLGMVFAVENGTTPDSILLPPPDDLPMCRPGSKRRHVAPPPPPPEAKAQPPQSHETNGRPPSNKEGEDITRGGAR

SEQ ID NO: 13318 - protein, 536 aa, Mus musculus
MGLRPAVLLLCASVSLLGGLTFGYELAVISGALLPLQLNFGLSCLEQELLVGSLLLGALLASLVGGFLIDCYGRRRAILGSNAVLLAGSLILGLASSLPWLLLGRLSVGFAISLSSMACCIYVSELVGPRQRGVLVSLYEVGITVGILFSYGLNYVLAGSPWGWRHMFGWAAAPALLQSLSLFLLPAGAEGTAAPKDLIPLQGRETSKPGLVKPQYSFLDLFRAQDGMWSRTVVGLGLVLFQQLTGQPNVLYYASTIFRSVGFHGGSSAVLASVGLGTVKVAATLVATGLVDRAGRRVLLLFGCALMALSVSGIGLVSFAVSLDSGPSCLATSNASQQVDLPGSSGLLVRSSLPPVLHTNGDQGQLVLSVTERPIHPVITASLGPVLNTASPVPTSPILEHTLLCWSALVCMMVYVSAFSVGFGPVTWLVLSEIYPAEIRGRAFAFCSSFNWAANLFISLSFLDLIGAIGLAWTFLLYGLTAVLGLAFIYLLVPETKGQSLAEIEQQFQTSRFPLNFGHRQRIGIQYHRLDVSSAS

SEQ ID NO: 13319 - protein, 380 aa, Homo sapiens [sequence omitted]

SEQ ID NO: 13320 - protein, 244 aa, Xanthobacter flavus
MKRVQDKVALVTGGAMGMGRTHAETLAAEGAYVFVGDRDAAAGKAVADGIVAKGGKAEFLSLDVTKESDWAAAVDTVKAKSGKLNVLVNNAGILVLKPAHETTNDEWDSTFNVNVRGVWLGIRSFVPLMKGNNGSIINISSIYGIVGAPMAGAYIASKGAVRLLTKSCAVDLIQFGIRVNSVHPGVIDTPMTKDLLHGDPAARKAIMGATLFDRPCQPVEVSKAVLFLASDESSFVHGAEMVVD

SEQ ID NO: 13321 - protein, 379 aa, Fagus sylvatica
MAIDCITNITSMPHPPKEEHKDHQKQLVFDASVLRHQTNIPQQFIWPDEEKPRANAPELQVPLIDLRGFLSGDPTAANEASSLVGKACQKHGFFLVVNHGVDDKLIAHAHQYIDYFFELPMSAKQRAQRKVGEHCGYASSFTGRFSFKLPWKETLSFRSSAQPDSSNIVQDYLCNTMGEDFKPFGKVYQDYCDAMSTLSLGIMELLGMSLGVSQGHYREFFEENESIMRLNYYPPCQKPDLTLGTGPHCDPTSLTILHQDQVGGLQVFVDEEWRSITPNFNAFVVNIGDTFMALSNGRYKSCLHRAVVNSKTPRKSLAFFLCPKNDKVVSPPSELVDSLCPRVYPDFTWPMLLEFTQKHYRADVKTLEVFSNWLQQKNS

SEQ ID NO: 13322 - protein, 402 aa, Fagus sylvatica
MEACDCIEPQWPADELLMKYQYISDFFIALAYFSIPLELIYFVKKSAVFPYRWVLVQFGAFIVLCGATHLINLWTFTMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEKCALWMPTRTGLELQLFYTLRQQNPIGYTVPIHLPVINQVFSNNRAVKIAPNCPVARIRPLAGKYVPGEVVAVRVPLLHLSNFQINDWPELSTKRYALMVLMLPSDSARQWHVHELELVEVVADQVAVALSHAAILEESMRARDLLIEQNVALDLARREAETAIRARNDFLAVMNHEMRTPMHAIIALSSLLQETELTPEQRLMVETILKSSNLLATLINDVLDL

SEQ ID NO: 13323 - protein, 635 aa, Fagus sylvatica
MESCDCIETQWHDELLVKYQYISDFLIALTYFSIPLELIYFVQKSAFFPYRWVLMQFGAFIGLCGATHFISLWTFSMHSKAVAVVMTVAKIACAIVSCATALMLVHIIPDLLSVKTRELFLKNKAEELDREMGLILTQEETGRYVRMLTHEIRSTLDRHTILKTTLVELGRTLGLEECALWMPSRTGMNLQLTHTLNSQIQGSTVPLSDSIVNEVFNNARAMRIPYTCPLARFRPLVGRYVLPEVVRVPLLPLSNFQINDWPDLSAKSYAIMVLILPTDGARKWRDYELELVDVVADQVAVALSHAAIIEESMRARDQLMEQNVALDLARREAERAIHARNDFLAVMTHEMRTPMHATIALSSLLLESELSPEQRVVIETVLKSSNLLATLINDVLDLSRLEDGSLELEIGTFNLHGVFREVLNLIKPIASVKKLSMTLLLTPDLPVCAVGDEKRLMQTVLNVAGNALKFTKEGYVSIIASVAKPESFRDWRAPEFYPIASDGHFYLRVQVDKDSGCGILPQDIPHLFTKFTQSQSGSNRRNGGAGLGLAICKRIRFVNIMGGHIWIESEGPDKGSIATFIVKLGICDNPNDSALQQVAPIGRAHNASGDLTGHKPVSRDIVNMDSSNLRYQRSF

SEQ ID NO: 13324 - protein, 375 aa, Fagus sylvatica
MCGGAIISDFIAPTGSRRLTADYLWGDRKKPISGKRFSKPVVDLDDEFELDFQGFKDEEESDIDEEEVLVQDVKPFTFSAPPSSGSKPVKSVEFNGQAEKSAKRKRKNQYRGIRQRPWGKWAAEIRDPRKGVRVWLGTFNTAEEAARAYDAEARRIRGKKSKGNFPMRLPVPKRSVKANLQKPLAKANLNSVQPNLNQNFNFMNSDQDYTMGLMEEKPFTNQYGYMDSIPVNADVGLKSFASNNTAPYFNSDQGSNSFDCSDYGWGEQGSKTPEISSVLSATLEGDESQFVEDAVPTKKLKSDSGNAVFIENNTAKTLSEELSAFESQMNFQMPFLEGSWESNMEALFSGDTTQDGNSMDLWSFDDLPVMAGGVL

SEQ ID NO: 13325 - protein, 114 aa, Methanosarcina mazei
MKYVIAMIRPERLDAVKRELQKIEVSRLTVSSVSGYGAQKGYMEIYRAMEYDANLLEKIKIEIAVNDEFLEPTIEAIKTGAKGSDGYVGSGKIFVLPLENVIRIRTNETGPEAI

SEQ ID NO: 13326 - protein, 825 aa, Triticum monococcum
MAFSPRSPWSRSKKPDIYSTVVVHDDEDNARGGGAARAEDDDDDDPSALPPLLQRLPKDFGGASFDDDDDPYSSDLDDASLSATVVIKRGAPASTSSSSRSPFLDLRRSSPRAAEADPFSTFVVHGTARSGGASSPRESVSGTFIRHSGGPPSPRESVSGTFIRHTRGSSSPHESFSGTFIHHTSSASSPRDSASGAGAGFGSSFITPSSGQAEEDRQPSLLMQQQQSRRKASMSSLPDSVTREDPSTKYELLHELGKGSYGAVYKARDLRTQELVAVKIISLTEGEEGYEDIRGEIEMLQQCSHPNVVRYFGSYQGEEYLWIVMEYCGGGSVADLIGITEEPLDEPQIAYICRETLKGLAYLHTIFKVHRDIKGGNILLTEQGEVKLGDFGVAAQLTRTMSKRNTFIGTPHWMAPEVIQESRYDGKVDVWALGVSAIEMAEGMPPRSTVHPMRVIFMISSEPAPMLEDKEKWSLLFHDFIAKCLTKDARLRPPAIEMLKHKFIEKCNTGASKMLAKIKEAKIIRETAVQNQLPDSDDAMDATVRINEDYGETVPTNSQSTHETKNDGSGGDFGTMIVHPEDGDEAAESSIFPRAEFIPGLGSINSFTHDPKRAELISKFWAESTAESDASKERDLYGLPDIQEPKTMPRSTGTVKHHKGVEGTVLRHDITASPGVASTMNKLSSSPSRKAFSVQDKLWSIYAAGNTVPIPFLKAIDISPLALVSDSVAGNGPAGSSTTDALEAVRELFSGDGQAKKGRKGQNEAPLPPGVHDRLTTSPTLMNLAQALAYHKTCYEDMPLQDSQATEEQQTIQNLCDTLRTILRL

SEQ ID NO: 13327 - protein, 210 aa, Lycopersicon esculentum
MNIFETYYSDSLILTESSSSSSSSSFSEEEVILASNNPKKPAGRKKFRETRHPIYRGIRKRNSGKWVCEVREPNKKTRIWLGTFPTAEMAARAHDVAALALRGRSACLNFSDSAWRLPIPASSNSKDIQKAAAQAVEIFRSEEVSGESPETSENVQESSDFVDEEAIFFMPGLLANMAEGLMLPPPQCAEMGDHCVETDAYMITLWNYSI

SEQ ID NO: 13328 - protein, 606 aa, Delphinium 'MagicFountains dark blue'
MDSCACIETQWPADELLVKYQYISDFFIALAYFSIPLELIYFVQKSAFFPYRWVLMQFGAFIVLCGATHLINLWTFSMHSKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRTGMNLQLSHTLRHQIPVGSTVSTNLPIVTQVFNSNQAIKIPHTCPLARIGPTAGRYVPPEVVAVRVPLLHLSNFQINDWPELSAKSYAVMVLMLPTDSARKWHDHELDLIEVVADQVAVALSHAAILEESMRARDMLMEQNIALDMARREAEMAIRARNDFLAVMNHEMRTPMKAVIALSSLLLEIELTPEQRVMIETVLKNSNLLAALINDVLELSRLEDGSLELDIRTFNLHGIFREVLNMIKPITAVKKLSLTLMLSPDLPVVAVGDEKRLMQIMLNVVGNAVKFTKEGYVSVIASVAKAESLREWQAPEIFMVSSDSHFHLCVQVKDSGCGISPQEIPHLFTKFTQLRSGQNRSNDGAGLGLALCKRFLNLMEGHIWVDSDGTDKGCTVTIIVKLGICEGQPEPSNLQVVSRPRLS

SEQ ID NO: 13329 - protein, 606 aa, Delphinium 'MagicFountains dark blue'
MDSCACIDTQWPADELLVKYQYISDFFIALAYFSIPLELIYFVQKSAFFPYRWVLMQFGAFIVLCGATHLINLWTFSMHSKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRTGMNLQLSHTLRHQIPVGSTVSTNLPIVTQVFNSNQAIKIPHTCPLARIGPTAGRYVPPEVVAVRVPLLHLSNFQINDWPELSAKSYAVMVLMLPTDSARKWHDHELDLIEVVADQVAVALSHAAILEESMRARDMLMEQNIALDMARREAEMAIRARNDFLAVMNHEMRTPMKAVIALSSLLLEIELTPEQRVMIETVLKNSNLLAALINDVLELSRLEDGSLELDIRTFSLHGIFREVLNMIKPITAVKKLSLTLMLSPDLPVVAVGDEKRLVQIMLNVVGNAVKFTKEGYVSVIASVAKAESLRDWQAPEIFMVSSDSHFHLCVQVKDSGCGISPQEIPHLFTKFTQLRSGQNRSNDGAGLGLALCKRFLNLMEGHIWVNSDGTDKGCTVTIIVKLGICEGQPEPSNLQVVSRPRLS

SEQ ID NO: 13330 - protein, 673 aa, Carcinus maenas
MKNRVILMVCVAWCVLGLAAANTSAKQHHTATNTTTTADNETLQRVRIDGSEAHNEAEGEHRLERYPVVVLDFERVQTPFIGLWIFLACLGKIGFHMTPKISHVFPESCMLIVLGVLIGLLLIYTQAATVSPLTADVFFLYLLPPIILDAVYFMPNRLFFDNLFTILVFAVIGTIWNALTIGITMYAISLTGLFGLDIPMLHMFLFSSLISAVDPVAVLAVFEEMQVEEVLFILVFGESLLNDGVTVVLYHLFEGFSELGEANIMAVDIASGVASFLLVALGGTAIGIIWGFLTAFVTRLTSGVRVIEPVFVFVMAYLAYLNAEIFHLSGILSITFCGITMKNYVEQNISAKSHTTIKYAMKMLASSSETIIFMFLGVSTIQSDHQWNTWFVILTILFCSIYRILGVLIFSAVCNRFRVKKIGFVDKFVMSYGGLRGAVAFALVITINPIHIPLQPMFLTATIAMVYFTVFVQGITIKPLVQLLGVKKSEKRSLTMNERLHERVMDYVMSGVEEMIGKQGNLHIRSKFKRFNNKYLTPFLVREKNVIEPKLIETYSNIKKHEAMQQMHNSYNASTNIESFSNLIRNDATHPHVQMNNQGEWNLDVAELEYNPTLRDLNDAKFHHLLSNDYKPVKKNRASTYKRHAVKDDDMQTQSDIGHHNMYLHTHTHTQLL

SEQ ID NO: 13331 - protein, 453 aa, Zea mays
MPACRPRNWRSGETAPRPIPLALVAAAQPLFLTAGSQLLLSPLGIVTKLPQPAAATNAERPPASLHLSEWGLSPPSNRSSGTSSTPSFRRRSLQLLLSFPSFNRCNLHFPWSSLINNVSLQPSFKFYRKCLTNCPYFALTMHSTTKPLGSSMPVKRAHLKPHAADIKRNPHVHELYKLVYRLPENLSWLLAPPEIPKRPASKKKKQKDEIVAGNSFGVILEWEGVVVDDDDPDLEPRVWYVLSLEEGKSFPPDALLKKIEGMRTDQAIAEVLCWSEDPAEIQRLATHKEVIYQKLQGGYYQLRPHVLDFLNTLVGFDIPIAIAAPRSRKSLEEGIKTVGLQGYFDAIVALEDFCLGKPDGEMFEVAAEQLGLEPDACVVFGNSNLTTESAHNAGMRCVAVAGRHPAYELQSANHVVRWLDQLSIVDLQRLANGEVIGRRGRESDMDMEIVIEE

SEQ ID NO: 13332 - protein, 467 aa, Oryza sativa
MVLLNSEEVSCNDHHQVDVVAAAGLQCSGDMLGDKQLVSQVILEGLEIEEPPADEMEAAEKKAGISRLMAGYVQHLQHRSAYHLGYPLNFDYDFSPLAPFLNFSLNNAGDPFAKVNNSVHSRQFEVAVLNWFANFWDVQRDQFWGYITSGGTEGNLYGLLVGRELFPDGILYASNDSHYSVFKAAKMYRVKCIRIATTVSGEMNYADLKSKLQHNTNSPAIINANIGTTFKGAVDDIDQIISTLEKCGFQNRYYIHCDSALSGMMTPFMKQAPKVSFKKPIGSISVSGHKFLGCPMPCGVVITRLEHAEVLSTDIEYIASRDSTITGSRNGHAPIFLWYTLSKKGYKGLLKEVHICMGNARYLEVLLKQVGISASCNTLSNIVVFERPKDERIVCRWQLACEGNLAHIVVMPNVTFEKLTVFVEELAEKRKDWYQDKGFDIPCLAVDIGKENCYCNLHAKKLRIPKM

SEQ ID NO: 13333 - protein, 108 aa, Drosophila melanogaster
MEVDEDGYEVPSSSSKGDKKRFEVKKWNAVALWAWDIVVDNCAICRNHIMDLCIECQANQASATSEECTVAWGVCNHAFHFHCISRWLKTRQVCPLDNREWDFQKYGH

SEQ ID NO: 13334 - protein, 797 aa, Rattus norvegicus
MSTRTPLPTVNERDTENHISHGDGRQEVTSRTGRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARAKFRQIVSAVQYCHQKRIVHRDLKAENLLLDADMNIKITDFGFSNEFTVGSKLDTFCGSPPYAAPELFQGKKYDGPEVDVWSLGVILYTLVSGSLPFDGQNLKELRERVLRGKYRIPFYMSTDCENLLKRFLVLNPVKRGTLEQIMKDRWINAGHEEEELKPFVEPELDISDQKRIDIMVGMGYSQEEIQESLSKMKYDEITATYLLLGRKSAELDASDSSSSSNLSLAKVRPSSDLSNSTGQSPHHKGQRSVSSSQKQRRYSDHAGPAIPSVVAYPKRSQTSTADSDLKEDGVPSRKSGSSAVGGKGIAPASPMLGNASNPNKADIPERKKSPAVPSSNAASGGMTRRNTYVCSERCAADRHSVIQNGKESSLTEVFAYAASPASLCATSTCRLRHQRSMSVSASGHPKMVLPPIDSEGDTFKAITTPDQRTPVASTHSISSATTPDRIRFPRGTASRSTFHGQPRERRTATYNGPPASPSLSHEATPLSQTRSRGSTNLFSKLTSKLTRRLPTEYERNGRYEGSSRNVSSEQKDENREAKPRSLRFTWSMKTTSSMDPSDMMREIRKVLDANTCDYEQRERFLLFCVHGDGHAESLVQWEMEVCKLPRLSLNGVRFKRISGTSIAFKNIASKIANELKL

SEQ ID NO: 13335 - protein, 1047 aa, Saccharum officinarum
GGGGDPRSPVAGASPTKAASPRGPHMNFNPSHYFVEEVVKGVDESDLHRTWIKVVATRNARERSTRLENMCWRIWHLARKKKQLELEGIQRISARRKEQEQVPREPTEDLPEDLSEGHKGDTLGDFPPVETPKKKFQRNFSSLTVWSDDNKEKKLYIVLISVHGLVRGENMELGRDSDTGGQVKYVVELARAMSMMPGVYRVDLFTRQVSSPDVDWSYGEPTEMLCSGSNDGEGMGESAGAYIVRIPCGPRDKYLKKEALWPYLQEFVDGALAHILNMSKALGEQVGNGRPVLPYVIHGHYADAGDVAALLSGALNVPMVLTGHSLGRNKLEQLLKQGRMSKEEIDSTYKIMRRIEGEELALDASELVITSTRQEIDEQWGLYDGFDVKLEKVLRARARRGVSCHGRFMPRMVVIPPGMDFSNVVVPEDIDGDGDNKDDIVGLEGASPKSMAPIWAEVMRFLTNPHKPMILALSRPDPKKNITTLVKAFGECRPLRELANLTLIMGNRDDIDDMSAGNDSVLTTVLKLIDKYDLYGSVAFPKHHNQTDVPEIYPLATKMKGVFINPALVEAFGLTLIESAAHGLPIVATKNGGPVDITTALNNGLLVDPHDQNAIADALLKLVADKNLWQECRRNGLRNIHLYSWPEHCRTYLTRVAGCRLRNPRWLKDTPADAGADEEEFLEDSMDAQDLSLRLSIDGEKSSLNTNDPLSLDPQHQVQKIMNKIKQSSALPPSMSSNAAEATGSTMNKYPPLRRRRRLFVIAVDCYQDDGRASKKMLQVIQEVFRAVRSDSQMSKISGFALSTAMPLSETLQLLQLGRIQATDFDALICGSGSEVYYPGTANCIDAEGKLRPDQDYLMHISHRWSHDGVRQTIAKLMASQDGSDDGVELDVASSNAHCFAFLIKDPKKVKTVDELRERLRMRGLRCHIMYCRNATRLQVVPLLASRSQALRYLFVRWGLSVGNMYLITGEHGDTDLEEMLSGLHKTVIVRGVTEKGSEALVRSPGSYKRDDVVPSETPLAAYTTGELKADEIMRALKQVSKTSSGM

SEQ ID NO: 13336 - protein, 963 aa, Saccharum officinarum
MAGNDNWINSYLDGILDAGKAAIGGNRPSLLLRERGHFSPARYFVEEVITGYDETDLYKTWLRANAMRSRREEHALENMTWRIWNLARKKKEFEKEEACRLSKRQPETEKTRADATADMSEDLFEGEKGEDAGDPSVAYGDSTTGSSPKTSSIDKLYIVLISLHGLVRGENMELGRDSDTGGQVKYVVELAKALSSSPGVYRVDLLTRQILAPNFDRSYGEPAELLVSTSGKNSKQEKGENSGAYIIRIPFGPKDKYLAKEHLWPFIQEFVDGALSHIVRMSKAIGEETGRGHPVWPSVIHGHYASAGIAAALLLGALNLPMAFTGHFLGKDKLEGLLKQGRQTREQINMTYKIMCRIEAEELSLDASEIVIASTRQEIEEQWNLYDGFEVILARKLRARVKRGANCYGRFMPRMVIIPPGVEFGHIIHDFDMDGEEENPSPASEDPPIWSQIMRFFTNPRKPMILAVARPYPEKNITTLVKAFGECRPLRELANLTLIMGNREAISKMHNMSAAVLTSVLTLIDEYDLYGQVAYPKHHKHSEVPDIYRLAARTKGAFVNVAYFEQFGVTLIEAAMNGLPIIATKNGAPVEINQVLNNGLLVDPHDQNAIADALYKLLSDKQLWSRCRENGLTNIHQFSWPEHCKNYLSRILTLGPRSPAIGNREERSNTPISGRRQIIVISVDSVNKEDLVRIIRNAIEVIHTQNMSGSAGFVLSTSLTISEIHSLLLSGGMLPTDFDAFICNSGSNIYYPSYSGETPNNSKITFALDQNHQSHIEYRWGGEGLRKYLVKWATSVVERKGRTERQIIFEDPEHSSAYCLAFRVVNPNHLPPLKELRKLMRIQSLRCNALYNHSATRLSVVPIHASRSQALRYLCIRWGIEVPNVAVLVGESGDSDYEELLGGLHRTVILKGEFNTPANRIHTVRRYPLQDVVPLDSSNITGVEGYTTDDLKSALQQMGILTQ

SEQ ID NO: 13337 - protein, 187 aa, Homo sapiens
MPVDLSKWSGPLSLREMDERSQHLLHVTYARAVVDELGKVLTPTQVKNRPTSISWDGLDSGKLYTLVLTDPDAPSRKDPKYREWHHFLVVNMKGNDISSDTLLSDYVGSGPPKGTGLHRYVWLVYEQDRPLKCDEPILSNRSGDHRGKFEVVSFRKKYELGAPVAGTCYQAEWDDYVPKLYEQLSGN

SEQ ID NO: 13338 - protein, 499 aa, Escherichia coli
MTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADRLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPDWLDGWCETKSVCVRY

SEQ ID NO: 13339 - protein, 358 aa, Homo sapiens
MDELFSQVDEKRKKYDIPKYLCCKISFELMRELCITPTGISYDRKDIEEHLQRVDHFDPVTWSPLTQKQFIPNLAMKEAGEKAWGSLSHGSPILIPVLVETQSNLRQHPFPPELPFPKLLLDVQELPYPVSSDERRQKLEMPDWHGSSQEGPTSWISNWSAPHSKTMQVPKCDDLRHTTTEISEMNRNISWLQAEIEGLKGQKASLEAAVADAEQRGELAIKDANAKLSELEAALQRAKQDMAWQLHEYQELMNIKLALDMEIATYRKLLEGKDSRLESGMQNMSIHTKTTSSYAGGLSSAYGGLTSPSLSYGLGSSFGSGVGSSSFSHSSSTRAVVVKKIQTRNGKLVSESSDVLRK

SEQ ID NO: 13340 - protein, 90 aa, Homo sapiens
MLVKNNHLSDKIIVLPGKTEDVSLPEAVDVIISEPMGYMLFNERMLESYLHSKKWLKSNGMMFPTFSDIHLAPFSDEQLYVEHFSRANFW

SEQ ID NO: 13341 - protein, 353 aa, Limulus polyphemus
MACCLSEEGKEQKRINQEIERQLRKDKRDARRELKLLLLGTGESGKSTFIKQMRIIHGQGYSDDDKKSYIKLVYQNIIMAMQSMNKAMEMLKISYKDRNNIENAELVLSVDYETVTTFDSPYVEAIKSLWVDPGIQECYDRRREYQLTDSAKYYLNDIDRIAVPNYLPTQQDILRVRVPTTGIIEYPFILDSIIFRMVDVGGQRSERRKWIHCFENVTSIIFLVALSEYDQILFESDNENRMEESKALFKTIITYPWFLNSSVILFLNKKDLLEEKIMFSHLVDYFPEYDGPKKDAVQGREFILKMFVDLNPDSEKIIYSHFTCATDTENIRFVFAAVKDTILQLNLKEYNLV

SEQ ID NO: 13342 - protein, 420 aa, Homo sapiens
MPRASRVPVAASLPLSHAVIPTQLPSRPGHRPPGRPRRCPKASCLPPPVGPSSTQTAKRVTMGWPRPGRALVAVKALLVLSLLQVPAQAVVRAVLEDNSSSVDFADLPALFGVPLAPEGIRGYLMEVKPANACHPIEAPRLGNRSLGAIVLIRRYDCTFDLKVLNAQRAGFEAAIVHNVHSDDLVSMTHVYEDLRGQIAIPSVFVSEAASQDLRVILGCNKSAHALLLPDDPPCHDLGCHPVLTVSWVLGCTLALVVSAFFVLNHLWLWAQACCSHRRPVKTSTCQKAQVRTFTWHNDLCAICLDEYEEGDQLKILPCSHTYHCKCIDPWFSQAPRRSCPVCKQSVAATEDSFDSTTYSFRDEDPSLPGHRPPIWAIQVQLRSRRLELLGRASPHCHCSTTSLEAEYTTVSSAPPEAPGQ

SEQ ID NO: 13343 - protein, 509 aa, Homo sapiens
MADYLISGGTRYQPEDGLTAQQLFASADDLTYNDFLILPGFIDFLAGEVDLTSALTRKITLKTPLISFPTDTVIEADMAIAMALMGGIGFIHHNCTPEFQANKVQKVKKFEQGFITDPVVLSPLHTVGDVLEAKMRHGFSGIPITETGTIGSKLVGILTSRDIDFLAEKDHTPSSVRMELVVAPAGVTFKEANEILQRSKKGKLPVVNDHDELVAIIARTDLKKNRDYPLASKDSHKQLLCGAVVGTCEDDKFRLGLLTQAGVDVIVLDSSQGNSVYQIAMVRYIKQKYPHLQVIGRNVVTAAQAKNLIDAGVDGLHVGMGCGSICITLEMMACGRTHGTAVYKVAEYAWRFGVPIIADGGIQTVGHVVKALALGASTVMMGSLLATTTEASGEYFFSDGVPLKKYQGMGSVDAMEKSSSSQKRYFSEADKVKFSQGILGSIQDKGSIQKFVPYLIAGIQHSCQDIGARSLAVLRSMMYSGELKFEKGTVSAQIEGGVHGLHSYERWLY

SEQ ID NO: 13344 - protein, 341 aa, Homo sapiens
MADYLISGSTRYVSEAGLTAQQLFASADGLTYNDFLILPGFIGFITDEVDLTSALTRKITLKTPLTSSSMGTVTDADMAIANKVQKVKKFEQGFITDPVVLSPSHTVGDVLEAKMRHGFSGIPITETGTIGSKLVGIIASRDIDFLAEKDTILLSEMMTPRTELDFHKQLLCGAVVGTREDDKFCLDLLTQAGVDVIVLDSSQGNSVYQIATVHYIKQKYLHLQQPSVGMGCGSICITGEVMACGQTHGTAVYKVAEYVWRFGVPVIADGSIQTVGYMVKALALGASTVLALGASTVMTGSLLAATTEASGEYFFSDRVWLRKYRGMGSLDAMEKSSSTQK

SEQ ID NO: 13345 - protein, 608 aa, Homo sapiens
MAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLANTGIVNHTHSRMGSIMSTGIVQGSSGAQGSGGGSTSAHYAVNSQFTMGGPAISMASPMSIPTNTMHYGS

SEQ ID NO: 13346 - protein, 342 aa, Homo sapiens
GATHRLLLLGAGESGKSTIVKQMRILHVNGFNGDEKATKVQDIKNNLKEAIETIVAAMSNLVPPVELANPENQFRVDYILSVMNVPDFDFPPEFYEHAKALWEDEGVRACYERSDEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 13347 - protein, 355 aa, Sporothrix schenckii
MGACMSSNSEEVEQKKRSQKIDKDLEEDSKRLRRECKILLLGSGESGKSTIVKQMKIIHLKGYSEDELFSYRPTVFKNLLECAKAVINAMRQFEIELESDEIRAYCDFLLDYSIGSGPQPSIDPKVGEAVLALWEDPVRGQLMERQTEFYLMDSAGYFFDEVRRIVHPDYIPNEMDVLRARTKTTGIYETRFQMGPLSIHMFDVGGQRSERKKWIHCFEDVTSIIFCVALSEYDQVLLEESSQNRMMESLLLFDSVVNSRWFMRTSIILFLNKVDIFKQKLGRSPLGNYFPDYSGGDDANKAAKYLLWRFNQVNRAHLNLYPHLTQATDTSNIRLVFAAVKETILNNALKDSGIL

SEQ ID NO: 13348 - protein, 261 aa, Mus musculus
MAATAREDGVRNLAQGPRGCEHYDRACLLKAPCCDKLYTCRLCHDTNEDHQLDRFKVKEVQCINCEKLQHAQQTCEDCSTLFGEYYCSICHLFDKDKRQYHCESCGICRIGPKEDFFHCLKCNSCLTTNLRGKHKCIENVSRQNCPICLEDIHTSRVVAHVLPCGHLLHRTCYEEMLKEGYRCPLCMHSALDMTRYWRQLDTEVAQTPMPSEYQNVTVDILCNDCNGRSTVQFHILGMKCKLCDSYNTAQAGGRRVPVDQQ

SEQ ID NO: 13349 - protein, 378 aa, Mus musculus
MSLSKKRKLESGDSGGAGAGGEGAEEENGGEQEAAPPRPRRTKSERDQLYYECYSDVSVHEEMIADQVRTEAYRLGILKNWAALRGKTVLDVGAGTGILSIFCAQAGARRVYAVEASAIWQQAREVVRLNGLEDRVHVLPGPVETVELPERVDAIVSEWMGYGLLHESMLSSVLHARTKWLKEGGLLLPASAELFVAPISDQMLEWRLGFWSQVKQHYGVDMSCMESFATRCLMGHSEIVVQDLSGEDVLARPQRFAQLELARAGLEQELEAGVGGRFRCSCYGSAPLHGFAVWFQVTFPGGDSEKPLVLSTSPFHPATHWKQALLYLNEPVPVEQDTDISGEITLLPSPDNPRRLRILLRYKVGDHEEKTKDFAMED

SEQ ID NO: 13350 - protein, 237 aa, Camelpox virus
MAMPSLYACSSIEDDFNYGSSVASASVHIRMAFLRKVYGILCLQFLLTTATTAVFLYFDCMRKIIQGSPVLILASMFVSIGLIFALTLHRHKHPLNLYLLCGFTLSESLTLASVVTFYDVHVVMQAFMLTTAVFLALTAYTLQSKRDFSKLGAGLFVTLWILILSGLLRIFVQSETVELVLSAFGALVFCGFIIYDTHSLIHKLSPEDYVLASINFYLDIINLFLHLLQLLEVSNKK

SEQ ID NO: 13351 - protein, 767 aa, Tolypothrix sp. PCC 7601
MVSEFQAQSINVNSLKEAAIHVCSQIQPHGVLLVLGEPELNILQISSNTWSVFGILPEDVLQKKLEDLLDPFQIERIKAGILEGNLDYINPTKIWVRKKGDEYVVFDAVFHRNPEGLLILELEPAISQENIPFLSFYHLARASINQLEKTTNLRDFCQIIVQEVRKVTGFDRVMLYKFDDDGHGSVIAEEKLDSMEPYLGLHYPESDIPKPARKLFASNFIRLIPDAHAEPVQILPINHPQSQQPIDLTNSILRTAANCHLEYLHNMGVGASLTISLIKDGKLWGLIACHHQTPKYVSYEFRKACEFLGRVIFTEISTREETEDYDYRMNLAYIQTVLVEYMSQEENFIDGLVKHQPNLLNLTSAQGAAVCFGDRCTVIGQTPKEEDLNFLLQWLKNNVREEVFYTDSLPRIYPDAEKFKNVASGLLAIPISKRNYVLWFRPEVIQTVNWGGNPNEAFEVSQTEGNLRLVPRKSFELWKENVQLTSLRWKAVEIKAALELRKAIINIVLRQADELAQLAHDLERSNAELKKFAYVASHDLQEPLNQVANYVQLLEMRYENELDEDAKEFINFAVEGVSLMQTLIDDVLAYSKVDMQASAFQLTEVETPLNRSLSNLRGRIHETGAMITHDPLPTVMADSTQLMQLFQNLIANAIKFRSEQPPKIHIGAERLEDEWLFSVQDNGIGLEPRFSDRIFVIFQRLHTREEYPGTGMGLAICKKIIECHRGRIWVESQLGEGATFYFTIPVGGRERERRNGRQTQKDLFGRG

SEQ ID NO: 13352 - protein, 765 aa, Tolypothrix sp. PCC 7601
MLQLIYNNFIVSLSPENSPENAAIAPFEVDLTNCDREPIHIPGSIQPHGMLLALTEPELTIVQVSRNTDEILGVAATEFINQPLSRLLDAQQIDFFRNCLAQEDLTLVNPIELTIAVGENARAFDGIIHRSDRLLILELEPVLHQKNYTFFNFYHLVKAALSKVQNASTLDELCQIIVKHVRQMNGFDRVMIYRFDENWHGTVIAEDKSAHLSPYLSLRYPASDIPKQARQLYRDNWLRLIPDVDYQPVALLPHHNPVTNQPTDLSHSVLRSVSPLHIEYLHNMGVKASMSISLLKNQKLWGLIACHHESPKYVPYEIRSACEFLGQMTSLELAAKEDSENTEYKMQLKAVQSKLVEYMAAANNFVDGLIGQEPNLLDLVNATGAAVCINGEYQTLGRTPQHREIEQLINWLSQHTQEEVFHTNCLSELLPEASEWKDVASGLMALSISKSQKSYLLWFRPEALQTVDWAGNPHKPVELADDGSLRLSPRKSFDLWKEIVQRQSLPWESYEIEAVWNFRSAIVGVVLRKADELAKMNVELQRSNDELDAFAYIASHDLKEPLRGIHHYSSFLIEDYGNRLDDEGIGRLRTLIRLTQRMENLIDSLLHFSRLGRVELGIQPTDLNDLVQRVIDVLSARIQETGATIRIPRPLPTIMCDRVQVSAIFTNLIANGIKYNDKPEIWVEIGYLEPITLYVRDNGIGIRDRHFESIFRIFKRLHGPTQYGGGTGAGLTIAKKVVERHGGKIWVESTYGEGSTFYFTLQEVK

SEQ ID NO: 13353 - protein, 165 aa, Microsporum canis
MAAAATSKITLTSSDGVDITIDRQVAERSILIKNMLKDLGDSGEAIPIPNVNESVLKKVIEWCKHHKGDPPSTGDDDVDSRRKTTDIDEWDQKFMQVDQEMLFEIILAANYLDIKALLDVGCKTVANMIKGKSPEEIRKTFNIQNDFTPEEEDQIRRENEWAEDR

SEQ ID NO: 13354 - protein, 370 aa, Pseudoalteromonas tunicata
MIPNQWYAILRTQDVKKKPVGIKRLEKLLVLYRDTAGELVCLDDRCPHKGVKLSLGQQHGDLIACPYHGFQYDQQGDCVHMPVLGQKGNVPKGMCVKSYKVKEELGLIWFWFGDVRQEHEYPDIPMFKQLKEYKGHYSYYGWDAPINYTRYVESVCEIYHIPFVHKGSAINIWDPKGGRVDNFECKVEDTLITSDFILRPDDDRTAEETLVARKPWTRGWRFGIDVQMPNLILIRSDVFDVIFIPTPIDENTCWVCVCYQEPKRDLLLPLIKPLPIPFWGPVRPWYMCRIERFVQQAKDMAVIAHQEPKVSHPKANRLIPLDKVNAHYIRFREKLIREAKEQQQVKELAKSNPEFAAPTLEQIIGIEEVH

SEQ ID NO: 13355 - protein, 744 aa, Bombyx mori
MRVCFDNLCFGSSQRGAADDEPRALVNTGGGALTVAPTVNGERRALDETYREIELNGIMGTPTAMNAESENCVANATMANDMQPLIERIKELEALLKQRDQEMLELRSQLDKLQSVFPYQQYARGSRGPRKQRAQGISAEPQNSASLQDLTHQTFPIYDKSETSRELIKTAILDNDFMKNLEMTQIREIVDCMYPVEYAAGSIIIKEGDVGSIVYVMEEGRVEVSRENKYLSTMAPGKVFGELAILYNCKRTATIKAATDCRLWAIERQCFQTIMMRTGLIRQAEYTDFLKSVPIFKNFPEDTLIKISDVLEETHYQNGDYIIRQGARGDTFFIISKGQVKVTQKLPNSNDEKFIRTLTKGDFFGEKALQGDDLRTANIVCDSPDGTTCLVIDRETFNQLISTLDEIRTKYKDLGDDRQRLNEEFANLRLSDLRIIATLGIGGFGRVELVQIQGDSSRSFALKQMKKAQIVETRQQQHIMSEKEIMSEMNCEFIVKLYKTFKDRKYLYMLMETCLGGELWTILRDRGQFDDATTRFYTACVVEAFHYLHSRNIIYRDLKPENLLLDSKGYVKLVDFGFSKKLQASRKTWTFCGTPEYVAPEVIMNRGHDISADYWSLGVLMFELLTGSPPFTGSDPMKTYNKILKGIDAVEFPRCITRNAANLIKKLCRDNPAERLGYQRGGITEIQKHKWFDGFNWEGLAQRSLEPPIVPTVNSAIDTHNFDQYPADADEPPPDDLSGWDANF

SEQ ID NO: 13356 - protein, 738 aa, Bombyx mori
MRVCFDNLCFGSSQRGAADDEPRALVNTGGGALTVAPTVNGERRALDETYREIELNGIMGTPTAMNAESENCVANATMANDMQPLIERIKELEALLKQRDQEMLELRSQLDKLQSVFPYQQYARGSRGPRKQRAQGISAEPQNSASLQDLTHQTFPIYDKSETSRELIKTAILDNDFMKNLEMTQIREIVDCMYPVEYAAGSIIIKEGDVGSIVYVMEEGRVEVSRENKYLSTMAPGKVFGELAILYNCKRTATIKAATDCRLWAIERQCFQTIMMRTGLIRQAEYTDFLKSVPIFKNFPEDTLIKISDVLEETHYQNGDYIIRQGARGDTFFIISKGQVKVTQKLPNSNDEKFIRTLTKGDFFGEKALQGDDLRTANIVCDSPDGTTCLVIDRETFNQLISTLDEIRTKYKDLGDDRQRLNEEFANLRLSDLRIIATLGIGGFGRVELVQIQGDSSRSFALKQMKKAQIVETRQQQHIMSEKEIMSEMNCEFIVKLYKTFKDRKYLYMLMETCLGGELWTILRDRGQFDDATTRFYTACVVEAFHYLHSRNIIYRDLKPENLLLDSKGYVKLVDFGFSKKLQASRKTWTFCGTPEYVAPEVIMNRGHDISADYWSLGVLMFELLTGSPPFTGSDPMKTYNKILKGIDAVEFPRCITRNAANLIKKLCRDNPAERLGYQRGGITEIQKHKWFDGFNWEGLAQRSLEPPIVPTVNSAIDTHNFDQYPSEVRSSVSIFDV

SEQ ID NO: 13357 - protein, 539 aa, Homo sapiens
HEAEAGFLAEAELLNLRKISSDLDGHPVPKQAFTDVATGSLGQGLGAACGMAYTGKYFDKASYRVYCLLGDGELSEGSVWEAMAFASIYKLDNLVAILDINRLGQSDPAPLQHQMDIYQKRCEAFGWHAIIVDGHSVEELCKAFGQAKHQPTAIIAKTFKGRGITGVEDKESWHGKPLPKNMAEQIIQEIYSQIQSKKKILATPPQEDAPSVDIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 13358 - protein, 204 aa, Lycopersicon esculentum
MARAQQRYRGVRQRHWGSWVSEIRHPLLKTRIWLGTFETAEDAARAYDEAARLMCGPRARTNFPYNPNMPQTSSSKLLSTTLTAKLHKCYMASLQMTKTSPQGQKLAKNATNVQESVINSYKMKQQMLVPKPSVLLTHHDHHEEAKVVNLGVGVIRKVEDQVLEGIPQFVKPLEDDHIEQMIEELLDYGSIELCSNVVPSHQIQ

SEQ ID NO: 13359 - protein, 239 aa, Phalaenopsis equestris
MDSSSMEPKEKMGRGKIEIKRIENTTNRQVTFCKRRNGLLKKAYELSVLCDAEVALIIFSTRGRLYEYANNSVKGTIERYKKASTDNSNTGSISEANSQYYQQEATKLRQQITNLQNSNRNLLGDALTTMSLRDLKQLETRLEKGINKIRAKKNELLHAEIDYMQKREMELQTDNMFLRNKISDNERAQQQHQHMSILPSTSTEYEVMPPFDSRSFLHVNLMDPNDRYSHQQQTALQLG

SEQ ID NO: 13360 - protein, 1419 aa, Caenorhabditis elegans
MAKEFQFNWKPTIIPELLHGSVFDRYDDESTCLELNAQVRIDENGFFLRWLIEGKDAVVLDMGQIWEARTGGLPKDGRIMFELEQRGASETIAERTIWITHGQDLVNVQSFFLVAESVELAKTCRAGINDILKSSRIRHVCPTTQLMKYHTWLTMNVNERRKIPIKLIIKTFSSGKPEKMVQKCLNDLGLGGDKYTPARVINRSMGKKFRNFYKCSRGRKRKEREELDVDILTFEKFQRLYNKICPRTEVQELFVKLSGQKEYLTKERLINFLNEEQRDPRLNEILFPFFDSQRIVALLKKHENDIKYQEDGKMSGDGFLRFLMSDENPPVFLDRIEMFMDMDQPLCHYYINSSHNTYLTGRQYGGKSSSEIYRQVLLSGCRCIELDCWDGTGENKGEPIITHGKAMCTDVFFKDVLVQIRDTAFARSDFPVVLSFENHCSKSNQLKMAKYCMDIFGDMLLSKPFEDAPLDPGVSLPSPNRLRKKILIKNKRLKTDIERHQLDQFLREGKLDEEDELNETPEVVGEDSVSPRSGGSGGTGAPEEVDDDTSDDDDDPSVQTSLNVMRTIPTVNTTSNNGSNRSARSSLDTPSPSGGSLMVPDRATSTATSIKNAVLARSPNFSSLRQKLSFKRRQSPLAGDQRAHPEVEQPVSSSSPATPSISGPPPCATSSGSTSSITITTTGCSTSSSGPSKHILGGEMPAKENDEAHPELKQNFIAKNLKGFGFSKKQPVLTKEEEERIFAEYHYTGATTNIHPLLSSLVNYTHPVKFSGFDVAEANNLHFHMSSFSESTGLGYLKQSAPEFVNYNKRQSSRIYPKGARVDSSNFLPQIFWNAGCQMVSLNFQTPDVYMQLNMGKFEYNGGSGYLLKPDFLRRPDRTFDPFSESPVDGVIAAHCSVRVISGQFLSDRKIGTYVEVEMYGLPTDTIRKEHKTKVIPGNGLNPVYNEDPFVFRKVVLPELAVLRFAVYDENGKQLGQRILPLDGLQAGYRHISLRSDTNQSFILSPVLFVQIVIKTYVPDELSGLVDALADPRAFLSEQKKRQEALAHMGVDDSDIPDVPNTRNMALRHVKQPPRQNGSSADLLANNGQTGSARGDQTSSMASSTIRSPNEQPQPVAVDKFKVDPIEVDDLRRDKAFAKLLKRFQKELDDLRKKHQKQRDSIQKQQQTNVDKLITNNRRSTKKEKGSRRSLTASVSSGCGSASGTVTVSVCSPSGASCSGYSTGGPSTPVACNSDGTGSPATIGSPVPQDLVNNDRVRSLVNTQTGEWSAMVRRHDEEEFELKKVQLKEQFDLLRKLMSEAQKNQMLALKLRLEAEGKDLKQTQTKKSMEDAKVIQLDKGIKTKAERDRRVKELNEKNLKMFVEERKRLAMKAQKHEEQLTKRHLDQLEQLDKDFHKALDAEVGNYKEEQLAAQPTSVV

SEQ ID NO: 13361 - protein, 171 aa, Oryza sativa; identical to SEQ ID NO: 3978

SEQ ID NO: 13362 - protein, 419 aa, Danio rerio
MKGFVDAPNYFIELLEGGTTLENVIDNHIYEQNLAEKNAFVVADLGALMRQHVAWKTTMPLVRPFYPVSCNSSPVVIELLSALGVGFVCANKAETTLVLSHDVPPENIILSGVCKQLSLIKHAAKTGINFLLCENEAELRKIARAHPEAKLLLQVSTEAQIEEASVTIGCSLKGCRHLLELAKELNVSVAGVTFQVPASCKDPQAYTHALSDARCIFDMGKELGFDMNILDIGGGFSGSEFQLKQVHSVIRPLLEAYFPSESGVSIIAEPGNFFVFSCFTLAVNVIGKKAAYRDLHTSTHDKLTSSEAPEFVYYMNDGVYGSFMGRLFGNIISTPSVHKMSLTLDEPVFSSSLWGPSCDPLDQVVERCLLPELAVGDWLVFINMGASGQEGPATFSDTDQPPVYYTISTDDWFEMQEAG

SEQ ID NO: 13363 - protein, 218 aa, Streptomyces coelicolor A3(2)
GMAWEALNNIAAAKDRPLVIVVNDNERSYAPTIGGLANHLATLRTTDGYERFLARTKEVLERTPVVGRPLYDTLHGAKKGLKDFIAPQGMFEDLGLKYVGPIDGHDLEALESALTRAKRFGGPVIVHCLTEKGRGYQPALQDEADRFHAVGKIHPDTGLPISTSGADWTSVFGDEMLKLGKEREHVVAITAAMLQPVGLDKFAKAFPDRVYDVAIAEQ

SEQ ID NO: 13364 - protein, 219 aa, Streptomyces coelicolor A3(2)
GMAWEALNNIAAARDRPLIIVVNDNERSYAPTIGGLANHLATLRTTDGYERALAWGKDVLQRTPVVGHTVYEALHGAKKGFKDAFAPQGLFEDLGLKYLGPIDGHDIGAVESALRRAKRFHGPVLVHCLTEKGRGYEPALRDEEDHFHTVGVMDPLTCEPLGPAGGPSWTSVFGEEIVRIGEERADVVAITAAMLHPVGLAPFAERFPDRVWDVGIAEQ

SEQ ID NO: 13365 - protein, 218 aa, Streptomyces hygroscopicus
MAWEALNNIAAAKNRPLVIVVNDNERSYGPTIGGLANHLATLRTTDGYERFLARGKDLLERTPVVGRPLYETPHGAKKGLKDFITPQGMFEDLGLKYVGPIDGHDIEALESALQRAKRFGGPVIVHCLTEKGRGYQPALQDEADRFHAVGKIHPDTGLPISASGADWTSVFGEEMVKLGEEREDIVAITAAMLHPVGLTEFAKRFPDRVYDVAIAEQH

SEQ ID NO: 13366 - protein, 220 aa, Streptomyces hygroscopicus
GMAWEALNNIAAARDRPLVIVVNDNERSYSPTIGGLANHLATLRTTDGYERFLARGKDLLERTPVVGRPLCGSLRGAKKGFKDAFAPQGMFEDLGLKYVGPIDGHDTEAVESALRRAKRFHGPVLVHCLTEKGRGYRPALEDEADRFHTVAAMDPLTCAPLTPSGGRSWTSVFGEEMVRIGAERPDVVALTAAMLHPVGLAGFAEAYPERVWDVAIAEQH

SEQ ID NO: 13367 - protein, 215 aa, Streptomyces hygroscopicus
GMAWEALNNISGTPDRPVVIVVNDNGRSYAPTTGGLATYLAGLRTSPDYEWFLEWSKHQLRQTPKLYEALHAVKTGLKDMLAPQGLFADLGLKYLGPVDGHDIAAVEAALRQAAGFGGPVVVHCLTRKGHGYRRAEADERDHHHAVGASDPATGEPLGSPGPSWTSVFGAELVEIGRERPEVVAVTAAMLQPTGLAAYAEEFPDRVFDVAIAEQH

SEQ ID NO: 13368 - protein, 219 aa, Streptomyces lividans
GMAWEALNNIAAAKDRPLVIVVNDNERSYAPTIGGLANHLATLRTTDGYERFLARTKEVLERTPVVGRPLYDTLHGAKKGLKDFIAPQGMFEDLGLKYVGPIDGHDLEALESALTRAKRFGGPVIVHCLTEKGRGYQPALQDEADRFHAVGKIHPDTGLPISTSGADWTSVFGDEMLKLGKEREDVVAITAAMLQPVGLDKFAKAFPDRVYDVAIAEQH

SEQ ID NO: 13369 - protein, 219 aa, Streptomyces lividans
MAWEALNNIAAARDRPLIIVVNDNERSYAPTIGGLANHLATLRTTDGYERALAWGKDVLQRTPVVGHTVYEALHGAKKGFKDAFAPQGLFEDLGLKYLGPIDGHDIGAVESALRRAKRFHGPVLVHCLTGKGRGYEPALRDEEDHFHTVGVMDPLTCEPLGPAGGPSWTSVFGEEIVRIGEERADVVAITAAMLHPVGLAPFAERFPDRVWDVAIAEQH

SEQ ID NO: 13370 - protein, 219 aa, Streptomyces caeruleus
GMAWEALNNIAAAKDRPLVIVVNDNERSYAPTIGGLANHLATLRTTDGYERFLARGKDILERTPVVGRPLYETLHGAKKGLKDFIAPQGMFEDLGLKYVGPIDGHDLEAMESALQRAKRFGGPVIIHCLTEKGRGYQPALQDEADRFHAVGKIHPDTGLPIASSGVDWTSVFGEEMVKLGNERADIVAITAAMLQPVGLEKFAKAFPDRVYDVGIAEQH

SEQ ID NO: 13371 - protein, 220 aa, Streptomyces caeruleus
GMAWEALNNIAAARDRPLVIVVNDNERSYSPTIGGLANHLATLRTTDGYERFLAWGKDVLQRTPVVGQPLYGSLHGAKKGFKDAFAPQGMFEDLGLKYVGPIDGHDTEAVESALRRAKRFHGPVLVHCLTEKGRGYRPALEDEADRFHTVAAMDPLTCAPLTPSGGRSWTSVFGEEMVRIGAERPDVVALTAAMLHPVGLAGFAEAYPERVWDVAIAEQH

SEQ ID NO: 13372 - protein, 220 aa, Streptomyces caeruleus
GMAWEALNNIAAAKDRPLIIVVNDNERSYAPTIGGLAGHLATLRTSDGYEQVLAWGKEVLQQTPVVGRPLYGSLHGAKKGFKDFVAPQGMFEDLGLKYVGPVDGHDIAAVETALRRASRFTGPVLVHCITEKGRGYQPALDDEADHFHTVGVMDPLTCEPLAPAGKPSWTSVFGDEILAIGEERPDVVAVTAAMLHPVGLTGFAARFPDRVWDVAIAEQH

SEQ ID NO: 13373 - protein, 179 aa, Streptomyces caeruleus
GMAWEALNNLGGARQRPVIVVLNDNERSYAPTVGGLATHLGKLRSARGPGNVFEEFGFGYLGPVDGHDIAAVEEALGRARALGGPVVVHVVTEKGRGWETAETNELDRCHVVRATPSSSAAPASSPSWTAVFSDEMVRIGAERPDVVAITAAMAEPVGLLDFQREFPARTIDVGIAEQH

SEQ ID NO: 13374 - protein, 220 aa, Streptomyces caeruleus
GMAWEALNNIAAAKDRPLVIVVNDNERSYAPTIGGLANHLATLRTTDGYERFLARGKDILERTPVVGRPLYETLHGAKKGLKDFIAPQGMFEDLGLKYVGPIDGHDLEAMESALQRAKRFGGPVIIHCLTEKGRGYQPALQDEADRFHAVGVMDPLTCEPLAPAGKPSWTSVFGDEILAIGEERPDVVAVTAAMLHPVGLTGFAARFPDRVWDVAIAEQH

SEQ ID NO: 13375 - protein, 218 aa, Streptomyces rishiriensis
GMAWEALNNIADGDRPLVIVVNDNERSYAPTIGGLANHLATLRTTDGYERFLARGKDLLERTPVVGKPLYETLHGAKKGLKDFIAPQGMFEDLGLKYVGPIDGHDIEALESALARAKRFGGPVIVHCLTEKGRGYQPALQDEADRFHAVGKIHPDTGLPIATSGADWTSVFGEEMVALGKEREDIVAITAAMLQPVGLDKFAKAFPDRVYDVAIAEQH

SEQ ID NO: 13376 - protein, 220 aa, Streptomyces rishiriensis
GMAWEALNNIAAAKDRPLIIVVNDNERSYAPTIGGLANHLATLRTTDGYEKVLAWGKDVLLRTPLVGNTVYESLHGAKKGFKDAFAPQGMFEDLGLKYVGPIDGHDLGAVESALRRAKRFHGPVLVHCLTEKGRGYEPALAHEEDRFHTVGAMDPLTCAPLAPAGGPSWTSVFGDEIVAIGEERDDVVAITAAMLHPVGLGKFAERFPGRVWDVGIAEQH

SEQ ID NO: 13377 - protein, 355 aa, Takifugu rubripes
MGCRQTSEEKEKARSCRRIDRHLRSESQRQRREIKLLLLGTSNSGKSTIVKQMKIIHSGGSNLEACKEYMPLILYNLIDSLTRIIRALAALRIDFHNPDRAYDAVQLFALTGPAESSGEITPELLGVMRRLWADPGAGACFKRSSEYHLEDNAAYYLNDLLRISALEYIPTVEDILRSRDMTTGIVENKFTFKELTFKMVDVGGQRSERKKWIHCFEGVTAIIFCVELSGYDLKLYEDNQTSRMAESLRLFDSICKTIWFINTSLILFLNKKDLLAEKIRRIPLVICFPEYKGQNTYEEAAVYIQRQFEDLNRNKETKEIYSHFTCATDTSNIQFVFDAVTDVLIQNNLKYIGLC

SEQ ID NO: 13378 - protein, 358 aa, Takifugu rubripes
MGAGISAEEKHSREAEKDIKEDAEKDARTVKLLLLGAGESGKSTIVKQMKIIHQDGYSLFECLFFIAIIYGNTLQSILTIVRAMTTLNIQYGDSARQDDARKLMHMADTIEEGTMPKEMSDIIQRLWKDTGLQACFFRASEYQLNDSAGYYLSDLERLVTPGYVPTEQDVLRSRVKTTGIIFTQFSFKDLNFRMFDVGGQRSERKKWIHCFEGVTCIDFIAALSAYDMVLVEDDEVNRMHESLHLFNSICNHRYFAATSIVLFLNKKDVFEEKIKKAHLSICFPDYDGPDTYEDAGNYIKVQFAFLNMRRDIKEIYSHMTCATDTQNVKFVFVFDAVTDIIIKENLKDCGLFVTHHGR

SEQ ID NO: 13379 - protein, 109 aa, Takifugu rubripes
DSVTSILFLVSSSEYDQVLMEDRQTNRLRESVDIFETIVNNRVFGNVSIILFLNKTDLLEEKVQVPLKDYFPEYTGPEHSLADIQAFMVECFRARRRDATQKPLYHHFT

SEQ ID NO: 13380 - protein, 371 aa, Takifugu rubripes
MGCTVSAETKALAERSNMIDRNLREDGEKTAREVKLLLLGAGESGKSTIVKQMKIIHEDGYSEDECKQYRAVVYSNTIQSIMAIIKAMGNLKIDYEDSARADDAAQLFALSAAAEEQGILPDDLSRVIQRLWSDGGVQSCFTRAREYQLNDSAAYYLNDLERIAKSDYIPTQQDVLRTRVKTTGIVETHFTFKDLHFKDFDVGGQRSERKKWFHCFEGVTGIIFCVGMSAYDLVLAEDEEMNRMHESMKLFDSICNNKWFTETSIILFLNKKDLFEEKIAHSPLTICFPEYTGPNKYEEAQAYIETKFEDLNKKKDTKEIYTHFTCATDTKNVQFVFDAVTDVIIKNKLKDCGLFVSAAVQRNGRHKAKTV

SEQ ID NO: 13381 - protein, 89 aa, Takifugu rubripes
LFLNKKDLFEEKIKRSPLTICYPEYTGSNTYEEAAAYIQCQFEDLNRRKDTKEIYTHFTCATDTKNVQFVFDAVTDVIIKNNLKECGLY

SEQ ID NO: 13382 - protein, 298 aa, Homo sapiens
MENFQKVEKIGEGTYGVVYKARNKLTGEVVALKKIRLDTETEGVPSTAIREISLLKELNHPNIVKLLDVIHTENKLYLVFEHVHQDLKTFMDASALTGIPLPLIKSYLFQLLQGLAFCHSHRVLHRDLKPQNLLINTEGAIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 13383 - protein, 873 aa, Clostridium symbiosum
AKWVYKFEEGNASMRNLLGGKGCNLAEMTILGMPIPQGFTVTTEACTEYYNSGKQITQEIQDQIFEAITWLEELNGKKFGDTEDPLLVSVRSGARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 13384 - protein, 525 aa, Bombyx mori
MEIQLRRHRSAQIQDQENLYAGVRGKGNGAVPTKRLGLTVRGALGDLNTNVQVQREALGKVAVTTAEFEKKATLNRGVVRSNYSHVTSKVDTGLAVKNVIQPSSRPPLRREESTAGLTARAVTRTRVALKDNQNKPNEIKESINIYIQTKKCQDTKKTKLPMLKENKELRTSKSHLKDGTDSLRKTKLALKDPIESLGKLKLAETYPEKGMGLIDKAKVEKQAEFFETVFDITPPLPEDIEDIDAGDNNSPLLMSMYIKDIYKYLTELEEKYSIEPDHLKKQTVITGKMRATLIDWLVEVQRQFSLVLETFHLTVGIIDRYLQVVPNVQRNQLQLVGVTAMFIASKYEEIYAPDVGDFVYVTDNAYTKSDVFRCERDIMCKLGFCLARPIPLSFLRRFVKAARGTSRNHHLAKYFVDLCLVEYTMAHYRPSELAAAAICLSLHLLSSKTLSEVWTSTLSYYSGYDLDHIDPIIRKIAKIVINIENSKYKAVYNKYLDTTLAKVSSLPQLKSEAIYELAKISSPSP

SEQ ID NO: 13385 - protein, 366 aa, Homo sapiens
PRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 13386 - protein, 296 aa, Leishmania mexicana mexicana
RILLSNQTNLVREPYQKPAAQPPTPLTNESRFVSEYGSEILTYFLEVERVVYSERMYMSRQSEVTDRMRKILIDWLIDVVTEFKLHPETFFLAVDIIDRFLFFYSIPRTKLQLVGVTAILVAAKHEEIWPPTVNDCVAVTANTYTSREVIDMEFDVVTTLRFKFTVPTTYPITCRLLESCHMAPAVRHATFLFLESAAHCYPLLQFLPSRIAAGAVLLGAFLIRYNRSKGVISLQGLWEIEVSPFAQGIGFEELQPVTEQLLPFTQRLCSGSSRLQAVRRKYSSSEYDCVASLEFP

SEQ ID NO: 13387 - protein, 137 aa, Oryza sativa (japonica cultivar-group)
MAEEGQRGGYSRLAGDEEVATASGGGGGDYDERKLRLLGYEPQLKRNLSLLSNFAVSFSIVSVLTGITTLFGTGLQFGGPATMVYGWPIAGAMTLVVGLAMAEICSAYPTSGGLYFWSARLCSHRRWGPFASWLTGW

SEQ ID NO: 13388 - protein, 766 aa, Oryza sativa (japonica cultivar-group)
MTWNKAPAADAEAGGGGDTGHARLRELGYKQELKRDLSVLSNFAFSFSIISVLTGITTLYNTGLSFGGPATMTFGWFVAGAFTMTVGLSMAEICSSFPTSGGLYYWSARLSGKRWAPFASWITGWFNIVGQWAVTTSVDFSLAQLIQVIILLSTGGNNGGGYMASKYVVIAFHAAILLSHAAINSLPITWLSFFGQFAAAWNMLGVFVLMIAVPTVATERASAKFVFTHFNTENNAGIHSNFYIFVLGLLMSQYTLTGYDASAHMTEETKNADRNGPIGIISAIGISIIVGWGYILGITFAVKDIPYLLNPENDAGGYAIAEVFYLAFKSRYGSGIGGIICLGIVAVAIYFCGMSSVTSNSRMAYAFSRDGAMPLSSVWHKVNKHEVPINAVWLSALISLCMALPSLGSLVAFQAMVSIATIGLYVAYALPILFRVTLARKHFVPGPFNLGRCGVAVGWAAVLWVATITVLFSLPVSYPVTKDTLNYTPVAVGGLFLLWEMEESSSMIGGVSGGRRSITEEQAAGAEAEADEEELEPLFDYSRVQPTMAFSFDDTDIEKSDIFVHCNKRRKVADGDGDANADEKGDKGEQKAAKAAAVVDLGEEDWLPPPPPPKPKSTVTDESEQSSVLKELRYKPVHGSILLQKQAMAKFAESADDFLEKLAQTARQKVEARIPTEHIDLDKSPERHEAREKVVVTVQDKAGHHQFRLYKDEKFGKLFRAYAKKVNLSVADLTFAFDGDKVDAESTPEDLGLEDEDMVEVLHKTR

SEQ ID NO: 13389 - protein, 470 aa, Oryza sativa (japonica cultivar-group)
MAAAGLNHGGASPSARGKWLGGPVAPGVVELPADRDCWAEEFWGGIEDGTSSVTLSHRYGPCSPADPNSGEKRPTDEELLRRDQLRADYIRRKFSGSNGTAAGEDGQSSKVSVPTTLGSSLDTLEYVISVGLGSPAVTQRVVIDTGSDVSWVQCEPCPAPSPCHAHAGALFDPAASSTYAAFNCSAAACAQLGDSGEANGCDAKSRCQYIVKYGDGSNTTGTYSSDVLTLSGSDVVRGFQFGCSHAELGAGMDDKTDGLIGLGGDAQSPVSQTAARYGKSFFYCLPATPASSGFLTLGAPASGGGGGASRFATTPMLRSKKVPTYYFAALEDIAVGGKKLGLSPSVFAAGSLVDSGTVITRLPPAAYAALSSAFRAGMTRYARAEPLGILDTCFNFTGLDKVSIPTVALVFAGGAVVDLDAHGIVSGGCLAFAPTRDDKAFGTIGNVQQRTFEVLYDVGGGVFGFRVGAC

SEQ ID NO: 13390 - protein, 170 aa, Heterodera glycines
  unsure (1)..(170): unsure at all Xaa locations
MTDTANRQRRGRGERRTRVLLRDSAKKITKASILRLARRAGVARINARVYDEVRAALRSYLETIIRDAAIYCQHERRKTMKSRDVVHALRRQGNLMYGFEQXAXGGGGWIYLEPAPYDIFGXYYYCTYVCICLYCILLCRCYCTPFYPCNCDPXLLLSXCVDICVFWYDK

SEQ ID NO: 13391 - protein, 1832 aa, Podospora anserina
MYNPPGQRDATRPFHVPPPPPPMSPPPPTVGINNPMMTIPPPPPRHPNAPSTTGNVLLPPPPSGPPPNSGFPNSAIAPPSALGSTAPWHGAWGRAYDGRTAFNIPPPPPGGGAGGGGGGGSGGVLRAYDPKYHAQVLAAANNGATYTVPPPPPPQQQQQQQQQQQQQQQQQQQQQQQQQQQQQQQQQQQQQQQQQQQQQQQQQQQQQQQQQQQQSDQMGALTSATYIPQGDTYGEGVGIPGLGLEDSAIGWNMGAHLESATATPLDESSGRDRLYANAMAQRGSSTTSNATVSSVSVPPELAAQWPMEKVLGWLQANSFSSHWQETFKYLGLDGARFLELGSSHGGRGNFGMMHQQVYPRLLALSGPEWNQAREREEGKRMRRLVRSIVTGRPVEVKGGRLGGGQQQPQHARQNSTSAPPAVTGGQTGNRSAESPNVSVDDGFWDTGVTDADDGDKQTPNPIKIPEFGFSRRFSQSRATTMPTLSSTMPTDHRNMMKEIDTSRRHSPTLSESGEAGGTFRGGSTPLGGGGGGGGGGGRDSPSAGSPNPASGLFPSSTAGNLSASPHSSRFGHRSRNSTDSVSSSAAIYGSGVPADAAAMLKSGMNIADVVNAARNANDRRHAQDGGRPSPQESGGGDRSAGEPPGSAKGSGSFLSIFTRKKHGRKDDGFGGDEDSPTSPGLSFKPQSLGDNRPGSSAGTYGHHHAGNVRANRGGPRVFILATADCWNYRMLDVTDIETASDLRQLICINLGLPESEGAHLYPTELGKFEHDGEALDDSKLLAIKTQRADAIGTLKLFVRVGGPPQMRQTGAQIAMDEETYVKLNGRMRSSSSPPTSRQNTLTGKEGEDKMLTAEAIEYRTEQLRKQKEYLAKRKQVAENNHVADRSPSSSIVGRTVDFDQPRHSPFEDRKMDTLLPQRKPPAPPSDPSATLIKANSLKKTGHGLRLSGDSGYHPKRKTSSDLRSSGDVVFEKQKRWGPVADPSAGIGALLVGMSDGMASIARPRPGGGMMQQRQPSPHRVATEPITSQELQRGKKAMSTVNFGPAHQRERSGSGGGSPRPGGMPGSPGSYTWSSKNVPFLVPDYSPNGTPAPPTASRMPDGGGNSGDGCLDQNHNHQAQNGTIAKMRNVARAPSPGNVSPSSRRRPSDSFSSQAAVAKKRKSHGPDTDFTDNDVTFSASSTRASKKVDDSDSDDDSDDGLFAIPIAARNSGPDKGKTTAPAEGNSGDSDGASGTGTGKRPSLRLNTRSGSNSRAKKTLSVAFAVSPQSSSAGGKTPLEDDDSGRSSSQRRGTPGTPQSEGGWDSEEKDSKISRRKSFIEKDVWANRPPTDALVNNLEDFFPDLDVDQPVLEEGVDQEPPSPIAEGDENNQGSASVPPLPPLPPGLSTGKLHTFYNDNDTLGSDESTLKALESRPVSMQSLAHRSIRRSGGGGGLGRMKSIREVARGANEFGKRYTQGPGQIDAQSSAAAAGNRNTNLMRRKSTKMFNANIVQIQPDRGSLNLAMGGLTTIPQDSLPTRSTNSRESIPKRQTTFRWFKGQLIGKGTFGRVYLGMNATTGEFLAVKEVEVNPKAAQGDKKKMQELVAALDQEIDTMQHLDHVNIVQYLGCERKETSISIFLEYISGGSIGSCLRKHGKFEEPVVASLTRQTLSGLAYLHREGILHRDLKADNILLDLDGTCKISDFGISKKTDNIYGNDKTNSMQGSVFWMAPEVIRSQGEGYSAKVDIWSLGCVVLEMFAGRRPWSKEEAVGAIYKIANGETPPIPEDIREVISPVAIAFMLDCFTVVSSERPTADVLLSQHPFCELDPTYSFLDTELYAKIAGRVNDLGRGQ

SEQ ID NO: 13392 - protein, 247 aa, Medicago sativa
MARGKIQIKRIENTTNRQVIYSKRRNGLFKKANELTVLCDAKVSIIMFSSTGKLHEYISPSASTKQFFDQYQTTVGIDLWNSHYENMQENLKKLKDVNRNLRKEIRQGMGECLNDLSMEELRLLEDEMDKALKAIRERKYKVITNQIDTQRKKFNNEREVDNRLLRDLDARAEDPRFEMMDNGGEYESVIGFSNLGPRMFALSLQPTHPNPHNGGASAASDLTTYPLLFSHFSLRIRTTNTTITFQQ

SEQ ID NO: 13393 - protein, 277 aa, Ricinus communis
TNNNELFLNLVMEYVPESMYRVLKHYSNAKQTMPLVYVKLYMYQIFRGLAYIHTVPGVCHRDLKPQNILVDPLTHQVKLCDFGSAKVLVKGEANISYICSRFYRAPELIFGATEYTTSIDIWSAGCVLAELLLGQPLFPGENAVDQLVEIIKVLGTPTREEIRCMNPNYTDFRFPQIKAHPWHKVFHKRMPPEAIDLASRLLQYSPSLRCTALEACAHPFFDELREPNARLPNGRPLPPLFNFKQELNGASPELVNKLIPDHMKRQMGLNFLHLAGT

SEQ ID NO: 13394 - protein, 84 aa, Homo sapiens
MKVKIKCWNGVATWLWVANDENCGICRMAFNGCCPDCKVPGDDCPLVWGQCSHCFHMHCILKWLHAQQVQQHCPMCRQEWKFKE

SEQ ID NO: 13395 - protein, 103 aa, Apis mellifera
MTGRGKGGKGLGKGGAKRHRKVLGDNIQGITKPAIRRLARRGGVKRISGLIYEETRGVLKVFLENVIRDAVTYTEHTKRKTVTAMDVVYALKIQGRTLYGFGG

SEQ ID NO: 13396 - protein, 103 aa, Diprion pini
MTGRGKGGKGLGKGGANGHRKVLRDNIQGITKPAIRRLARRGGVKRISGLIYEETRGVLKVFLENAIRDAVTYTEHAKRKTVTAMDVRYALKRQGRTLYGFGG

SEQ ID NO: 13397 - protein, 103 aa, Diprion pini
MTGRGKGGKGLGKGGAKRHRKAVRDNIQGITKPAIRRLARRGGVKRISGLIYEETRGVLKVFLENVIRDAVTYTEHAKRKTVTAMDVVYALKRQGRTLYGFGG

SEQ ID NO: 13398 - protein, 102 aa, Diprion pini
MTGRGKGGKGLGKGGKRHRKVLRDNIQGITKPAIRRLARRGGVKRISGLIYEETRGVLKVFLENVIRDAVTYTGHAKRKTVTAMDVGDALKRQGRTLYGFGG

SEQ ID NO: 13399 - protein, 103 aa, Diadromus pulchellus
MTGRGKGGKGLGKGGAKRHRKVLRDNIQGITKPAIRRLARRGGVKRISGLIYEETRGVLKVFWQNVIRDAVTYTEHAKRKTVTAMDVVYALKRQGRTLYGFGG

SEQ ID NO: 13400 - protein, 451 aa, Oryza sativa (japonica cultivar-group)
MGGILVPYVCGACGPGRTGGKRGFAIRGSEATKSRHDAPQSPASTVARGVGGVPGASWGWFFQAAAGSPELDPAEERISGKGAAKLLDGRLVVALRARIHADPAPEFDQFDCLPDPVVLLILNKLEDVRSLGRCAAVSKRFSGLVPLVSDVYVKIDRVVATDGDADDALNLSSAKPKNIFSHFFKLMLFTIVKPFHSMRNLNGTGRPLFPLAQHSPVHVLRNFSDVWNLRVELPSGDVGTEEGVLLKWRAEYGSTLRNCVILGGTLVDRKPIGAEHESSVEDNGSMPESFYTNGGLKLRVVWTISSLIAASTRHYLLRSIIKDHPTLRSLVLADADGQGTLYMGMEQLREFRENKLSASACSNRTQVPACNMKLKYAPYLELPGGMTLQGATLVVIKPSNDGGSGGHSSRKETEAFVSSAFDEPFRFAVKALMKRRTYLLEMNEQLQSCLE

SEQ ID NO: 13401 - protein, 310 aa, Oryza sativa (japonica cultivar-group)
MASKAGGGGVARRGGGRMRSLGRQGSMYSLTLDEVQSQLGEPLHSMNLDELLRSVFPDGLAIADGAGATTSSQQHQPGSGLLRQGSITMPPELSKKTVDEVWKGIQAAPKRNAETGGGGGGGRRRRERQPTLGEVTLEDFLVKAGVVTQGSLKELSDVGNVDPVGRGVTATGTVDLAPGSHWIEQYKQQIASTDAHHHGQQGVQGAYFPNRLVPQPLNVGPGAILEPSYSDGQTSSGMIGGMSDSQTPGRKRGMSGDVADKLMERRQKRMIKNRESAARSRARKQAYTNELENKVSRLEEENVRLKRQKE

SEQ ID NO: 13402 - protein, 219 aa, Oryza sativa (japonica cultivar-group)
MDTEDTSSASSSSVSPPSSPGGGHHHRLPPKRRAGRKKFRETRHPVYRGVRARAGGSRWVCEVREPQAQARIWLGTYPTPEMAARAHDVAAIALRGERGAELNFPDSPSTLPRARTASPEDIRLAAAQAAELYRRPPPPLALPEDPQEGTSGGGATATSGRPAAVFVDEDAIFDMPGLIDDMARGMMLTPPAIGRSLDDWAAIDDDDDHYHMDYKLWMD

SEQ ID NO: 13403 - protein, 308 aa, Neocallimastix patriciarum
MAQKKQQQKLGFYEDFLLAGVSATISKTAAAPLERVKLLVQNQGEMLKSGRLATPYKGIGDCFVRVAKEEGIASFWRGNGANIIRYFPTQALNIAFKERIKNAFAVDKEKEGYAKWLVANIASGGAGGALSQVFVYSLDYARTRLANDAKSANGGERQYKGLIDVYKKTYKADGIAGLYRGFTLSCVGIMVYRGLYFGLYDSMKPLLKNLGMEGSFAASFILGWGVTTVAGIASYPIDTIRRRMMMTSGEAVKYKSSIDCAKQVMQKEGVQAFFKGCGANILRGVAGAGVLSGFDKIKEVYINWRIKN

SEQ ID NO: 13404 - protein, 299 aa, Mus musculus
MDLVLSAADYYFFTPYVYPATWPEDNIIRQTISLLIVTNLGAYILYFFCATLSYYFVYDHSLMKHPQFLKNQVSREIVFTVKSLPWISIPTVSLFLLELRGYSKLYDDIGDFPNGWIHLMVSVVSFLFFTDMLIYWIHRGLHHRLVYKRIHKPHHIWKIPTPFASHAFHPVDGFLQSLPYHIYPFVFPLHKVVYLGLYVLVNVWTISIHDGDFRVPQILRPFINGSAHHTDHHMFFDYNYGQYFTLWDRIGGSFKHPSSFEGKGPHSYVKNMTEKESNSFAENGCKGKKVSNGEFTKNK

SEQ ID NO: 13405 - protein, 472 aa, Mus musculus
MATKCTKCGPGYPTPLEAMKGPREEIVYLPCIYRNTGTEAPDYLATVDVDPKSPQYSQVIHRLPMPYLKDELHHSGWNTCSSCFGDSTKSRNKLILPGLISSRIYVVDVGSEPRAPKLHKVIEASEIQAKCNVSNTHTSHCLASGEVMVNTLGDLQGNGKGSFVLLDGETFEVKGTWEKPGGASPMGYDFWYQPRHNVMVSTEWAAPNVFKDGFNPAHVEAGLYGSRIFVWDWQRHEIIQTLQMTDGLIPLEIRFLHDPSATQGFVGCALSSNIQRFYKNEEGTWSVEKVIQVPSKKVKGWMLPEMPGLITDILLSLDDRFLYFSNWLHGDIRQYDISNPQKPRLTGQIFLGGSIVRGGSVQVLEDQELTCQPEPLVVKGKRIPGGPQMIQLSLDGKRLYATTSLYSDWDKQFYPDLIREGSVMLQVDVDTVNGGLKLNPNFLVDFGKEPLGPALAHELRYPGGDCSSDIWI

SEQ ID NO: 13406 - protein, 103 aa, Trichogramma cacoeciae
MTGRGKGGKGLGKGGAKRHRKVLRDNIQGITKPAIRRLARRGGVKRISSLIYEETRGVLKVFLENVIRDAVTYTEHAKIPTVTAMDVVYALKRQGRTLYGFGG

SEQ ID NO: 13407 - protein, 519 aa, Oryza sativa (japonica cultivar-group)
MQGIGRRYGRIKVYAVLGDDEAQHAKNNMRGALFHVDNPGPMAPIAKGNFLDVNQALEVVRFGIQYCDWRARQDLLTIMVLHNKVVEVLKSLAIEFKSNGTLRKELAELQEELAKAHNQVHLSETRASSALDKLAQADNLVNDRLLQDGGSSASIDNYVSLASRTSSASRFVNKKTLRPSLDVSGPVQPYNPNLKNFWYPVVFSGDLKDDTMVPIDCFEEQWVIFRGKDGRPGCVQNTCAHRACPLHLGSVSEGRIQCPFHGWEYSTDGKCEKMPATKLLNVRIRSLPCFEQEGMVWIWPGDGTPESTIPSLQPPSGFTIHAEMVMELPVEHGLLLDNLLDIAHAPFAHTSTFAKGWSVPSLVKFLTPASGLQGYWDPYPIDMEFRPPCMVLSTTGISKPGKLEGKSIKQCSTHLHQLHICLPSSRNKTRMLYQMSLNFAPWLKHIPFMHILWSHFGEKVLNEDLRLVLGQQERMINGANVWNWPVSYDKLGIRYRLWRDAIERGANRLPFNNQSESGS

SEQ ID NO: 13408 - protein, 541 aa, Oryza sativa (japonica cultivar-group)
MTTVASLSLLPHLLIKPSFRCCSRKGVGRYGGIKVYAVLGDDGADYAKNNAWEALFHVDDPGPRVPIAKGKFLDVNQALEVVRFDIQYCDWRARQDLLTIMVLHNKVVEVLNPLAREFKSIGTLRKELAELQEELAKAHNQVHLSETRVSSALDKLAQMETLVNDRLLQDGGSSASTAECTSLAPSTSSASRVVNKKPPRRSLNVSGPVQPYNPSLKNFWYPVAFSSDLKDDTMVPIDCFEEQWVIFRGKDGRPGCVMNTCAHRACPLHLGSVNEGRIQCPYHGWEYSTDGKCEKMPSTKMLNVRIRSLPCFEQEGMVWIWPGNDPPKSTIPSLLPPSGFTIHAEIVMELPVEHGLLLDNLLDLAHAPFTHTSTFAKGWSVPSLVKFLTPSSGLQGYWDPYPIDMEFRPPCMVLSTIGISKPGKLEGKSTKQCSTHLHQLHICLPSSRNKTRLLYRMSLDFAPWIKHVPFMHILWSHFAEKVLNEDLRLVLGQQERMINGANVWNWPVSYDKLGIRYRLWRDAIERGVDRLPFSNQSESGS

SEQ ID NO: 13409 - protein, 232 aa, Oryza sativa (japonica cultivar-group)
MDPSGAFFHAAPRSGSNVSLASLARTAGGRRMMHRVFRGVITFIFAIAGLFLGAVTGGLIGLATESGLFRGTGIGAITGALVSIEVVDSSIRVWRSRRSGISSICYVLNVIYSLLTGRLVREKVDPAVQRVVRSQMNAVDSSPFRESPDLFEIEGTNGMPRASIDKLPEVRITEEYRRNAIGDLSGCSVCLQDFQTGEKVRSLPDCWHVFHVPCIDGWLIKHGSCPLCRRKL

SEQ ID NO: 13410 - protein, 234 aa, Achromobacter xylosoxidans
MSTDKVAIITAGGSGMGAAAARKLAADGYRVAILSSSGKGEALAAELGGLGVTGSNRSPEDLARLVDATLQKWGRVDAVVNSAGHGPKGPLLEISDDDWHLGMEFYLLNVVRIARLVAPVMKRQKSGAIVNISTYATFEPEALFPTSGVFRAGLAAFTKVFADEYAEHNVRMNNVLPGFIDSLPEKEDRRARIPMGRYGTAEEVADLIAFLASDASSYITGQNIRIDGGITRSV

SEQ ID NO: 13411 - protein, 376 aa, Danio rerio
MDTTGKVIKCKAAVAWEAGKPLTIEEVEVAPPKAHEVRVKIHATGVCHTDAYTLSGSDPEGLFPVILGHEGAGTVESVGEGVTKFKPGDTVIPLYVPQCGECKFCKNPKTNLCQKIRVTQGQGLMPDNTSRFTCKGKQLFHFMGTSTFSEYTVVAEISLAKVDEHAPLDKVCLLGCGISTGYGAAINTAKVEAGSTCAVFGLGAVGLAVVMGCKSAGATRIIGIDVNPDKFEIAKKFGATEFVNPKDHSKPIQEVLVELTDGGVDYSFECIGNVGIMRAALEACHKGWGTSVIIGVAGAGQEISTRPFQLVTGRTWKGTAFGGWKSVESVPKLVNDYMNKKLMVDEFVTHTLPFAQINEAFDLMHAGKSIRAVLQF

SEQ ID NO: 13412 - protein, 292 aa, Danio rerio
MQKYEKLEKIGEGTYGTVFKAKNRETHEIVALKRVRLDDDDEGVPSSALREICLLKELKHKNIVRLHDVLHSDKKLTLVFEYCDQDLKKYFDSCNGDLDPEIVKSFMYQLLKGLAFCHSRNVLHRDLKPQNLLINRNGELKLADFGLARAFGIPVRCYSAEVVTLWYRPPDVLFGAKLYSTSIDMWSAGCIFAELANAGRPLFPGNDVDDQLKRIFRLLGTPTEEQWQTMNKLPDYKPYPMYPATTSLVNVVPKLSSTGRDLLQNLLKCNPVQRISAEEALQHPYFADFCPP

SEQ ID NO: 13413 - protein, 348 aa, Danio rerio
MPGPVSSKARVYADANTVKSKEYWDYEAHVPSWSNQDDYQLVRKLGRGKYSEVFEAININSNDRVVVKILKPVKKKKIKREIKILENLRGGTNIIRLVDTVKDPVSRTPALVFEYINNTDFKDLYQRLTDFDIRFYLYELLKALDYSHSMGIMHRDVKPHNVMIDHQMRKLRLIDWGLAEFYHPAQEYNVRVASRSYKGPELLVDYQMYDYSLDMWSLGCMLASMIFQKEPFFHGQDNYDQLVRIAKVLGTEEQFSYLNKYHIELDTRFKDLLGQQTRKRWENFVLPENQHLVSPEALDLLDKLLRYDHQQRLTAQEAMEHPYFYPVLKGQPLSNSEGALAISSSTTT

SEQ ID NO: 13414 - protein, 215 aa, Danio rerio
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASSFKSPVKAIR

SEQ ID NO: 13415 - protein, 291 aa, Danio rerio
MEHQLFCCEVDTIRRAYQDSNLLNDRVLQTMLKAEENYLPSPNYFKCVQKEIVPKMRKIVATWMLEVCEEQKCEEEVFPLAMNYLDRFLSVEPTKKTRLQLLGATCMFLASKMKETVPLTAEKLCIYTDNSVRPGELLQMELLALNKLKWDLASVTPHDFIEHFLAKLPIHQSSKQILRKHAQTFVALCATDVNFIASPPSMIAAGSVAAAVQGLYLKSTDSCLSSQNLTNFLSQVIRSDPDCLRSCQEQIESLLESSLRQAQQHISTETKRVEEDVDLSCTPTDVRDINI

SEQ ID NO: 13416 - protein, 410 aa, Danio rerio
MPSKKVLQTEHINTTDEAPKTTSVRPRKRKADVAIHLQDPDEEVTEMTRKKQCASQACWNPDTGYTSPCRRIPTPDEVEEPVAFGSVGFTQYASESIFITPTRSTPLPALCWASKDEVWNNLLGKDKLYLRDTRVMERHPNLQPKMRAILLDWLMEVCEVYKLHRETFYLGQDYFDRFMATQENVLKTTLQLIGISCLFIAAKMEEIYPPKVHQFAYVTDGACTEDDILSMEIIIMKELNWSLSPLTPVAWLNIYMQMAYLKETAEVLTAQYPQATFVQIAELLDLCILDVRSLEFSYSLLAASALFHFSSLELVIKVSGLKWCDLEECVRWMVPFAMSIREAGSSALKTFKGIAADDMHNIQTHVPYLEWLGKVHSYQLVDIESSQRSPVPTGVLTPPPSSEKPESTIS

SEQ ID NO: 13417 - protein, 629 aa, Danio rerio
MSVSSFRRGQWASQSLRVTAKELSIVGVRGKNTAIAERFSKYQKAAEETSLDKKKSPEKSTPGLRNGNLSVLKQLWEHPAETPTSPEPKAHLQNHLQQSAVKIPLESTDVQLIEGTDQQCLSDSDQPMEKRTQRDVETLIEKPTVPLNSLKMMFEKGETLHSNVSREPGTTGDSGSDNMEPGTKESLECGVKMLDSTPLRDRMAMYQAAVTKLDFPSSPNSEAADSEARAHSGKQKENVPPVSADVCPESNTIKSPAPDRNGSVLSPEQNQPKLVKMFPLPVRETCVTCLKTVYPLEKLVANQQIYHNTCFRCAYCNTKLSLVNYASLHNNVYCKPHYCQLFKAKGNYDEGFGHRPHKELWEGRPEGVDDQVKLSPQETSLTVEESPLVKVNVLAATLETRTQATSERVEKPLETGRLKISWPPQSEGDESATHTVTDGSGIKPIRPKWPPEGDTVSSNVDLESDLPKLRRSVSLKERSKPFCIFDSAPVAQPKRCQRSPSNEKPDSEEEMSPVSSTTDTTISSEDMTEHNQSEEEDQDKTKEDEQMEHEEKVDVQEEELSSLKCSTPDNSPPLSPESESGLDPEENQASQDVGFWDGEEAEEDTADVTVEDLIKRNRHYDDEDDEDVV

SEQ ID NO: 13418 - protein, 350 aa, Danio rerio
MGAGASAEEKHSRELEKKLKEDADKDARTVKLLLLGAGESGKSTIVKQMKIIHKDGYSLEECLEFIVIIYSNTMQSILAVVRAMTTLNIGYGDAAAQDDARKLMHLADTIEEGTMPKELSDIILRLWKDSGIQACFDRASEYQLNDSAGYYLNDLERLIQPGYVPTEQDVLRSRVKTTGIIETQFSFKDLNFRMFDVGGQRSERKKWIHCFEGVTCIIFIAALSAYDMVLVEDDEVNRMHESLHLFNSICNHRYFATTSIVLFLNKKDVFVEKIKKAHLSMCFPEYDGPNTFEDAGNYIKVQFLDLNLRRDIKEIYSHMTCATDTENVKFVFDAVTDIIIKENLKDCGLF

SEQ ID NO: 13419 - protein, 354 aa, Danio rerio
MGSGASAEDKEMAKKSKELEKQLQEDADKEAKTVKLLLLGAGESGKSTIVKQMKILHQGGYTKEEQMEFRSIIFGNILQSALAIIRGMEMLSINFGSPSAQEDSQKLQNLSDSIEEGTMPPELADVIKRLWKDAGVQASFDRAAEYQLNDSAGYYLNEMDRICKPDYLPTEQDVLRSRVKTTGIIEEQFGCKELHFRMFDVGGQRSERKKWIHCFEGVTCIIFCGALSAYDMVLVEDDEVNRMHESLHLFNSICNHRFFATTSIVLFLNKKDLFQEKIKKVHLSICFPDYDGPNTYEDASNYIKTQFQDLNMKKGVKEIYSHMTCATDTKNVEIVFNAVTDIIIKENLKDCGLF

SEQ ID NO: 13420 - protein, 538 aa, Danio rerio
MEYHSVGPGGVVVTGNNVPAFLTKLWTLVEDPDTDPLICWSPNGTSFHVFDQGRFSKEVLPKYFKHNNMASFVRQLNMYGFRKVVHIEQGGLVKPEKDDTEFQHPYFIRGQEQLLENIKRKVTTVSNIKHEDYKFSTDDVSKMISDVQHMKGKQESMDSKISTLKHENEMLWREVATLRQKHSQQQKVVNKLIQFLITLARSNRVLGVKRKMPLMLNDSSSAHSMPKFSRQYSLESPAPSSTAFTGTGVFSSESPVKTGPIISDITELAQSSPVATDEWIEDRTSPLVHIKEEPSSPAHSPEVEEVCPVEVEVGAGSDLPVDTPLSPTTFINSILQESEPVFRPDSAPSEQKCLSVACLDNYPQMSEITRLFSGFSTSSLHLRPHSGTELHDHLESIDSGLENLQQILNAQSINFDSSPLFDIFSSAASDVDLDSLASIQDLLSPDPVKETESGVDTDSGKQLVQYTSQPSFSPIPFSTDSSSTDLPMLLELQDDSYFSSEPTEDPTIALLNFQPVPEDPSRTRIGDPCFKLKKESKR

SEQ ID NO: 13421 - protein, 489 aa, Danio rerio
MKHSSNVPAFLTKLWTLVEDSDTNEFICWSQEGNSFLVLDEQRFAKEILPKFFKHNNMASFVRQLNMYGFRKVMHIDSGIVKQERDGPVEFQHPYFKHGQDDLLENIKRKVSNARPEESKIRQDDLSKILTSVQSVHEQQENMDARLATLKRENEALWTELSDLRKVHVQQQQVIKELVQFIFTLVQNNRLLNLKRKRPLALNINGKKSKFIHQLFEEPIDHSKTTVNGLKNNSDISDDVIICDITDEDPEVTDGISVPDEEDAEIVEITYESSPKTVQQDSANGTIVNSTAHQEAEPKTTHDVSTTNSALQLNKPSCLSLEDPMKLMDSILSENGAISQNINLLGKVELMDYLDSIDCSLEDFQAMLYGKQFNIDPDIIEETISETKNNNSKANKENLDSENTDKQLIQYTTCPLMAFLDGCTPLTPSDPQPEDPPDLLDESLEMKTPRSSLIRLEPLTEAEANEATLFYLCELNSDLPNADTPPLDI

SEQ ID NO: 13422 - protein, 361 aa, Danio rerio
MSQKERPTFYRQEVNKTIWEVPVQYQNLSPVGSGAYGSVCSAFDAKTGFKVAVKKLSRPFQSIIHAKRTYRELRLLKHMRHENVIGLLDVFTPATSLKEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNVTVDIWSVGCIMAELLTGRTLFPGTDHINQLQQIMRLTGTPPSSLISRMPSHEARTYISSLPQMPKRNFADVFIGANPQAVDLLEKMLVLDTDKRITAAEALAHPYFAQYHDPDDEPEAEPFDQSFESRELDIEEWKRQTYEEMISFEPPVFDVDEMES

SEQ ID NO: 13423 - protein, 461 aa, Danio rerio
MTACTGSDFDFAFLEEGFCARDIVEQKINESSLSDDKDAFYVADLGDVLKKHLRWLRVLPRITPFYAVKCNDSRAVVTTLASLGAGFDCASKTEIQIVQSVGVDPSRIIYANPCKQVSQIKYASAHGVQMMTFDSEVELMKVARSHENAKLVLRIATDDSKAVCRLSVKFGATLKSSRLLLERAKELGLDVIGVSFHVGSGCTDPETYSQAISDARYVFDIGAELGYNMSLLDIGGGFPGSEDTKLKFEEIAAVINPALDKYFPVDSGVRIIAEPGRYYVASAYTLAVNIIAKKVIMKEQSASDEEEDVSNDRTLMYYVNDGVYGSFNCILYDHAHVLPTLHKKPKPDERMYPCSIWGPTCDGLDRIVEQCSLPDMQVGDWLLFENMGAYTVAASSTFNGFQKPDIYYIMSRTAWQCMQQIRAQGIPALPLEEPSAGNVPSHCGRESSLDVPAKPCPTQVL

SEQ ID NO: 13424 - protein, 582 aa, Danio rerio
MGGLQKKKYESGSATNYITRNKARKKLSLSLADFRRLCILKGIYPHEPKHKKKVNKGSTAARTYYLLKDIRFLLHEPIVGKFREYKIFVRKLRKAYGKAEWSAVERLKENKPGYKLDHIIKERYPTFIDALRDVDDALSMCFLFSTFARTGKCHVQTIQLCRRLSVEWMNYIISSRSLRKVFLSIKGIYYQAEVLGQTITWIVPYQFAHNHPTDVDYRVMATFTELYTTLLGFVNFRLYQTLNLVYPPKLDGQGEISLKAEFEEDYALESESYTEKLSALSASLARMVASVEEEEAELDHFPTEGEDQEKMEVREKMEQQQSKQKKLFEGLKFFLNREVPRESLAFVIRCFGGEVSWDKSLCIGSTYEATDETITHHIVDRPSMDKQYINRYYIQPQWVYDSVNAKIQLPVEEYFLGVTLPPHLSPFVEETEGDYVPPEKLKLMALQRGEKPQAEEDEEEEGEEEEDDEEDEEDDEQSEDEEEAEEEANLAEMEEKRSQGKSLSVKVTPGKAKAENRARAAEEEKAEEKRLAIMMMKKKEKYLYDKIMFGKKRKVREANKLAAKRKAHDDASKADKKKKKKC

SEQ ID NO: 13425 - protein, 645 aa, Drosophila melanogaster
MKFNLVQTLVFTLCLISVQIYGIQDASGKRIVSKYERIMQMYPQLSSGAGESSQWRAAEKDNQRHPCRRDCADKQPMTCYYYMVVHYDDTMAETCKRYLQSKFRFKLSGKEYIDGIALATQLAANDDCKYADGLESEVMVVNGQLPGMNIEVCYGDTVVADVINSMHETTTIHWHGMHQRLTPFMDGVPHVTQYPIEAGQAFRYRFEVDHGGTNWWHSHTEHQRAFGLAGPLVVRMPPKLNPHAHLYDFDMSEHVIMIQDWVHNFVESVAENILINGRGRNLKKGVKAAKPTLYAHFPVVRGGRYRFRVIFNGVSNCPISFSIDKHDLVVIASDGNDIEPVEVQRIMFHGAERFDFVLHANQEVSNYWIRVKGYSFCAKNQLHQEAVLHYRDADTRALDTHTLSYAYDAPGKTLNELGDDASGARAGNSISLANLNAQRPEPEVAPSVTFYTSMNAFEVRQGEGFRFQMDDISFSMPKMSLLQTRNLGVGQFFCNRSQQADLGFNCRQRHCQCSNVIQVPANQQVEFVISSLSQTPHPIHLHGYTFRVVGMGVLGEQKIGQIEQIDKKTPLPRRAKGAPLKDSVQVPAFGYTILRFYSNSPGYWMFHCHISPHSENGMAAVVRVGEDVEMKMCPVSNCGLCSSVA

SEQ ID NO: 13426 - protein, 277 aa, Drosophila melanogaster
MEEPKSVPTAELPSTSTGASSSSSTLSNNVSYDKIAWTRDITEPLAEESSTSQLRPLGTSIPTNSTASELKKSNTSYSFTGDYLSGGNKADLKGGYPFGGTDTDTKANEKDKEKEHTADDSLYECNICLDTAKDAVVSMCGHLFCWPCLHQWLLTRPNRKLCPVCKAAVDKDKVIPLYGRNSTHQEDPRNKVPPRPAGQRTEPDPVPGFPGFGFGDGFHMSFGIGAFPFGFITSTLNFGEPRPPAANRGTRQYEDEQTLSKLFSYLAVVWILWLFYA

SEQ ID NO: 13427 - protein, 384 aa, Xenopus laevis
MSRSKRDSNFSVFEIGDSTFTVLKRYQNLKPIGSGAQGIVCAAFDAVLERHVAIKKLSRPFQNQTHAKRAYRELVLMKCVNHKNIIGLLNVFTPQKSLEEFQDLYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCILGEMIKGGVLFPGTDHIDQWNKVIEQLGTPCTEFMKKLQPTVRTYVENRPKYAGYSFEKLFPDVLFPADSEHNKLKASQARDLLSKMLVIDASKRISVDDALQHPYINVWYDPLEAEAPPPKIPDKQLDEREHTIEEWKELIYKEVLDWEERAKNGVIRGQPAPLAQVQQ

SEQ ID NO: 13428 - protein, 448 aa, Mus musculus
MEAPGEGPCSESQVIPVLEEDPVDYGCEMQLLQDGAQLQLQLQPEEFVAIADYTATDETQLSFLRGEKILILRQTTADWWWGERAGCCGYIPANHLGKQLEEYDPEDTWQDEEYFDSYGTLKLHLEMLADQPRTTKYHSVILQNKESLKDKVILDVGCGTGIISLFCAHHARPKAVYAVEASDMAQHTSQLVLQNGFADTITVFQQKVEDVVLPEKVDVLVSEWMGTCLLFEFMIESILYARDTWLKGDGIIWPTTAALHLVPCSAEKDYHSKVLFWDNAYEFNLSALKSLAIKEFFSRPKSNHILKPEDCLSEPCTILQLDMRTVQVPDLETMRGELRFDIQKAGTLHGFTAWFSVYFQSLEEGQPQQVVSTGPLHPTTHWKQTLFMMDDPVPVHTGDVVHGFCCVTKKSGMEKAHVCLSELGCHVRTRSHVSTELETGSFRSGGDS

SEQ ID NO: 13429 - protein, 978 aa, Zinnia elegans
MMHPETPICNTCGEHIGFGPDGNGVFVGCHECNFPICKSCLEYEINEGHTACIQCGTPYDGNLTKVGEMEKEPVTRNTMAAHLSNSQDAGLHARNVSTVSTVDTEMTDESGNPIWKNRVESWKDKKNKKKKGGDKVAKEVQVPEDQHIEEKQQSADPNAMQPPSQIIPIPKSQITPYRIVIILRLIILGLFFHYRITNPVESSYGLWLTSVICEIWFAISWVLDQFPKWYPINRVTFTDELSARYEREGEPSELAAVDFFVSTVDPLKEPPLITANTVLSILAVDYPVEKVSCYVSDDGAAMLTFESLVETAEFARKWVPFCKKFSIEPRAPEFYFSQKIDYLKDKVQPSFVKERRAMKRDYEEYKVRVNALVAKAQKTPEEGWTMQDGTPWPGNNPRDHPGMIQVFLGHSGAHDIEGNELPRLVYVSREKRPGYQHHKKAGAENALVRVSAVLTNAPYILNLDCDHYVNNSKAVREAMCFMMDPQVGRDVCYIQFPQRFDGIDRSDRYANRNTVFFDVNMKGLDGIQGPVYVGTGCVFYRQALYGYGPQSLPTLPSPSSSSSCCCCGPKKPKKDLEEFKRDARRDDLNAAIFNLKEIESYDDYERSLLISQMSFEKTFGMSSVFIESTLMENGGLAESANPATMINEAIHVISCGYEEKTAWGKEIGWIYGSVTEDILTGFKMHCRGWRSIYCMPVRPAFKGSAPINLSDRLHQVLRWALGSVEIFLSRHCPLWYGWGGGRLKLLQRLAYINTIVYPFTSLPLVAYCTLPAICLLTGKFIIPTLSNIAAVWFLGLFLSIITTSVLEIRWSGVSIEELWRNEQFWVIGGVSAHLFAVFQGFLKMLAGVDTNFTVTAKAADDQEFGELYMIKWTTVLIPPTTLLVLNLVGVVAGFSDALNKGYEAWGPLFGKVFFAFWVILHLYPFLKGLMGRQNRTPTIVILWSVLLASVFSLVWVKIDPFVSKGDSNLTQGCIAIDC

SEQ ID NO: 13430 - protein, 386 aa, Lycopersicon esculentum
MADMNQHPTVFQKAANQLDLRSSLSQDVHARYGGVQPAIYQRHFAYGNYSNAGLHRGQATQDLSLITSNASPVFVQAPQEKGFAAFATDFLMGGVSAAVSKTAAAPIERVKLLIQNQDEMLKAGRLSEPYKGIGDCFGRTIKEEGFGSLWRGNTANVIRYFPTQALNFAFKDYFKRLFNFKKDRDGYWKWFAGNPASGGAAGASSLFFVYSLDYARTRLANDAKASKKGGERQFNGLVDVYRKTLKSDGIAGLYRGFNISCVGIIVYRGFYFGMYDSLKPVLLTGNLQDSFFASFALGWLITNGAGLASYPIDTLRRRMMMTSGEAVKYKSSLDAFSQIVKNEGPKSLFKGAGANILRAVAGAGVLAGYDKLQVLVLGKKYGSGGA

SEQ ID NO: 13431 - protein, 352 aa, Hemicentrotus pulcherrimus
MGNNPASKQGDKPESYVRDFLTEAKESFTKQWDCDKHNTAALDDFDRIRTLGTGSFGRVMLVRHKPTQKFYAMKILDKQKVVKLKQVEHTLNEKKILQAISFPFIVSLAYHFKDNSNLYMVLDYIPGGEMFSHLRRIGRFSEPHSRFYAAQIVLAFEYLHHLDLIYRDLKPENILIQENGYIAVTDFGFAKRVKGRTWTLCGTPEYLAPEIILSKGYNKAVDWWALGVLIYEMAAGYPPFFADQPIQIYEKIVSGKVRFPSHFSADLKDILRSLLQVDLTKRFGNLKAGVADIKLHKWFQSTDWIAIYQQRVDAPFVPRVKGPGDASQFDEYEEEALKISLTEKCVKEFADF

SEQ ID NO: 13432 - protein, 420 aa, Homo sapiens
QQGSSVASTEPGSGTWKDHGWHAQGASWMGSHIHPLLVIQDEVAAFFVADLGAIVRKHFCFLKCLPRVRPFYAVKCNSSPGVLKVLAQLGLGFSCANKAEMELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKKPSTEQPLYSSSLWGPAVDGCDCVAEGLWLPQLHVGDWLVFDNMGAYTVGMGSPFWGTQACHITYAMSRVAW

SEQ ID NO: 13433 - protein, 757 aa, Homo sapiens
PSPPTPSDGGTKRPGLRALKKMGLTEDEDVRAMLRGSRLRKIRSRTWHKERLYRLQEDGLSVWFQRRIPRAPSQHIFFVQHIEAVREGHQSEGLRRFGGAFAPARCLTIAFKGRRKNLDLAAPTAEEAQRWVRGLTKLRARLDAMSQRERLDHWIHSYLHRADSNQDSKMSFKEIKSLLRMVNVDMNDMYAYLLFKECDHSNNDRLEGAEIEEFLRRLLKRPELEEIFHQYSGEDRVLSAPELLEFLEDQGEEGATLARAQQLIQTYELNETAKQHELMTLDGFMMYLLSPEGAALDNTHTCVFQDMNQPLAHYFISSSHNTYLTDSQIGGPSSTEAYVRAFAQGCRCVELDCWEGPGGEPVIYHGHTLTSKILFRDVVQAVRDHAFTLSPYPVILSLENHCGLEQQAAMARHLCTILGDMLVTQALDSPNPEELPSPEQLKGRVLVKGKKLPAARSEDGRALSDREEEEEDDEEEEEEVEAAAQRRLAKQISPELSALAVYCHATRLRTLHPAPNAPQPCQVSSLSERKAKKLIREAGNSFVRHNARQLTRVYPLGLRMNSANYSPQEMWNSGCQLVALNFQTPGYEMDLNAGRFLVNGQCGYVLKPACLRQPDSTFDPEYPGPPRTTLSIQVLTAQQLPKLNAEKPHSIVDPLVRIEIHGVPADCARQETDYVLNNGFNPRWGQTLQFQLRAPELALVRFVVEDYDATSPNDFVGQFTLPLSSLKQGYRHIHLLSKDGASLSPATLFIQIRIQRS

SEQ ID NO: 13434 - protein, 356 aa, Oryza sativa (japonica cultivar-group)
MAALTSYEMAASILLCAEDSSSVLGFGGEEEEEEEDVVAGKRARCAGPPPPPCVDVAGVDFAVPSEECVARLVETEADHMPREDYAERLRAGGGDGDLDLRVRMDAIDWIWKVHSYYSFAPLTACLAVNYLDRFLSLYQLPDGKDWMTQLLAVACLSLAAKMEETDVPQSLDLQVGEERYVFEAKTIQRMELLVLSTLKWRMQAVTPFSYVDYFLRELNGGDPPSGRSALLSSELILCIARGTECLGFRPSEIAAAVAAAVVGEEHAAFSHVNKERMSHCQEVIQAMELIHPKPSSPSRVFVSSSIPRSPTGVLDAAGCLSYRSDDSAVASHYAASSWGYEHDSSPVSSKRRKISR

SEQ ID NO: 13435 - protein, 350 aa, Homo sapiens
NPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 13436 - protein, 262 aa, Bradyrhizobium japonicum
MGSLSGKNAVVTGSTSGIGLAYARAFAAPGANVVINGFGSAEDIEKERAKIEADFGGKAIYSPADMTKPAEIAGMIALGEKTFGSVDVLVNNAGIQFVSPIEEFPPEKWDQIIAINLSSAFHAIRAAVPGMKKKGWGRIINTASAHSLVASPFKSAYVSAKHGIAGLTKTVALEVATHKITCNCISPGYVWTPLVEKQIPDTMKARNLTRDEVINDVLLDAQPTKEFVTSEQVAALALFLCSDDAAQITGTNLSIDGGWTAE

SEQ ID NO: 13437 - protein, 161 aa, Brassica juncea
MSTKKIVLKSSDDESFEVDEAVARESQTLAHMVEDDCTDNGIPLPNVTGKILAKVIEYCKKHVDAAAAKTEATADGGAPSDEDLKAWDAEFMNIDQATLFELILAANYLNIKNLLDLTCQTVADMIKGKTPDEIRTTFNIKNDFSPEEEEEVRRENQWAFE

SEQ ID NO: 13438 - protein, 145 aa, Brassica juncea
MVLKSSDGESFEVDEAVALESQTIAHMVEDDGVDNGIPLPNVTSKILAKVIEYCKKHVDAAASKTEAVDGGASSDDDLKAWDAEFMKIDQATLFELILAANYLNIKNLLDLTCQTVADMIKGKTPEEIRTTFNIKNDFTAEEEEE

SEQ ID NO: 13439 - protein, 160 aa, Brassica juncea
MSTKKIVLKSSDGESFEVDEAVALESQTIAHMVEDDCVDNGVPLPNVTSKILAKVIEYCKKHVDAVASKSEAVDGGGSSDDDLKAWDAEFMKIDQATLFELILAANYLNIKNLLDLTCQTVADMIKGKTPEEIRTTFNIKNDFSPEEEEEVRRENQWAFE

SEQ ID NO: 13440 - protein, 161 aa, Brassica juncea
MSTKKIVLKSSDGESFEVDEAVARESQTLAHMVEDDCIENGIPLPNVTSKILAKVIEYCKKHVDAAAAKTEGAVDGAASSDDDLKAWDTEFMKIDQATLFELILAANYLNIKNLLDLTCQTVADMIKGKTPEEIRTTFNIKNDFSPEEEEEVRRENQWAFE

SEQ ID NO: 13441 - protein, 160 aa, Brassica juncea
MSTKKIVLKSSDGESFEVDEAVALESQTIAHMVEDDCVDNGIPLPNVTSKILAKVIEYCKKHVDAAASKTEAVDGGASSDDDLKAWDAEFMKIDQATLFELILAANYLNIKNLLDLTCQTVADMIKGKTPEEIRTTFNIKNDFTPEEEEEVRRENQWAFE

SEQ ID NO: 13442 - protein, 160 aa, Brassica juncea
MSTKKIVLKSSDGESFEVDEAVALESQTIAHMVEDDCVDNGVPLPNVTSKILAKVIEYCKKHVDAAASKSEAVDGGGSSDDDLKAWDAEFMKIDQATLFELILAANYLNIKNLLDLTCQTVADMIKGKTPEEIRTTFNIKNDFSPEEEEEVRRENQWAFE

SEQ ID NO: 13443 - protein, 1088 aa, Homo sapiens
MRPKTFPATTYSGNSRQRLQEIREGLKQPSKSSVQGLPAGPNSDTSLDAKVLGSKDATRQQQQMRATPKFGPYQKALREIRYSLLPFANESGTSAAAEVNRQMLQELVNAGCDQEMAGRALKQTGSRSIEAALEYISKMGYLDPRNEQIVRVIKQTSPGKGLMPTPVTRRPSFEGTGDSFASYHQLSGTPYEGPSFGADGPTALEEMPRPYVDYLFPGVGPHGPGHQHQHPPKGYGASVEAAGAHFPLQGAHYGRPHLLVPGEPLGYGVQRSPSFQSKTPPETGGYASLPTKGQGGPPGAGLAFPPPAAGLYVPHPHHKQAGPAAHQLHVLGSRSQVFASDSPPQSLLTPSRNSLNVDLYELSSTSVQQWPAATLARRDSLQKPGLEAPPRAHVAFRPDCPVPSRTNSFNSHQPRPGPPGKAEPSLPAPNTVTAVTAAHILHPVKSVRVLRPEPQTAVGPSHPAWVPAPAPAPAPAPAPAAEGLDAKEEHALALGGAGAFPLDVEYGGPDRRCPPPPYPKHLLLRSKSEQYDLDSLCAGMEQSLRAGPNEPEGGDKSRKSAKGDKGGKDKKQIQTSPVPVRKNSRDEEKRESRIKSYSPYAFKFFMEQHVENVIKTYQQKVNRRLQLEQEMAKAGLCEAEQEQMRKILYQKESNYNRLKRAKMDKSMFVKIKTLGIGAFGEVCLACKVDTHALYAMKTLRKKDVLNRNQVVHVKAERDILAEADNEWVVKLYYSFQDKDSLYFVMDYIPGGDMMSLLIRMEVFPEHLARFYIAELTLAIESVHKMGFIHRDIKPDNILIDLDGHIKLTDFGLCTGFRWTHNSKYYQKGSHVRQDSMEPSDLWDDVSNCRCGDRLKTLEQRARKQHQRCLAHSLVGTPNYIAPEVLLRKGYTQLCDWWSVGVILFEMLVGQPPFLAPTPTETQLKVINWENTLHIPAQVKLSPEARDLITKLCCSADHRLGRNGADDLKAHPFFSAIDFSSDIRKQPAPYVPTISHPMDTSNFDPVDEESPWNDASEGSTKAWDTLTSPNNKHPEHAFYEFTFRRFFDDNGYPFRCPKPSGAEASQAESSDLESSDLVDQTEGCQPVYV

SEQ ID NO: 13444 - protein, 303 aa, Rattus norvegicus
MGSWKSGQSYLAAGLLQNQVAVVTGGATGIGKAISRELLHLGCNVVIASRKLDRLTAAVDELRASQPPSSSTQVTAIQCNIRKEEEVNNLVKSTLAKYGKINFLVNNAGGQFMAPAEDITAKGWQAVIETNLTGTFYMCKAVYNSWMKDHGGSIVNIIVLLNNGFPTAAHSGAARAGVYNLTKTMALTWASSGVRINCVAPGTIYSQTAVDNYGELGQTMFEMAFENIPAKRVGLPEEISPLVCFLLSPAASFITGQLINVDGGQALYTRNFTIPDHDNWPVGAGDSSFIKKVKESLKKQARL

SEQ ID NO: 13445 - protein, 817 aa, Pyrococcus furiosus DSM 3638
MAYRFIKWFEELSKNDVPLVGGKGANLGEMTNAGIPVPPGFCVTAEAYKYFVENVKVSKEDVKRILGEKVNKGTISEVLAQAPDEPRPLQDWIMDIISKTDVDDSKMLQENTEAIRTLIKSLDMPSEIAEEIKQAYKELSQRFGQEEVYVAVRSSATAEDLPEASFAGQQETYLDVLGADDVIDKVKRCWASLWTARATFYRAKQGFDHSKVYLSAVVQKMVNSEKSGVMFTANPVTNNRNEIMINASWGLGEAVVSGAVTPDEYIVEKGTWKIKEKVIAKKEVMVIRNPETGRGTVMVKVAEYLGPEWVEKQVLTDEQIIEVAKMGQKIEDHYGWPQDIEWAYDKDDGKLYIVQSRPITTLKEEATAEEAEEVEEAEVILKGLGASPGIGAGRVVVIFDASEIDKVKEGDILVTTMTNPDMVPAMKRAAAIVTDEGGRTSHAAIVSRELGIPCVVGTKEATKKLKTGMYVTVDGTRGLVYKGIVKSLVKKKEEAKAEGGQVVVAGAPLVTGTMVKVNVSMPEVAERAAATGADGVGLLRAEHMILSIGQHPIKFIKEGKEEELVEKLAEGIEKVAAAFYPRPVWYRTLDAPTNEFREMPGGEDEPEERNPMLGWRGIRRGLDQPELLRAEFKAIKKVVEKGYNNIGVMLPLVSHPEQIREAKRIAREVGLEPHKDVAWGVMIEVPAAAIIIEDLIKEGIDFVSFGTNDLTQYTLAIDRDNERVAKLYDETHPAVLKLIKHVIKVCKRYGVETSICGQAGSDPKMARILVRLGIDSISANPDAVQLIRQVVAQEERKLMLEAARKQLFEEEEEEELF

SEQ ID NO: 13446 - protein, 430 aa, Pyrococcus furiosus DSM 3638
MENPYEIVGVVAREILDSRGNPTVEVDVYTHVGMGRAAVPSGASTGTHEALELRDGGKRYHGKGVRRAVENVNKIIAPELIGMDVRWQREIDALLLELDGTENKSNVGANAILAVSLAVAKAAANSLELPLYQYLGGVNAYVLPVPLSNVINGGVHAGNDLDFQEFMIMPIGADSFREAIRWVSETYHVLKKVIMEKYGKNAVNVGDEGGFAPPMKEVTEPLDVLIKAIEEAGYKPGDEIALALDVASSELFNEETGKYVVGGKEYDRGELLELYKDLTSTYPIVSIEDPFHEEDWEGFVMITKELGHKVQIVGDDLFVTNPKRLRKGIELGAANALLLKVNQIGTLSEAMDAAFTAFRAGYGVIVSHRSGETEDATIADLAVALNAGQIKTGAPARSDRNAKYNQLIRIEEELEGVAVYAGKRFRKVFF

SEQ ID NO: 13447 - protein, 485 aa, Pyrococcus furiosus DSM 3638
MGKFVEKLENAIRGYTFDDVLLIPQPTEVEPKDVDVSTQITPNVKLNIPILSAAMDTVTEWEMAVAMAREGGLGVIHRNMSIEEQVEQVKRVKRAERFIVEDVITIAPDETIDYALFLMEKHGIDGLPVVEEDRVVGIITKKDIAAREGRTVKELMTREVITVPESVDVEEALKIMMENRIDRLPVVNEDGKLVGLITMSDLVARKKYKNAVRNEKGELLVAAAVSPFDLRRAIELDRAGVDVIVVDTAHAHNLKAIKAMKEMRQKVSADFIVGNIANPKAVDDLTFADAVKVGIGPGSICTTRIVAGVGVPQITAIAMVADRAQEYGLYVIADGGIKYSGDIVKAIAAGADAVMLGNLLAGTKEAPGKEVIINGRKYKQYRGMGSLGAMMKGGAERYYQGGYMKTRKFVPEGVEGVVPYRGTVSEVLYQLVGGLKAGMGYVGARNIKELKEKGEFVIITSAGLRESHPHDIIITNEAPNYPLER

SEQ ID NO: 13448 - protein, 280 aa, Pyrococcus furiosus DSM 3638
MNERRKAELVLLGATFIWGSTFPVMKIGVEDFPPITFIALRFGIASFVLFLALRKHIRKDALFPGLILGFTLFLGHGFQIVGLKYTTPSNSAFITSLYVVFTPFIAFLFFRKGLKMFDAFSLSLAVIGLYLISNAELRLNYGDALTVVAALSFAFQIVLVEYFGNLGVGLAFWQIFWNFILSTVYAGIFEGISLPSDPKVLGGIIYTGIFATALSFTLQVKYQPKVESYKAAIIYSSEPIFAHLLALAFLNDRLPPKGYLGAFLILLAVWLELYQERKNY

SEQ ID NO: 13449 - protein, 421 aa, Pyrococcus furiosus DSM 3638
MDCGKDYCVKDLSLAEEGWKKIDWVSRFMPVLQYIKREFEEKKPFKGVRIAATLHLEMKTAFLLLTLKAGGAEVSAAASNPLSTQDDVVAALAKAGVKVYAIRGESREQYYEFMHKALDIRPNIIIDDGADMISLVHKERQEMLDEIWGGSEETTTGVIRLRAMEKAGILKFPVIAVNDSYMKYLFDNRYGTGQSTWDGIMRATNLLIAGKNVVVVGYGWCGRGIAMRARGLGATVIVVEVDPIKALEARMDGFLVMDMKEAAKIGDIFVTATGNIKCIRREHFELMKDGAIMANAGHFDVEIWKPDLEKLAVEINNPRPNVTEYKLKDGRRLYLLADGRLVNLVAADGHPAEIMDMSFALQAKAAEYIKDNHERLEPKVYILPREIDEMVARIKLESMGIKIEELTEEQKKYLESWEHGT

SEQ ID NO: 13450 - protein, 473 aa, Pyrococcus furiosus DSM 3638
MIHYETLVYGGDHVNIKKLTPLLTLLLFFIVLASPVSAAKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 13451 - protein, 166 aa, Pyrococcus furiosus DSM 3638
MMVNTMNILRKIFRRICRTAVKFVFPNGFRILLLRWSGVKVGKDVAINEGFTMACDIGYEENLVIEDRVAIGPNVTIVITSHPNNSHLRNLKDRYPSIEVFGKVHIKHDAWIGAGAIILPNVTIGEFSIIGAGSVVTKDVPPYSIAVGVPARVVKKLKIEKKTENT

SEQ ID NO: 13452 - protein, 339 aa, Pyrococcus furiosus DSM 3638
MSIIQDIIGRIVVLRGGQYSVEVDVVTDESFGRFAAPIDENPALYIAEARRAVSEVDEIIGPELIGFDAIDQELIDSYLWEIDGTDNFSHIGANTALAVSVAVAKAAANSRNISLYSYIGGTFTTELPVPVVTFGADENFEYHVIVRDLLEVTDIIDAVVRLLDFSLSLEELSKASEQVGLELGLEVSLGITMRKELETEKVLEIVEDYNIAYIKPIGTPELFLELIAGTHGVFIDGEYLYRKYNILDRKYYNALSIKPINLGTLTDLYNFVNDVKAEKITPILSESKYEPADETLPHLALGLRCPAMLIHMNSVEKINELNRIAEELGERGRIITFEE

SEQ ID NO: 13453 - protein, 307 aa, Pyrococcus furiosus DSM 3638
MIESFREAFGRALVEIGKKREEVVVIDADVKGSTKTIYFEKAFPKRFIQVGISEQDMIGTAAGLAIAGKIPVASAFAVFLMRAWEQIRNTVARDNLNVKIVGTHSGFSDYMDGSSHQCLEDIALMRVLPNMKVVVPADAYATKVLLEQIIDTYGPVYMRLGRDYAPRVYEDGTKIKLGKANVLRKGKEILLVAAGTLVHTALNVAKMLEKLNVDASVIDMHTIKPLDEKTLLNYAKRAELVITLEEHSIYGGLGGAVAEVLSEKLPRRVVRIGTVEFGQSGRDYLALLDRYGLTPDKIYQKIVQVVM

SEQ ID NO: 13454 - protein, 203 aa, Pyrococcus furiosus DSM 3638
MAHGPRYRVPFRRRREGKTNYRKRLKLLKSGKPRLVVRKSLNHHIAQIIVYDPKGDRTLVSAHTRELIRDFGWKGHCGNTPSAYLLGLLIGYKAKQAGIEEAILDIGLHPPVRGSSVFAVLKGAVDAGLNVPHSPEIFPDEYRIRGEHIAEYAKMLKEQDEEKFRRQFGGYLVKGLDPEKLPEHFEEVKARIIEKFEGEGARE

SEQ ID NO: 13455 - protein, 358 aa, Pyrococcus furiosus DSM 3638
MHNLAIKLRERGHEVGIVTNNRVTGKEKELEKYGIDLIKIPGVVSPLLEVNITYGLKSSELNEFLNNFDVIHSHHAFMPLALKAVKAGRTMEKATLLTTHSISFAHESKLWDTLGLTIPLFRSYLKYPHRIIAVSKAAKSFIEHFTSVSVSIVPNGVDDTRFFPAKHKDKIKAKFGLEGNIVLYVSRMSYRKGPHVLLNAFSKIEDATLVMVGSGEMLPFLKAQAKFLGIEERVVFMGYVPDDALPEVFRMADVFVLPSVSAEAFGIVVLEAMASGVPVVATDVGGIPEIIKENEAGLLVPPGNELKLREATQKLLKNEELRKWYGMNGRKAVEEKYSWDKIVVEIERIYSEVLEEQS

SEQ ID NO: 13456 - protein, 263 aa, Pyrococcus furiosus DSM 3638
MKPICELISLKGKRALITGAASGIGKATAFRFAEAGADLYLVDINEEGLKLVKERIQEKYDVNVEIFRVNLAKKQEIDILWKLLEGREPDILVNNAGVYWFKDFVEVDEEFYRKVMAINLDSVFWMCQHFIRRRKNRGEVIINVSSIEAFLPFAKGLVHYDTAKLGVVALTRAIAREYGKTIRANVVVPGGIETEGVKKLKKEAIAKFDMEKISTSLHFNARLPMGRFGDPDEVARVILFLASDMASYINGAVIPVDGGFLSA

SEQ ID NO: 13457 - protein, 278 aa, Pyrococcus furiosus DSM 3638
MKRVNAFNDLKRIGDDKVTAIGMGTWGIGGRETPDYSRDKESIEAIRYGLELGMNLIDTAEFYGAGHAEEIVGEAIKEFEREDIFIVSKVWPTHFGYEEAKKAARASAKRLGTYIDLYLLHWPVDDFKKIEETLHALEDLVDEGVIRYIGVSNFNLELLQRSQEVMRKYEIVANQVKYSVKDRWPETTGLLDYMKREGIALMAYTPLEKGTLARNECLAKIGEKYGKTAAQVALNYLIWEENVVAIPKASNKEHLKENFGAMGWRLSEEDREMARRCV

SEQ ID NO: 13458 - protein, 339 aa, Pyrococcus furiosus DSM 3638
MAHVAEWKKKEVEELANLIKSYPVVALVDVSSMPAYPLSQMRRLIRENNGLLRVSRNTLIELAIKKVAQELGKPELEKLINYIEGGAGILVTTMNPFKLYKFLQQNRQPAPAKPGAKVPKDVVIPAGPTSLAPGPIVGQMQAMGIPARIERGKVTIQKDTVVLKAGEEITPELANILNALGIQPLEVGLDLLAVYEDGIIYTPDVLAIDESEYINMLQKAYMHAFNLAVNIAYPTPQTIEAIIQKAFLNAKAVAVEAGYITKETISDIIGRAIRAMLLLAQQLPEDVLDEKTKELLSAQAQVSVAQVEEEKKEEKVEEEKEDEEASEEEALAGLSALFG

SEQ ID NO: 13459 - protein, 213 aa, Arabidopsis thaliana
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLRIPESTCAKDIQKAAAEAALAFQDETCDTTTTDHGLDMEETMVEAIYTPEQSEGAFYMDEETMFGMPTLLDNMAEGMLLPPPSVQWNHNYDGEGDGDVSLWSY

SEQ ID NO: 13460 - protein, 400 aa, Cryptosporidium parvum
MGTKNIGKGLTFEDILLVPNYSEVLPREVSLETKLTKNVSLKIPLISSAMDTVTEHLMAVGMARLGGIGIIHKNMDMESQVNEVLKVKNWISNLEKNESTPDQNLDKESTDGKDTKSNNNIDAYSNENLDNKGRLRVGAAIGVNEIERAKLLVEAGVDVIVLDSAHGHSLNIIRTLKEIKSKMNIDVIVGNVVTEEATKELIENGADGIKVGIGPGSICTTRIVAGVGVPQITAIEKCSSVASKFGIPIIADGGIRYSGDIGKALAVGASSVMIGSILAGTEESPGEKELIGDTVYKYYRGMGSVGAMKSGSGDRYFQEKRPENKMVPEGIEGRVKYKGEMEGVVYQLVGGLRSCMGYLGSASIEELWKKSSYVEITTSGLRESHVHDVEIVKEVMNYSK

SEQ ID NO: 13461 - protein, 248 aa, Helianthus annuus
MGRGKVQLRRIENKINRQVTFSKRRGGLLKKAHEISVLCDAEVALIVFSNKGKLFEFSTDSCMDSILERYERYSYTERQLVAADATPRSWTLEYNKLKSRAELLQRNHRHYMGEDIESLSLKEIQNLEQQLDTGLKNIRTRKNQLLHESISELQKKGKAIQEQNTTLTKKIKEKEKDKTIPQNTQWEMHNYVDHDTTFLMPPPPPALNMGGDYNHGGGGSSEGADGRTNELDLSLQPIYSCHMRCFPS

SEQ ID NO: 13462 - protein, 902 aa, Arabidopsis thaliana
MASEASPSSSATRSEPPKDSPAEERGPASKEVSEVIESLKKKLAADRCISIKKRIDENKKNLFAITQSFMRSSMERGGSCKDGSDLLVKRQRDSPGMKSGIDESNNNRYVEDGPASSGMVQGSSVPVKISLRPIKMPDIKRLSPYTTWVFLDRNQRMTEDQSVVGRRRIYYDQTGGEALICSDSEEEAIDDEEEKRDFLEPEDYIIRMTLEQLGLSDSVLAELANFLSRSTSEIKARHGVLMKEKEVSESGDNQAESSLLNKDMEGALDSFDNLFCRRCLVFDCRLHGCSQDLIFPAEKPAPWCPPVDENLTCGANCYKTLLKSGRFPGYGPIEGKTGTSSDGAGTKTTPTKFSSKLNGRKPKTFPSESASSNEKCALETSDSENGLQQDTNSDKVSSSPKVKGSGRRVGRKRNNNRVAERVPRKTQKRQKKTEASDSDSIASGSCSPSDAKHKDNEDATSSSQKHVKSGNSGKSRKNGTPAEVSNNSVKDDVPVCQSNEVASELDAPGSDESLRKEEFMGETVSRGRLATNKLWRPLEKSLFDKGVEIFGMNSCLIARNLLSGFKSCWEVFQYMTCSENKASFFGGDGLNPDGSSKFDINGNMVNNQVRRRSRFLRRRGKVRRLKYTWKSAAYHSIRKRITEKKDQPCRQFNPCNCQIACGKECPCLLNGTCYEKYCGCPKSCKNRFRGCHCAKSQCRSRQCPCFAADRECDPDVCRNCWVIGGDGSLGVPSQRGDNYECRNMKLLLKQQQRVLLGISDISGWGAFLKNSVSKHEYLGEYTGELISHKEADKRGKIYDRENCSFLFNLNDQFVLDAYRKGDKLKFANHSPEPNCYAKVIMVAGDHRVGIFAKERILAGEELFYDYRYEPDRAPAWAKKPEAPGSKKDENVTPSVGRPKKLA

SEQ ID NO: 13463 - protein, 372 aa, Trypanosoma brucei
MSSEKVAGYVQCVVGIIFGVVTGGASIYVTIAMELLQVAVPYVLVTLGLQRRPPKGGVDKAMAEAESVEAEVMKKPSKQQRSFRALFIGIDYKGTPAELRGCQADAVMMAGTMEKIGIPITERCVLMDTDDPRFNAIKPTRANILQHMAWLVKDAKPGDALFLHYSGYGAQVRAEEDKEEEFDQCIVPCDYEENGCILDNELHEIISTLPRGVRLTAVFDCSHAGTLLDLPFSLICSSNDCSAVGEMKRIRTGGDVNAHVLMFSACGDDEAAADLPNAGDFVEGASGSGGAATQCFISMLLNKTPGTIYSLLSTTRDKLREKGFKQSPQMSASRCLSLTEKFTLTELFSVAEPCPNILTGEPRWKTTPLGGK

SEQ ID NO: 13464 - protein, 347 aa, Trypanosoma brucei
MCSLITQLCDAGQLADYVGLGWLNAVSSQPYLVQALGLQPPPRRVDVDAAFRDAEGLHGHQPWVATPLPGRTVRALFIGINYYGTSAALSGCCNDVKQMLATLQKKGLPINEAVILVDEDNFPGRTDQPTRDNIVRYMAWLVKDAKPGDVLFFHYSGHGTQCKSRGDSDEKYDQCIAPVDFQKSGCIVDDDIHKLLFSRLPEKVRLTAVFDCCHSGSIMDLPFTYVCSGGEQASGTPHMKRIREGNDVLGDVMMISGCADEQTSADVKNTATFGTGSTGAGGAATQCITCMLMNNQSLSYGKLLIETRDMLKRKGFKQVPQLSASKAIDLDQTFSLTEMFSVDRSVQ

SEQ ID NO: 13465 - protein, 357 aa, Trypanosoma brucei
MAVDPRCLLSLCSTISKASSAKGTNDFVKIGMELWQTAQPYLVQALGLQPPPPKVDVDAAVANAGDAHGEQPWVATPLPGQTVRALFIGINYYGTSAALSGCCNDVKQMLATLQKKGLPINEAVILVDEDNFPGRTDQPTRDNIVRYMAWLVKDAKPGDVLFFHYSGHGTQCKSRGDSDEKYDQCIAPVDFQKSGCIVDDDIHKLLFSRLPEKVRLTAVFDCCHSGSIMDLPFTYVCSGGEQASGTPHMKRIREGNDVLGDVMMISGCADEQTSADVKNTATFGTGSTGAGGAATQCITCMLMNNQSLSYGKLLIETRDMLKRKRFKQVPQLSASKAIDLDQTFSLTEMFSVDRSVQ

SEQ ID NO: 13466 - protein, 353 aa, Trypanosoma brucei
MGGCVSTALKVGAETVAEGHIDLISFAINYFKNAVPYIVKYLGRQQRPKEVDMEATLTEAKESKGFQPWKISCQPKGAVRGLFIGVNYGNTEAQLSGCCHDIMMMIGALQKRNFPLTEVVILADEEDVPGRTGEPTRANILRYLAWLAQDAQPNDVLFFHYSGHGTRANARDDDCEEYDQCIVPMDYVENGCIVDNEIHEILVSQLPKGVRLTAVFDCSHSGSMLDLPYAYVCDSSKDGSGSCGMKRVREDNDVQADVLMISACADDEAALGVDNTQDFYESGKDSGGAATFCLTAMMMREEPLTFLDLLVHTREMLKSRGFTQVPHLSASKPINLMQRFSLEGLFPQERTLL

SEQ ID NO: 13467 - protein, 340 aa, Trypanosoma brucei
MDAALALLFGQVATAVLPYVVNSIGRVPRPKRVDVKKAMGEAHQCRPVVPYRAPRPYTEGRVKALFIGINYTGSSAQLGGCVNDVMHMLKTLQRIEFPISECCILVDDRRFPNFTAMPTRENIIKYMAWLVYDVRPGDVLFFHFSGHGAETKGGRDSNEKMDQCLVPLDYDKAGAILDDDLFELMIKGLPAGVRMTAVFDCCHSASLLDLPFAFVAGRNVSSNQRHEMRMVRKDNYSRGDVVMFSGCEDSGTSADVTNTSSFGNGTVAAGGAATQAFTWALLNTTGYSYIDIFMKTREVLRQKGYKQVPQLSSSKPVDLYKQFSLFGPLTMNASLVQDLP

SEQ ID NO: 13468 - protein, 634 aa, Passiflora edulis
MDSCDCIDTQWGHEGILVKYQYISDVLIAFAYFSIPIELVYFVQKSAFFPYRWVLMQFGAFIVLCGATHFINLWTFSTHSKAVAVVMAIAKVSCAVVSCATALMLFHIIPDILSVKTRELFLKNKAEELDREMGLILTQEETGRHVRMLTHEIRSTLDRHIILKTTLVELGRTLGLEECAIWMPSRTGSTLQLSHTLNYQAQIGSPVSINIPEVNQVFNSARATRISYTCPLARIRPLVGGYLLPEVVAVRVPLLHLSNFQIKDWPDLSAKSYAVMVLILPTNSARTWRDHELELVEVVADQVAVALSHAAILEESMRARDQLMEQNVALNMARREAEMAVHARTDFLAVMKHEMRTPMHAIIALSSLLLETELMPEQRAMIEIVLKSSNLLATLTNDVLDLSRLEDGSLGLDLAVFNLHEVFREVINLIKPIASVKRLTLTQIMTPDLPSFAVGDEKRLMQTILNVVGNGVKFTKEGSVSVIVSVANPDSLREWRLPDVYPISSDGHFYLQVQVKDSGCGILPQDIPLLFTKFFHPRSESNRGTDGAGLGLAISKRFVSLMGGHMWIDSEGLDKGTVATFIVKLGHCTDRDDSSAHHAASRGRANNESLMEGHKLPFRDNGFVSSYSRYQISV

SEQ ID NO: 13469 - protein, 129 aa, Oryza sativa (japonica cultivar-group)
MNCKQVTDIKRFNNMMSDHGIYLRERLLIPISNPEILQGSTCYIEMDYNARREVAVFYPQGRPSGKAESSTNTAAAERRSRRILESVKRSLHTDDRTAAYYLSVTDGDPRAAMMEYSEDLRWERQQTGH

SEQ ID NO: 13470 - protein, 143 aa, Oryza sativa (japonica cultivar-group)
EFRTPDFHPTASDDNFYLKVQIKDTGCGISPQDLPQVFTKFAQSQPGGNRGYSGSGLGLAICKRFVTLMGGHIWLDSEGTGRGCTVTFVIQLGICDNTNAYQQKLIPLVWPSSGDADFVGPVPNAPNEEKGQASLKSRYQRSI

SEQ ID NO: 13471 - protein, 258 aa, Pseudomonas putida
MNKRFQDKTAVITGAAQGIGRRVAERMAAEGGRLLLVDRSELIHELADELVGVAEVLTLTADLEQFADCQRVMAAALERFGRLDILINNVGGTIWAKPFEHYQEHEIEAEVRRSLFPTLWCCHAAVPPMLEQGSGAIVNVSSVATRGVNRVPYGAAKGGVNALTACLAFETAERGIRVNATAPGGTEAPPRRIPRNSAEPSEQEKVWYQQIVDQTLDSSLMKRYGNIDEQAGAILFLASDDAAYITGVTLPVAGGDLG

SEQ ID NO: 13472 - protein, 104 aa, Hordeum vulgare subsp. vulgare
MGRSPCCEKEHTNKGAWTKEEDQRLIAYIRANGEGCWRSLPKAAGLLRCGKSCRLRWMNYLRPDLKRGNFTDDEDELIIRLHSLLGNKWSLIAGQLPGRTDNEI

SEQ ID NO: 13473 - protein, 733 aa, Bordetella pertussis
MAAEKAPAKTAVKVAKPAAKTAAKKTATKTVAAKTAAADKPAKTTKARAKKAEDKLADLVGAARPAPSGRRPGRPAKNANNDSDAFDDSMDGEGEVLPDLKPPKRGGKRGKADPKDLIARGPVSPEEYEARRNRLKQLIKLGKDRGYLTYGEINDHLPDDLVDAEAIDGIISTFSDMGIAVYDQAPDAETLLMSENAPVASNDDDVEDEAEAALTTVDSDFGRTTDPVRMYMREMGSVELLTREGEIEIAKRIEDGLKHMVMAISACPTTINEILAHITRVREGQAQIDEVVDGLVDPEDGEEYAGAGVTADEDEGDDGPAGGMSSKQLEDLRVKALAKFDEVSKQFEKMRQSYEKEGYKSDAYLKAQDIIQTELMGIRFTAKMVEKLADTLRAQVEEVRQLERAVLHTCVDRAGMPRSHFLKAFPGNETNLQWVLDEVAAAHAYSETLERQIPAVQELQQKLIDLQTRVVLPLKDLKDVNKRMATGEAKARKAKREMTEANLRLVISIAKKYTNRGLQFLDLIQEGNIGLMKAVDKFEYRRGYKFSTYATWWIRQAITRSIADQARTIRIPVHMIETINKMNRISRQILQETGAEPDPATLAQKMDMPEDKIRKILKIAKEPISMETPIGDDDDSHLGDFIEDTATLAPSDAALHGSMRDVVKEVLDSLTPREAKVLRMRFGIEMSTDQTLEEVGKQFDVTRERIRQIEAKALRKLRHPSRADKLKSFLEGQ

SEQ ID NO: 13474 - protein, 113 aa, Mus musculus
MSASVVSVISRFLEEYLNSTPQRLKLLDAYLLYILLTGALQFGYCLLVGTFPFNSFLSGFISCVGSFILAVCLRIQINPQNKADFQGISPERAFADFLFASTILHLVVMNFVG

SEQ ID NO: 13475 - protein, 302 aa, Hordeum vulgare subsp. vulgare
MGRPSSGAVGQPKVRKGLWSPEEDEKLYNHIIRHGVGCWSSVPRLAALNRCGKSCRLRWINYLRPDLKRGCFSQQEEDHIVALHQILGNRWSQIASHLPGRTDNEIKNFWNSCIKKKLRQQGIDPATHKPMASADTATAAAALPDAEEEDRKPLCPAVDGSLVPKQPAVFDPFPLCVDYGAGFAEELGAANAAALYGQLCGGKEVADDDAGFGAADYSCVLDVSENLGYGESSSNSSNWNYGGEVGSVLDGEVPHWAKPEPAFAEMERQQQHSPAEQKLSLPCQEQSLLASFDFNLELEPYF

SEQ ID NO: 13476 - protein, 189 aa, Salmo salar
MSEGVPSPVCPSGTLAQAHQSPHRLPMEGQAAQAAGSTNVCWLRLKASADHLIHVALRILCNVMHSHIVHLVPNSARAIVNMAAAMDVDTPSATNSGASKKRFEVKKWNAVALWAWDIVVDNCAICRNHIMDLCIECQANQASATSEECTVAWGVCNHAFHFHCISRWLKTRQVCPLDNREWEFQKYGH

SEQ ID NO: 13477 - protein, 236 aa, Homo sapiens
MDLVLRVADYYFFTPYVYPATWPEDDIFRQAISLLIVTNVGAYILYFFCATLSYYFVFDHALMKHPQFLKNQVRREIKFTVQALPWISILTVALFLLEIRGYSKLHDDLGEFPYGLFELVVSIISFLFFTDMFIYWIHRGLHHRLVYKRLHKPHHIWKIPTPFASHAFHPIDGFLQSLPYHIYPFIFPLHKVVYLSLYILVNIWTISIHDGDFRVRMKNYSMESLQRLNRLLPSYS

SEQ ID NO: 13478 - protein, 355 aa, Phytophthora infestans
MGLCASQMNDNDRQAMAKSREIEAKNEEAHRVEQEKVKLLLLGAGESGKSTVFKQMKILFGAALTEDEKRHCTPIIYNNVVTSMKMLIEQCAEMKLKGDVVCVQDFEDIRTLSDEAEVNLVIGQKIKNLWSDPGIVATWNRRAEFQIIESVKYYFNDLDRIMRDDYAATQQDMLYARVRTSGIVEERYQIDGATFVMYDVGGQRNERKKWIHCFEDVTAVIFVAALSEYDQSLYEDASTNRMIEAITLFDEIINNKFFLNSAMILFLNKKDLFQDKIKKVDPKTVEVFKDFPGGIGDYELGVQYFLGKFMEMNRQPEKEIYHHVTCATDSQNVQVVFNACKDIILKQNIKGSGFM

SEQ ID NO: 13479 - protein, 355 aa, Phytophthora palmivora
MGLCASQMSDSDRQAMAKSREIEAKNEEAHRVEHEKVKLLLLGAGESGKSTVFKHMKILYGASLTEEEKRHCTPIIYNNVVTSMKMLIEQCTEMKLKGEVVCAQDFEDIRTLSDEAEVNPVVGQKIKNLWTDPGIVATWNRRAEFQIIESVKYNSNDLDRIMRDDYAATQQDMLYARVRTSGIVEERYQIDGATFVMYDVGGQRNERKKWIHCFEDVTAVIFVAALSEYDQSLYEDASTNRMIEAITLFDEIINNKFFLNSAMILFLNKKDLFQDKIKKVDPKTVDVFKDFPGGIGDYELGVQYFLGKFMEMNRQPEKEIYHHVTCATDSQNVQVVFNACKDITLKQNIKGSGFM

SEQ ID NO: 13480 - protein, 344 aa, Phytophthora infestans
MGDAAELKKKCESLKETIEKTREAKSDGGFQSANASSGAKAILAPPKCRRLLKGHFGKIYAMQWGGDSSSLVSASQDGKLIVWNAQTTNKIQAIPLRSSWVMTCAFEQKQRNMVACGGLDNLCSIFHLSQAQVMRATKELAAHDGYLSCCRFVDEANIVTSSGDSNCILWDVESGEVKTTFREHSGDVMSVSINPHNPSMFISGSCDSTAKVWDIRTGKTTHTFQGHESDINSVDFFPSGNALGTGSDDSSCRLFDLRAYGELNNFSNDKILCGITSVSFSKSGRFLFAGYDDYNCYCWDVLSTSGAHIYQLAGHENRVSCLGVNPAGQALCTGSWDTLLKIWA

SEQ ID NO: 13481 - protein, 281 aa, Cucumis melo
TLEDGMKVAVKRGNPRSEQGLAEFRTEIEMLSKLRHRHLVSLIGYCDERSEMILVYEYMANGPLRSHLYGTDLPPLSWKQRLDICIGAARGLHYLHTGAAQSIIHRDVKTTNILLDENFVAKVADFGLSKTGPSLDQTHVSTAVKGSFGYLDPEYFRRQQLTEKSDVYSFGVVLMEVLCTRPALNPVLPREQVNIAEWAMTWQKKGMLDHIMDPNLVGKVNPASLKKFGETAEKCLAEYGVDRPSMGDVLWNLEYALQLEETSSALMEPEDNSTNQSLPSN

SEQ ID NO: 13482 - protein, 357 aa, Blumeria graminis
MAEFVRAQIFGTTFEITSRYSDLQPVGMGAFGLVCSAKDNLTGQNVAVKKIMKPFSTPVLSKRTYRELKLLKHLRHENVISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVIHTIASENTLRFVQSLPKRVRQPLKDKFTNADPLAIGLLEEMLVFDPRRRIKATDALAHEYLAPYHDPTDEPIALEKFDWSFNDADLPVDTWKIMMYSEILDYHNVDSENQAMEDPLECP

SEQ ID NO: 13483 - protein, 358 aa, Zea mays; identical to SEQ ID NO: 6808

SEQ ID NO: 13484 - protein, 390 aa, Zea mays
MAPSCYDAAASMLLCAEEHSSILWYDEEEEELEAVGRRRGRSPGYGDDFGADLFPPQSEECVAGLVERERDHMPGPCYGDRLRGGGGCLCVRREAVDWIWKAYTHHRFRPLTAYLAVNYLDRFLSLSEVPDGKDWMTQLLAVACVSLAAKMEETAVPQCLDLQVGDARYVFEAKTVQRMELLVLTTLNWRMHAVTPFSYVDYFLNKLSNGGSTAPRSCWLLQSAELILRAARGTGCVGFRPSEIAAAVAAAVAGDVDDADGVENACCAHVDKERVLRCQEAIGSMASSAAIDGDATVPPKSARRRSSPVPVPVPVPQSPVGVLDAAACLSYRSEEAATATATSAASHGPPGSSSSSSTSPVTSKRRKLASRCDGSCSDRSKRAPAQWTKE

SEQ ID NO: 13485 - protein, 217 aa, Hordeum vulgare subsp. vulgare
MDVGALSSDYSSGTPSPVGADGGNSEGFSTYMTVSSAPPKRRAGRTKFKETRHPVYKGVRRRNPGRWVCEVREPHSKQRIWLGTFETAEMAARAHDVAALALRGRAACLNFADSPRRLRVPAVGASPDEIRRAAVEAAEAFLPAPDQSNAPAEEVAAAPTMQFAGDPYYGMDDGMDFGMQGYLDMAQGMLIAPPPLVGPSATAGDGDDDGEVSLWSY

SEQ ID NO: 13486 - protein, 315 aa, Schistosoma mansoni
MNEQLVFRGTLSGHRGWVTQIATNATQPDLLVSASRDKSLIVWDLRRESGEYGVPVRSLHGHNHFVSDVVMSSDGLYALSGSWDSTLRLYDLETGKTTRRFCGHEKSVLSVAFSADNRQIVSGSRDKTARLWNTLGHCKYVFTDGGHTDWISCVRFSPNTDHPIVVTCGWDKQVKVWGLSDCSLRTTHYGHTGYLNTVTVSPDGSLCASGGKDGQAMLWDLALNKFLYTLPSGGIINALCFSPNRYWLCAAVGSSIKIWDLENKVLADDLRPELISGSSPAKQSTPSCTCLAWSADGQTLFAGFSDNLIRVWQMA

SEQ ID NO: 13487 - protein, 176 aa, Rhodovulum sulfidophilum
STFLVNSAGLHPGRAASDFAPKSWNRIMDVNVTGTFRVSQHIARGMAERGYGRIINIASISGLRAGVGRTAYGTSKAAIIGLTRQFALELGSRSITANAIAPGIIETPMTLAAYSEDTWKRVLEMIPARRRGQPEDIAEAVAFLASPAASYVNGEVLTVDGGYVASGMTQTGNLET

SEQ ID NO: 13488 - protein, 440 aa, Oryza sativa (japonica cultivar-group)
MGECKVGGGGGGGDCLIKLFGKTIPVPEPGACAAGDVDKDLQHSGSSTTEPKTQENTVQDSTSPPPQPEVVDTEDSSADKNSSENQQQQGDTANQKEKLKKPDKILPCPRCSSMDTKFCYYNNYNINQPRHFCKNCQRYWTAGGAMRNVPVGAGRRKSKSVSAASHFLQRVRAALPGDPPLYAPVKTNGTVLSFGSDLSTLDLTEQMKHLKDKFIPTTGIKNTDEMPVGLCAEGLSKTEESNQTNLKEKVSADRSPNVAQHPCMNGGAMWPFGVAPPPAYYTSSIAIPFYPAAAAAVAAYWGCMVPGAWNAPWPPQSQSQSVSSSSAASPVSTMTNCFRLGKHPRDGDEELDSKGNGKVWVPKTVRIDDVDEVARSSIWSLIGIKGDKVGADHGRGCKLAKVFESKDEAKASTHTAISSLPFMQGNPAALTRSVTFQEGS

SEQ ID NO: 13489 - protein, 493 aa, Oryza sativa (japonica cultivar-group)
MDAAAGGAPPRPAAGIRVRVPLYMTGQTYQGGSCRGVSGSAANPLIGQNKWVSLVATYTPRRVTSCGFVSLMLFHIQVESVSCYCRVDGGLKTVVSARKFVPGAKLCMQPDIKPNKRKSRSSHKERCRTQAPLLPGLPDDLAITCLMRVPRLEHTNLRLVCKRWNRLLSGNYYYSLRKKLGMAEEWVFVFKRDRDRKISWHAFDPVHQVWKSLPPVPAEYSEAVGFGCAVLSGCYLYLFGGKDPVRGSMRRVVFYNARINKWLRAPDMLQKRHCFGSCVINNRLYVAGGECEGIQRTLRSAEFYDPNRNRWSYISEMSTGMVPFIGVVYDGKWFLKGLDSHRQVVSEVYMPTSNVWSVTADEMVTGWRNPSICFNGRLYSAECRDGCKLRVYDRDTRSWTRFMDSRRHLGNSRAFEAAALVSLNGKICIIRNNMSITLVDVSNTPTVIEINNAHMWDVFARKGQHRSFIANLWFTIAGRNFKTHIIHCQVLQV

SEQ ID NO: 13490 - protein, 366 aa, Oryza sativa (japonica cultivar-group)
MASNGMASSPSSFFPPNFLLHMAQQQAAPPHDPQEHHHHHHHGHHGHHHEQQQQQQHHHHLGPPPPPPPHPHNPFLPSSAQCPSLQEFRGMAPMLGKRPMSYGDGGGGGDEVNGGGEDELSDDGSQAGEKKRRLNVEQVRTLEKNFELGNKLEPERKMQLARALGLQPRQVAIWFQNRRARWKTKQLEKDYDALKRQLDAVKAENDALLNHNKKLQAEIVALKGREAASELINLNKETEASCSNRSENSSEINLDISRTPPPDAAALDTAPTAHHHHHGGGGGGGGGGGMIPFYTSIARPASGGGVDIDQLLHSSSGGAGGPKMEHHGGGGNVQAASVDTASFGNLLCGVDEPPPFWPWPDHQHFH

SEQ ID NO: 13491 - protein, 251 aa, Polygonum hydropiper
AYNQFSSDIPVISLAGIDDVGGKREEICGKIVAACEDWGVFQVVDHGVDTQLVSEMTRLAREFFALPAEEKLRFDMTGGKKGGFIVSSHLQGEAVQDWREIVTYFSYPIKNRDYSRWPDTPEGWLKATEHYSEQLMGLACKLLGVLSEAMGLEAEALTKACVDMDQKVVVNYYPKCPQPDLTLGLKRHTDPGTITLLLQDQVGGLQATRDDGKTWITVQPVEGAFVVNLGDHGHFLSNGRFKNADHQAVVN

SEQ ID NO: 13492 - protein, 101 aa, Amblystegium humile
VEKAKFLYSAGFFLTVSPESMLTVAKHAAETGKYYMINLAAPFICQFFKDPLLKLFPYVDFIFGNESEARTFAQVQGWETEDTKVIAVKMAALPKASGTHK

SEQ ID NO: 13493 - protein, 101 aa, Amblystegium varium
VEKAKFLYSAGFFLTVSPESMLTVAKHAAETGKYYMINLAAPFICQFFKDPLLKLFPYVDFIFGNESEARVFAQVQGWETEDTKVIAVKMAALPKASGTHK

SEQ ID NO: 13494 - protein, 100 aa, Amblystegium varium
VEKAKFLYSAGFFLTVSPESMLTVAKHAAETGKYYMINLAAPFICQFFKDPLLKLFPYVDFIFGNESEARVFAQVQGWETEDTKVIAVKMAALPKAIGTH

SEQ ID NO: 13495 - protein, 100 aa, Amblystegium fluviatile
VEKAKFLYSAGFFLTVSPESMLTVAKHAAETGKYYMINLAAPFICQFFKDPLLKLFPYVDFIFGNESEARTFAQVQGWETEDTKVIAVKMAALPKASGTH

SEQ ID NO: 13496 - protein, 101 aa, Amblystegium tenax
VEKAKFLYSAGFFLTVSPESMLTVAKHAAETGKYYMINLAAPFICQFFKDPLLKLFPYVDFIFGNESEARAFAQVQGWETEDTKVIAVKMAALPKAIRHAQ

SEQ ID NO: 13497 - protein, 101 aa, Amblystegium tenax
VEKAKFLYSAGFFLTVSPESMLTVAKHAAETGKYYMINLAAPFICQFFKDPLLKLFPYVDFIFGNESEARAFAQVQGWETEDTKVIAVKMAALPKAIGTAQ

SEQ ID NO: 13498 - protein, 106 aa, Sorghum bicolor
GLKRGRWTAEEDQILANYIAEHGEGSWRSLPKNAGLLRCGKSCRLRWINYLRADVKRGNISKEEEDIIIKLHATLGNRWSLIASHFPGRTDNEIKNYWNSHLSRQI

SEQ ID NO: 13499 - protein, 203 aa, Sorghum bicolor
MGRTPCCDRAAVKRGPWSPEEDEALRSYVQRHGSGGNWIAMPKKAGLKRCGKSCRLRWLNYLRPDIRHGGFTAEEDAVILSLYTQLGSKWSLIASQMEGRTDNDVKNHWNTKLKKRLLAAAGTFSPAPHARVPAPAPAFRTGHVSPLSLVPSVGIPTVKNRAYTYDDFLGAGARDPFAAADGSTSGAFRGCRPPMVHGGQRAQ

SEQ ID NO: 13500 - protein, 516 aa, Encephalitozoon cuniculi
MERYKLRQVIGEGASSTVYSGVSARGEEVAVKVVPRKGRSTGMVYREIEMLSTIKHENIVGIVGRFESKKHVYMVEELCDFNLVSFLNEYEVDEDVALKILRMILCGLRHIHSLGIIHRDLKLGNILLKGNTVKICDFGLSCYVEENNSEFCGTMDYLAPEVVDGKKYSFGVDMWSAGVVFYVLLTKKKFCESLDSLECSEELRDLLEKLLERDESKRADASEALMHRSFSRFIPRCEDFRGLPGFERGTKYGVLRKAGDSVELGSIRIDARRGKRHGGGRKHGDLGCLCGEEFTYSVYVDSEEIEPAFITNGQLKTLGLLTAHVKAMREKTPKIIIDDDGNKFYYMFSGGFVYVGKELTLRARGGKYEMSRRSGEKTYLEAVPDFLYEAIGGLEARCKAIDKEVCWFSRESPVLIDCSSHQQFSMSCISQVSEMSIRNRVEYDYIESTGWCIRDGLNFLFLMNDGEMFEVLCPDLAVRYRGRLLFIDDRLPMKLKRSLKGISPFLRSLCDGCYMS

SEQ ID NO: 13501 - protein, 1935 aa, Encephalitozoon cuniculi
MSCIPRRMAFPSSDISCFTKSLHTTSADVTRTTFLISSPDCTRPKSKDETISEVNLLMSSEARSLLIDSTSSGPIFFNLFIIESFFLSGEFLFFATRKMPKVLSSSSQFMQGNVSSKGFYCGQEGPKPLDMNRDYLKNLYLQRLESERYSDVFRESMSSLVSTEIINAVISLAVQDDDETMLVDLLELFLQNLESNVVFHEKLTKSSFHLLLFKRPLGIQSYTKLKSIYDRVGSRRVVPGFEHTEFLSKNFYNYCLYKHAYKDYQFDLELDAGSLGPVETNLFKDLLKAVCIENRENEHLANYIKTLPMDVSVFLAIVMPDFRIDASRLGPEDVFLVCPSQVRGYDPKQFTKAFLCSLNSEGGLCRVCGRRVLGCGFEEIDREEYLDSVSGNIEEMCFGVSHWEKIRTPRMLTTILRSLFKRPGCLECYKCLRYFPIEEQGEMEDIVLRFLRYAASILSIGNIQVSLRMFPFIRHTPRVVFSYFVILFEGFLKYSGNLFLKNVIRNVSTRNKAKFMGVRAMIFEYYLKGSIESASSTEENTKNEGGSGAVENPGRKRADDLGDLFAPLSEFFDEERKAFVRNNMFYIYPIMYSLSFPYYTPDLAFTQANNHFLIISLFLRGEESRIDEIGYGKDELYRMGVDVMIPLLCNGYFKYDVLSRFFGNVQEYIRAHLPKFLFALKKVYVERPFEFRVCVFKILKCIIEAISGNVRMLFNYLFPFVEFFMRSHEESCGTDCKMIFIEYYSSFFKNDCLVRNMSRIFPYLDAEKIARWSNVKSEDDYLDIVIGLLDTRGHFSQEMAAKKAVELLARVFGDPGKGKGFDEESFVENVLRRFFKSREFRMKIGNVYGKLKELGNDAAFLIGCISQEFLDANPLPSVCSVLIEECTPEAIARVMVEKYLFEMDPGKQDLHFFIIQETLRFIKGPLSDRMEEVVEQFRSTQYFYEYVPVHPVEGVYEKTYTFKRFLGRLYRYSLNEIAKSEMQEYFSLLKYGNLLDTLFLEFHCLCLCRLLLEAGDHKVLGMVREIANNLQEGVDKRIARFVLKLHGFTSGKHIEDQQILRISFFLKDHHNAIQTLEKMIRKERKSELFDLLQYCYYSIKDYDKVLGINSVFARPSLINLFFRFCVDKNFAAARRCLEPKPGHDGVKEESGEDHKGQAPRELDVKILMEEIIDECQDDEVTKFMNDCKKIEGDFSEWKRLESRNEVFKHFIKDCELVSKSKNLLKTLDLIAGRRELAGDNRMLLECHESLVASIRSMMDARDDMSCDEMFESLLTAEKQDTIGNSSQGLHSREYFDDFASVDMVRAERRSERIGYMDRSKSGSTSGYSSLEEFERDLKLAIIRNYRGDDDVGRCIQEIGGMLLKREWCVLYELAELNVLQGKIGDAKTSLKKVLEIFPKTSMLYKKALIRYSELLDTKTAYTSALSILKDSGKLFLLGAKKFESTEPVKAMEMYINSVIHDNQCSDEAVPRIFHLFSEMMPPGDINAGAVLLKKFLESSISLLPPYYNQILSRLSHPNQDVANVVSRIVFELMENYPSKTFWRSLIMMNSQVPSTRKRMEGIVSGLTLDNKVALSNVKRISEELTCISRSKKNELTMEEDFPAFAKMFPAGVTVPNTKVLISGVRNEVKVFNSLQRPKRICFVGSDGKNYYWLCKNQDDLRKDSRFMDLNLIINSILKKQSSRKYIRTYAVIPFSHESGIIEWIGGLSSLKAICDTYYARDGISISETACRFVHNKKIGMREWHRVASKFHPKFHLWFHDSFPHPFSWLVARNNYTQTYAIMNIVGWFMGLGDRHAENILFDSNTGDTVHVDLNCIFGKGKELQVPERVPYRLTQNIVDAFGVLGLEGSYNTSLCTTLDLFLKNKNILVSNLLSFVYDPLFEWRRKSATTPKKIIEDLWHKMDDLDACSKCDVLNEEATNDENLCMMYIGWLPFI

SEQ ID NO: 13502 - protein, 257 aa, Encephalitozoon cuniculi
MDQTVDLEEVAKLVKKRDFKGLDRVLSTAKGISALDLKKLAKLSDSARIQALIENKYSEVVKHQVEGGTKDEAGMTGKAPSPLKSDADSSSALEEVATGDSQKDRSIKMFFDAIKTNISDCNNASAALLARQITIEIFGRNPSDIAKLIRSKCLNLKDKNNPALCRRVYNGDISPSRYVDMSSEEMKSESLKNEEVKMIEVSLYECQIPTQKAETDIFKCSKCGERKCSYRQLQTRSGDEPMTTFVTCECGNKWRFC

SEQ ID NO: 13503 - protein, 336 aa, Encephalitozoon cuniculi
MVDSKYDIDYRRLRDETMRMIDDIRSALSLDNGPEPDTLSHAEADLVGLWKSLLSEDCRPAEFDVQVGNQIYPNSTQTVTYLVVYYLLENNCADVVERLISETKDGKDEIIKIRDGYVKFKKVISQISEDSTFLLEEFLEGYPSKELELYLVSHEFLLLIHKGRYDEALRLCFKKLRSFVPTYIQDVKPLLRFLVNPTNIQEALKKSRSKLIEKFKSKYIEMNGMPNRCYLRELFETGTSAFLQLSTSGSLLFDKDDSTLPMEIKIEKGRNYHSLFICPVLKTLCVDENIPVMLECGHVISLEAASVLSQEGVLNSFKCPYCPEMSKYENILRLRI

SEQ ID NO: 13504 - protein, 272 aa, Encephalitozoon cuniculi
MEQGNGHATASIDHPHDVGDGEHCSLSPLVYGFSYSPSEDRIIEYLDSMSDNQAPESHIAASHRGYALEERRAIVLDPYPIGRISRGKVDVSYGFFNEYLYESHEHGPSKLLKAHRVMCGFEIYSLGQGDEEKVGCLRSNLFGTKYILYQGEKAVLEIKYATSIFKRRGPRSFSVLFTGISGSSLKEPVVMRNKEPYYNAETNSYSLNFNGRVTTPSVKNFQLIHPLEPTYVTLTFGKISRFKYILDYTYPWSGVQAFAIALAALDYKVGCD

SEQ ID NO: 13505 - protein, 283 aa, Encephalitozoon cuniculi
MGTRNYHKNFQVKRRRRREGKTDYKHRTNMIRQDSNSCGSVKHRLVVRITGSRVICQIVAAYMDGDRVMVYADSRELERYGINFGATNYSAAYATGFLIGRRALTAMSLDEVYRPKEIDGTYSVTKDIDGEKKAPRVFLDIGLARSTRGARVFGALKGASDAGLNVPHSAAKFYGHKPDGSFDAKELHDRIFGYNISEYMKQLRDGDPEKYKTQFSSYIKKGIDPEEIPRIYKSAFDKIAEDPTRKKKETKDYSGFKKYKQARLTYEERAKRVQAKLSAAEGE

SEQ ID NO: 13506 - protein, 307 aa, Encephalitozoon cuniculi
MNRIRVLGLVLMYYALSLSLGYLTSFLLSKRTYNFSFPLFKASMQNLIHFFGASTVLRLQKEKAPKPNYFGPSLPCALAGATDIGLSSISLRFTTLAFYTMVKSSSPVFILLFGFALGIEKPSITFFLTIFTIGVGVFLTSIKNTSFDIIGFGTISVASLMAGFRWAFVQYLVRNQDVQKEGVFVTMRDLCLPISFLLLLISLHVEGLMEIVTSRFFNTFDAALRNFGYISLCGALSFMLLCAEFTLVSETGVVFLSIAGIVKELIIISYAIITKDIALSNLNYVGLTISIAGILIYNFSRKPLSPH

SEQ ID NO: 13507 - protein, 898 aa, Encephalitozoon cuniculi
MDDMDKDNIVNGAEKPPLSRADNAVLTNAVFQGFITFCILIAYVILRKRAKWLYSPNVRGRPSHPCYNYTGFLSWIIPVVTVNDTILLSIIGLDAFMMLQTLKMLYRILFILSLFVIPSLGYLFWTNQRENVEHSDQWLVRLSLGSLDPDSGSYRLVIPVVYLISGFIMYSIFIYYKRYIVLRQAYLRNPAIMTSIITLKKLSNHLGSSERSTEYVNLPNRTLLVSRLPSYVNNDVDLYEFINALGVGEIDDSVLVYDTNTLQSLYGERDSYIYNIEKEINEKFVRINDWSEKNREACERSISGFKESISRTVEEAKIEGTFDPSQKRQLIVLFLNGAKQFENKLKEGEDVSRVSLYLEKLNDVNARISREKEIIKTEEAGDKDVRIVELVSRNNTLFLRGDISQDVSFFSFHHILNYRKYKMYFTLDLPSKTKRGFVTFKDQRSANIVKQSQIGSRIFSVTTEDAPAPNDVIWENITNSEVENYMYSIFGTVFFILFIVLFSSMVTSIVTLLVNFEGFKESKLISSFLSRYETIADSLRGALSPLIYNSMLLLVPTVITALMNMEGIYSYSTLQQKLMDKLCNFLFFNGFASVFFVTSFYRLFSDVLSRNKEIYDIVEAFSKESLESSVFFANIIIQKSLVGTALTLLKPAPLLINYIIFPFTGRKTRREKLDAEFSPPFDFGTIFPSCLTVFSMSIAYAVMCPPILLLGAFFYFCNYLAFKSEFLYSSRNEYESGGGYWDSACQNIVFSLIFFQVVTFAKMSSDKRFYLSMSLFPIILITFIFRNSLRKMFYKSCHFYPLNIKEEEYLDTFTEKVLVDRVNLLESWSEIGKGPDVDILRLAELGIKDTKEIEKESYYNDPNTATSNSSLILPENFFKTIWFLVNNDREDLFGLRAE

SEQ ID NO: 13508 - protein, 290 aa, Encephalitozoon cuniculi
MCAVVEELLWIGWQPKREKFFHPGMTRKDAKERKELTYERARKLFETYSRFALVKIENVVSTQLKDIKRQWGGNAELLMGKNSAIRRAIADLGKPELSGVYDLVKGDVCFVFFKGNARDIKKAIDENVREACAKVGNVAQRDVWVESCITGMTPDKTSYFQALGIATKITKGKVEIISPYKVLSEGDKVGPSQANLLGMLNIKPFCYKMTMHQIYEDGVIYDSSLIDIGEEDIFTSLRNAISTVAAASLGAGVITQASMPYNVRNAFKDILHVSLGADFMIKEQSMVMAN

SEQ ID NO: 13509 - protein, 118 aa, Encephalitozoon cuniculi
MDEFSGGLRPTDRSLPIANISKIMKKPIPKEAKVAKDAKEIMQKSAGEFIAIITCRAKEICESEARKTVTGEDLIRAMDELDMPYYAELARKYYIQYRELAKNERVRKYSRGFDYRKP

SEQ ID NO: 13510 - protein, 536 aa, Encephalitozoon cuniculi
MSENREIDATDRRDKTFDKEKLRPHVYSSVAGGMRSTSGDTKAVLLFSLLFALLSYIDAFLYVLGDMVMMNTQMPSSILFIKSVLVLPMTFFFIVIVQKGLRYLSQPRMLEVILIISSVFFLLFGFVIWPYCKRLQPDFFWSRDIFSDGKMKTRHLDFFFPIFLVFSEWASTMLYLVAELWGSLIISFMFFSRAIHQCTEAQVKKFLPTISLISAVVFLSSGLLTKSLNSRRDALPYHEKERLFSQVFIVTSALTVMSAITSFFTDRALAKDDPRHKGKKEHKVRKIGFAGSLKMMQKSRFLRAMTESVVAASVCSNIFEAIYRGGIVLGAVQSSTSKSSYMNRLNAMAQIITSIFLLVMFFKPATHLIERRGWFPVAITAPIVAIITLVLFFPMVFFNNITEGDLIASGEEYVGSFVLENYTGMFLTTIIRISKYCFFDVAKEAASIRVSPVHRHSFRGIHDGLGINIGKTIGSVYCTLVTVVFDVRDVRNVVSVSTVFVGVFCVIWIRSILHINKKYKESIERNDFINVELAEG

SEQ ID NO: 13511 - protein, 543 aa, Encephalitozoon cuniculi
MSTFQLSASSKDSYLFRTEEELEEEVYGKTGFFKHIRVARNEWPRVLYLSLLFGVITMVHTIMGNLREMVLMGRQDPMSMFFIKSIFLPPCSLLFIWAIQLGLSLFTPSKMFDITLILFSGCYILFGLVVWPLKGYIQKDFYWSRDIFGDGKMESLRIHFLYPVFLVFNEWTSSFLFLCSEMWGALVVSYFFNIFANEVSTRRQSQRYISVYNISNAISIFLSAVLTLVFNKWRDGVAFETKELGFRILILVLGSTVIGILALKKYMEREILPAPVFLIREVEKTSTERRKLKLDEARQTLSRSKLLIAISLNVLLYGVTSTLVEATFKSGIAAGARYTNNSKETFANFYNGLEQIIIAISLLVVINTPYSALVKKGGWKYLASLPIVIAMFSLFSVFLIAFYNVGADSGGNVLFGSLFKNRMPTFILENTLGLVTNASMKIGKYLGADVSKEAISMQIDPLYRAKYKAVYDGLCGKLGKSLGSIICTVMTGLWDITDIRRVSSVSGILIVIIIAMWYFILKYLSRQFQAAVEANTYIELDEF

SEQ ID NO: 13512 - protein, 553 aa, Encephalitozoon cuniculi
MSEIGSSVPVNENRPLLTEDEVEAQANSSTVWPLSRIRVARCEWKLWGSLAFIFGASAYIYSFSRVMKDSFVLSRQLPIAISFLKTCFVLPISVIVTGIVQKLLVTRTISKVFDYTLIAFSFLYLLIGMVLLPFAEKIQPGLYFSRDIFADDKMAYKGFEFLFAIFLIFNEWTTSFVYVCAELFGSLVVQFMFLAFANEALTIRQSTRMMPLFYVISNILLLLSSESTSFYSKKVREWDYKKTCLITNSFFAVFGAMIAVTYLVKKYAENTILKKQLFIRTEGVAKKKGRKSSAGFSESMKLMAQSKFLVAMVMNALFYYAGTNLIESSWKNGISVAADANNMEKRAYSASIVSGEQRVVGALVAIILLTPISTLVQTHGWITMAIVPPLVTLVSSLVIFGSAFFNYSNYPEGKTSVILSSLVKGYKPNFYLECNIGIYCVSGMKIAKYAFYDISKEAISLQIDPLYRPRLKAVYDGLCGKLGKSIGSLYAMFWSVMGYNDVRAAAPITLGMWLIISPIWIYSVIYLNRKYNQSIQTSSPIDLDLFSGKKDLE

SEQ ID NO: 13513 - protein, 205 aa, Encephalitozoon cuniculi
MENLLEDDSENLLRISSDEYWVGDFMRRKENHSIVRVPDEFLEDRFNTIGLDRYIDNLEEVYNSVLDKGPRGNFKEESSLYYLIHQRYIFTKSGLEAVLDKVMSREYGACPRVGCRSVGVIPIGLSDRPQVSSTKIYCHSCVNVYEASGTLQLLDGCAWGRSFPHFLILTHSYHFPSRTCEEYIPRIYGLRICSHDDNDSLSEDN

SEQ ID NO: 13514 - protein, 412 aa, Encephalitozoon cuniculi
MKVKDALLDIKPRMILTSRGRPTVEVDLITSRGVHRSSCPSGASKGSKEAVELLDGGEFYNGRGVETVINNINQLVVKKMCELECNVGDQQAIDNYLLGLDGTKNKSRIGGNGITALSTAFCKMGAAYSNMRVDEFISGITTFKRGIPVPHFNVLNGGIHSGNEMSVQEIMVAYQHDSLESNIESGCVLYESLKRVISEKYGALYTSVGDEGGFAPPIKKLEEGLDLILEASRRCNRTDMKIAIDFAANGFMRDGKYELDGETYTTKSLGERYIEILKEYPQVYSLEDPFSERDYDGWIWLNAEVGKKINIVGDDLTVTDPQLVRDAGARRMCNTLLVKPNQVGTVSETVEAIRIARKCGMKIMVSHRSGETDDHFISDLSVGVGAEYIKSGAPCRGERVSKYNQLLRLYEY

SEQ ID NO: 13515 - protein, 254 aa, Encephalitozoon cuniculi
MRGKQSHMSCEHYSNNCLVRFECCSSLYPCRLCHDKAEAHRANRYEVSQIVCGTCNLLQPKTQTCLQCLAAVSKYFCSKCNLWDSSDDQIFHCDGCNVCRRGDPKSSFHCDICQTCLVTRGPRDHTHVENTASGNCPICAEEMSESMEVLVLLRCGHSLHERCFNEFIKETYTCPMCSKPIGDTSIINRKVECLLGMEPPSPEQSPKNIAKCTNCNNLSKCGAIQNKCPFCGLRGVVDAAQEKNVKSQCLKPEE

SEQ ID NO: 13516 - protein, 103 aa, Encephalitozoon cuniculi
MSGSRFERELEFVQLLCNPDYLRWLTREGHFESEEFRSYLRYLEYWRSPEYSRFLTYPQCLAVLEHLNSENINDMLSDENFFLALGEQQYFIWLNKHKEGWNK

SEQ ID NO: 13517 - protein, 477 aa, Encephalitozoon cuniculi
MTIMNGTTLFLIICNEFCERFCFYGLKSLLFSFTRSEYGFTIKESTVNLHFFISMSYLFTLFGGLLSDMFLGRYSTIVLLSSLYLTGTSLLTYCSIVSGSPGLMVGSLLMIAVGTGGIKPCVAAFGGDQFGPDDAQDLRRFFDFFYFAINIGSMVSMVLTPTMSSVGCLGKQSCYPLAFGTSSTLLGASILLFIIGKRFYVIKPVRKEQFSRTFHSLVQNLKELFRRQSRDSERKTQGTLKTVSEAACISHEEDDKEKTLKILRILGPAAFFWMLSDQQSSSWVEQGTKMETHQSILGYGMDILPSQMQAFNAVFILLFIPLFSKMIYPLMGLAGVFSSPEEKMGFGIALASLSFFCSGYLEYRIGLPAPAGQRLSIMWQLPQYVLMTAGEIMLNVTGMEYMYTEAPEPMKSLVSSMWLLTVTAGNLLVMVLTFLDPVALFSSRAHDMWSFVAYGTAGLLASRCMFQASKAAKRNRK

SEQ ID NO: 13518 - protein, 187 aa, Encephalitozoon cuniculi
MSSRFMSKGKGYPMKTRREPEKPDGSSEEAVEAIAGIEGNGRKEDSTRPCREYTCSICYSQPEGPVLTPCGHLFCWGCIYIWSQSTGGCKFCPTCRCRMGIEEVISVLAVDSKKESRGLPPRPANNRKLVKVITPGIKINGTRFGGCFLQEEETNVFSYRTAIGLFTLMCILISVTLKSYLFESDST

SEQ ID NO: 13519 - protein, 292 aa, Encephalitozoon cuniculi
MGESCPGVSSKDAGKAEECKGCPNVGYCSQPVQQDPDIKAIQENLSGVKAVIAVMSGKGGVGKSTVTRNIAELMSSRGIATCILDLDLSGPSIPRLTGTDGQLMCETNGRLQPVEVHGLLKAVSAGYLQDPCEEGVVFSSTLKTSAMKKLLKWCSYEGTDVLLLDTPPNVTDEHLGMVNFIRPRFGIVVTTPQKFSLQDVARQVDFCRKARIEVLGIIENMKRFTCQKCGHSKSIFRSVGVESYCMSNGIAYLGSIDLKQDIAKRSDSGDTIEEEVLGKIVDAIMVVCSSKA

SEQ ID NO: 13520 - protein, 208 aa, Encephalitozoon cuniculi
MTSLDQLSLNQKNTGTKLVKGPWRHEEDERLLKLVKEFSPKNWSFIAKKLGSRVGKQCRERWHNHLNPQITKKPFTMEEEGVIIELHSKFGNRWSEIAKYLPGRTDNAIKNYWNSSIQRRSEKMRRRSMFCSIDEFHKNHDLGQGKYENNHNSSVVSPHVSMKQKTRRSSSVQNLPEYIPRPEAFDEEDFDEMDEIASQALLRICMSF

SEQ ID NO: 13521 - protein, 556 aa, Encephalitozoon cuniculi
MSENIRESISAKTLSKDQMETSYVSLKTWIEDSLDLFKNDLLPLLYPLFIHIYFDLIQQNKTDEAKEFFEKYRGDHYNKSEEIKQFESIYTVQHIHENNFAYTFKNSKYHLSMGRYAFDLLINFLEERNLTYILKILNQHLDIKVYVGPKSEERPQGIETSVVDAEIDLTTFLVSRECEDAILGDEQYRYDHLETYVLQLRKQREMKPKDSVYKPNASQIHAEIEKLKDLCKRVAVNKNNLPSICCYTIHNTYEGLTAAEISNDLKLMACGFKDSYVEVYSLTNESLKKLKSSSELAKSDIKTLNEEKFEEVGSSYKLVGHSGPVYGLKFFSSNKFLVSSSQDCTVCLWSLDLLCLLAVYKAHAFPVWCVDVAPNDYFFASGAGDRQAIVWSVMTSKPERLIISSLSDVTAVKFHPNSSYLFTGSSDHRVRMHDISTASVVRIFCGHTDTVTCMDVSHCGKFLASGSKDRTVLLWDIQSSKLLGKYVGHENTVFSVSFCFYGSVLASCGADNSVRLWDRTDHKGGCLGTYYTKNTPLLCVKFGYRNIISCTGPFIS

SEQ ID NO: 13522 - protein, 301 aa, Encephalitozoon cuniculi
MICKTQKLNNGKEIPTVGLGTWGMEDEAVLEGAIRNALSLGYRHIDTAFIYGNEKMIGNILKKLFDEGVVQRKDLFITSKLWNTFHGCPEDGLRRSLNDLQMDYVDLYLIHWPVTFDPAPDGTVESCGKKYNVGKFDAVGVWKKMEALVDLGLAKSIGISNFGKANTEKILGTCRICPAAIQIELHPYLNQKELVEFMKSKGIQVISYSSLGSAPGSSAKVRDDKTIKAIAKKYGCAPSQIILSYITAQGICVIPKSRSKEHLRENIDLKELSREDISAIDALNTGHRYVDPPGFGPEKFK

SEQ ID NO: 13523 - protein, 92 aa, Encephalitozoon cuniculi
MENKEIIKLKKWNLVALWSLDMKIETCAICRNHIMDTCVECQNGMTNNGECKVSWGVCNHAFHTHCITRWLSSKNVCPLDTKKWVYYDPEEK

SEQ ID NO: 13524 - protein, 505 aa, Schizosaccharomyces pombe
MVDGSIHVPVQSHEGQHDNSSSLNEEIQTSQDPLGIVESYQESSTSDFDKSHYTHNSSIAAADSEYGSAFIQGQSSNGSEIKSERPSIDKKLDVNIDSHPIEPPPFEHDIGLPASQVPAAEEEVESTPKAKPLYFLLDKRFWIVFFLGQVLSLCITATNTFNGYMSGISNIPAFQTFLVYALLTLVYTPYTVFRMGFKKYFEMIFRHGWKYIIFAFFDVEGNYFVVLAYQYTNMLSASLLDSWATVAVVILSFIFLKVRYHWSQILGVVACIGGLVLLVVSDVISRGDYSAVNPGLGDGYMIIGATCYGVSNTLEEYFASKLPLYVVIGQLSLYGSIISIIQTFIFDRHHLYTLHWTSEMGGYLAGFILVMFLLYSLAPILFRMSSATFYNISLLTSDFWSLVIGIHVFGYHVYWLYPIAFVLIILGLFVYHVFVDATRESIKPWLKKGQGVDGVGTVRRPPSLVSSNDELNKKNDIVVAHHDNEVKERIYDAYLSVKNVFVRKS

SEQ ID NO: 13525 - protein, 499 aa, Schizosaccharomyces pombe
MLHRRIHFKSQSTLDFDSVAVSISASTMKNELDKLVLNSRVSDKKTFGIQMDNFFALYRRYLLHTVKGYECDWDSIRPLGPEDMIDYGDLPLCKNAGKYLNRLAVVKLNGGMGNALGVNYPKAMIEVRDNQSFLDLSIRQIEYLNRRYDVSVPFILMNSYDTNDETCKVLRKYAGCKIDISTFEQSRYPRVFVDSQLPVPKAAPSPIEEWYPPGHGDIFDALVHSGTIERLLAQGKDYLFVSNIDNLGASVDLNILSHVIDNQIEYSMEITDKTKADIKVGILVNQDGLLRLLETNQVPEQHREEFMSDKVFKYINTNNVWLYLPAVKRVVENRELNLDIMPNIETVYYNNEPARIIEFTTAIGSAISQFKKTEGIRVSRPRFISVKNSSDLFLVRCDLYNVDHGSLKIEESRLGFPPPVVRMSNEFKDIAELFCRIPYMPSMKDLVSLSISGNVYFGRNVILKGNIVIVASENTILCIPSNAVLENCVVTGNCKIMEC

SEQ ID NO: 13526 - protein, 920 aa, Schizosaccharomyces pombe
MDFNTSTRSKSQPVQRNNYKVLYDPELGIKENLGRKIIYRFNGVSKPPLVVRDPRLKNPIYARGIPKSGRPFLKSLQTINYDYNENSLGPEPPTQVFVSNISPLVTSEQLRYHFKSFGEVFDLDLKLNPYTGTSLGLCCISFDKRSSISVAAHSAKIAVQQANGLRFSGKPLSVVLDRDGSLCEEAFKKALNAVEKQFQEETLQKQRFEREDESSRQKLSAAMNEDIPPWRQPSKNSQTLSNGDLQHSKVQNVDQKSGFLTSSETDVPKNINDYIYLLIDDRFVPPDRVYYTDIKHHFRKFLYEKIYMNKDGFYITFNNYREASNCYRALDRTYVQNCRIKLKFHDIPSRTKEDGKKSAVRRVVLPPEEAYAEATSVVLRDLEAALLRDVKSKIIGPAIFKYLHSMPKPSVKEELQENLLVSSTSVPDVPLKIESTVGKLPSLPKFKKRVDSSKMNLSAGSKTKSKLQRRRRRRHEARPLHYQLNQMYNSSASEAESDQELLLSSGDERVERGKIGSIKSVKSDEATPVFSDTSDENDKFHRFRTKSKISKKKYEKMEVDYTSSSETESDASILSPSAAIPKSGSAIKDELISPKKEIDEVLALAPKWRINEFDETGSVYYGALPYNYPEDDVLLDLDGLQYLVKNDEDYSYLQEALKDEPLMDINDPNFWAYERKSCKFKNGDVKYGDTAILPEPKGYFRSNTSGSAKSEGYYIIPTTEKSLYLPLRNRSTIDTISHSTSRITSRMNRVNNRRLAAGVEKSQLPAEADLLRFNALKARKKQLHFGPSRIHTLGLFAMENIDKNDMVIEYIGEIIRQRVADNREKNYVREGIGDSYLFRIDEDVIVDATKKGNIARFINHSCAPNCIARIIRVEGKRKIVIYADRDIMHGEELTYDYKFPEEADKIPCLCGAPTCRGYLN

SEQ ID NO: 13527 - protein, 139 aa, Schizosaccharomyces pombe
METKWLLSKVPDDKSRFEIELEFVQMLSNPWYLNFLAQHKYFEDEAFLQYLEYMEYWREPEYVKFIIYPTCLHMLTLLKNPQFRNDISRADLSKQVNDEIYYEWLGKGLQQYGSADDATLSQPQQEEDEKKVDVKKENE

SEQ ID NO: 13528 - protein, 288 aa, Schizosaccharomyces pombe
MNYQRLEKLGEGTYAHVYKGQNRVTGEIVALKVIRIDADEGTPSTAIREISLMKELRHPNIMSLSDVLQTENKLMLVFEYMEKDLKKYMDTYGNQGALPPSQVKNFTQQLLKGISFCHENRVLHRDLKPQNLLINSRGELKLADFGLARSIGIPVNTFSNEVVTLWYRAPDVLLGSRVYSTSIDIWSVGCIMAEMATGRPLFAGSNNEDQLLKIFRLLGTPTEQSWPGISLLPEYKPTFPIYKAQDLAYLFPTFDPLGLDLLRRMLRLQPELRTTGQDALQHAWFLTA

SEQ ID NO: 13529 - protein, 236 aa, Schizosaccharomyces pombe
MIPEACLFDMDGLLVDTESIYTKSTNIILKRYNKGPFSMEVKAKMMGRTSKEASRIFLDWSGIDLTCEEYIALQRETQAELWRHTKPLPGVMNLLSKLKSLNIPIALATSSDTHNFEKKSAHLSHLFDHFDGNIITGDDPRLPVGRGKPHPDIWFIALKMINDKRKAQGQAEILPENCLVFEDSITGVQSGRAAGMKVVWVPDVNILPFFSLSPEQAADKHITKVLSLENFDVTKV

SEQ ID NO: 13530 - protein, 539 aa, Schizosaccharomyces pombe
MEGENDPLLGSYKPKRRRSSLVYGLSRPQFLDTAASEVSPIPQERPTTSLRKPTPRVQRPATDVSYGALEETEENESIASGLSVQEDFNSKAWWKELTLLIKFATPVVLTSLLQYGEVVTTVFSLGHLGKTELAAASLSNMTATITAFAIYQGIVSALDTVGTQSFGSGNYEMVGLHLQRILAILLLIQFPIFLIWWKIEGILLFLRQDPLTCMFAAKYMRVMMLASPAYALFEALKRFLQVQGIFHPVTYILAIVVPINIFLNYLFVWSPWVGFGFLGAPVAVALTLWSACAVLIIYIMKVNGRQAWGGFSREALKNWGPLCRLAVPGVIMICSEYWAFELVTFASGVLGTTELASMSVLSTTSTLSYNLAFGVAAAAATRVGNLIGAGNTKLAKLATHVSINLGAAIGVIIAVILFLTRNTWTYIFTSDKDVVALVATIIPLVALINIADNTQCVAGGLLRGQGRQRIGGVVNFIAYYLLGLPVAIILCFKLDWGLYGLWIGIGAAILIIAGVETWCSLHVNWDHLVELANRQFDEA

SEQ ID NO: 13531 - protein, 500 aa, Schizosaccharomyces pombe
MTIDLNVIQSDIISARRAPENSLFIDGKFVSPIEPAAKPIPLINPATEEIIGTCANASAKDVDSAVENAYNTFRSGIWAKWPGKQRGLVLRKIAKMMREKRELLAGIDTINCGKPTPYALFDIDSCADMFEYYAEVAETDNPTVKVPLPNNPGFCAFEKRFPRGVIGVITPWNFPLKMALWKLVPAIASGNCVVLKPSELAPWSCLEFALICKEAGLPDGVLNVIIGSGKESGAALSCHPKIAYLAFTGSLATGKKIMHAAAENIVPLTLELGGKSPLIICEDADLSLAIPSAAFAIFFNQGEACTAASRLIVHESVADEVLGGLVSEANKLIIGNGLDPQVTLGPVVSKTQFEKIVSYIQSAINEGCKCVVGGLPRSEQKGYFIPPTVFTNVQTHNKIWREEIFGPVLAVKTFHTNEEALELANDSEYGLGSGVFSTNPKTLEFFSNNIEAGMCSLNNYHVVTHELPWIGWKHSGLGVGLSKHGYNEYMRLKQITQYVG

SEQ ID NO: 13532 - protein, 310 aa, Schizosaccharomyces pombe
MDVSTQTRHATYFQDENQLQKDHIYVKKKSHIKLNTGVRAPFKAVDNINQQDEPTLIEGNNESSISSSTGDTFEEDFAYQDKVEIEERSIRSTPKSIGDDDLENREGSFDAPEGILTHGKHRLPTIPEWTKEDLAALSEAAARLQANPSPEDIETDPSMVPDYDPEIFHYMQSLERKLAPPPNYMSVQQEIDWVTRHMLVDWIVQVQIHFRLLPETLFLAVNLIDRFLSIKVVSLQKVQLVGLSALLIACKYEEIHPPSIYNFAHVVQGIFTVDEIIRAERYMLMLLDFDISWPGPMSFLRRISRADSYD

SEQ ID NO: 13533 - protein, 506 aa, Schizosaccharomyces pombe
MDLAPRPLGRQHSKSQSAFAFDNTATSIAASTMKNELNHLASTVKDPLAKKAFQKEMDNFFSLFSRYLQEDARGSEINWDLVESPKPEQVVEYDTITEAGGLSRDYLNKLAVLKLNGGLGTTMGCVGPKSIIEVRDGNSFLDLSVRQIEHLNRKYNVNVPFVLMNSFNTDEATAKVIKKYEAHKIDILTFNQSRYPRVHKETLLPVPHTADSAIDEWYPPGHGDVFEALTNSGIIDTLIAQGKEYLFVSNIDNLGAVVDLNILNHMVETNAEYLMELTNKTKADVKGGTLIDYDGNVRLLEIAQVPPQHVEEFKSIKKFKYFNTNNLWFHLPSVKRVVNNHELSMEIIPNKKTIKHKGENINIIQLETAAGAAIRHFKNAHGVNVPRRRFLPVKTCSDLLLVKSDLYSINHGQVEMNPRRFGGTAPLVKLGAHFKKVADFSAHIPSIPKILELDHLTITGDVNIGRNVTLKGTVIIVASDANRIDIPNGSVLENCVITGNLNILEH

SEQ ID NO: 13534 - protein, 340 aa, Schizosaccharomyces pombe
MSSYILFGLENPLLDYYVGGETATLEKYGLKSNDAVLASESQMGIYKEPCVSYSAGGAAQNSCRAAQYVLPPNSTVFAGCVGQDKFADMLLESNEKAGLRSEFSVDPTTPTGVCAVVLSNNNKNRSLCTNLGAANNYKLKDLQQPNVWKFVEEAKVIYVGGFHLTVSPESMLCLAQHANENNKPYIMNLSAPFLSQFFKEQMDSVIPYCDYVIGNEAEILSYGENHGIKSTDVQEIALALSSVEKVNKKRTRVVVITQGADATIVAKDGKVTTYKPNRVPSEEIVDTNGAGDAFAGGFIAALSQGQGIDYAVTLGHWLGQECIKVSGTTLPLPKKQFPLP

SEQ ID NO: 13535 - protein, 132 aa, Schizosaccharomyces pombe
MSGGKSGGKAAVAKSAQSRSAKAGLAFPVGRVHRLLRKGNYAQRVGAGAPVYLAAVLEYLAAEILELAGNAARDNKKTRIIPRHLQLAIRNDEELNKLLGHVTIAQGGVVPNINAHLLPKTSGRTGKPSQEL

SEQ ID NO: 13536 - protein, 380 aa, Schizosaccharomyces pombe
MQQSPTAGKIINCKAAVAWQPAAPLSIENVQVFPPRVHEVRIKIVNSGVCHTDAYTLSGKDPEGLFPVILGHEGAGIVESVGPQVTTVQVGDPVIALYTPECKTCKFCKSGKTNLCGRIRTTQGKGLMPDGTSRFSCNGNTLLHFMGCSTFSEYTVVADISVVAIERLAPLDSVCLLGCGITTGYGAATITADIKEGDSVAVFGLGSVGLAVIQGAVKKRAGRIFGIDVNPEKKNWAMSFGATDFINPNDLQSPIQDVLIHETDGGLDWTFDCTGNVHVMRSALEACHKGWGQSIVIGVAAAGQEISTRPFQLVTGRVWRGCAFGGVKGRSQLPDLVKEYLDHKLEIDKYITHRRPLKEINEAFTDMHNGNCIKTVLSIP

SEQ ID NO: 13537 - protein, 624 aa, Schizosaccharomyces pombe
MDLLGLKELDNNKLVSKAKENGVEFSDLFLLSSGYLRDRENASASVSSKNERMVLNEERQNCWTKRNDPKGLTYYQLLKPSEVEILSRPETRRKRMACQVFFLNYYISTIEYHKLRKERLEEFTACTSSLKQSKQKRLWKEHCGRERAFLRKKRTKIQCSHFDLLVKLGQGGYGSVWLAKKRNTHELLAMKMMKKSTLQQLNEVKHILNERDILTNTNSEWLVKLYYAFQDKEKVYLAMEYVPGGDFRTFLTTKGLLHENQTRFYLAEMVAAISAVHKLGYMHRDLKPENFLIDQKGHIKLSDFGLSTAIVTSNQVNRLQHALVSAVNPQRPYLTQKQRRNIYKALLEKNENKVNSVVGSPEYMAPEVVYGKKYDRTVDYWSLGCICYECLVGYPPFSGSTLQETWTNLYYWREMLQRPSKNENGIYDKKARSVSDEAWSFITKCLTEPTSRFQSTIEIQKHPFFKRLHWNGLRKRAVPPFVPRLENQLDTSYFDDFNDEQVLDAYKDVYEKQRKAEQKAKSNGVMNGNQRQFLGFTFKYRPNARKPLVGRHREKRQLRKEKPEKKNNSTKQKDLITVSHNKGTTAIEDLDEDKRSKTKGHKTKSSRVHRLLERKGKDLYEFLL

SEQ ID NO: 13538 - protein, 1147 aa, Schizosaccharomyces pombe
MSFLFKRNKGSAHKPTKPNFSKTSTTPSTSQLKHSHESNVKMSTSTVTEHRKKPTGSGSHITASPWSKLTVRGSSNVLPRYSHASHLYAEGGQEIYIFGGVASDSQPKNDLWVLNLATSQFTSLRSLGETPSPRLGHASILIGNAFIVFGGLTNHDVADRQDNSLYLLNTSSLVWQKANASGARPSGRYGHTISCLGSKICLFGGRLLDYYFNDLVCFDLNNLNTSDSRWELASVVNDPPPARAGHVAFTFSDKLYIFGGTDGANFFNDLWCYHPKQSAWSKVETFGVAPNPRAGHAASVVEGILYVFGGRASDGTFLNDLYAFRLSSKHWYKLSDLPFTPSPRSSHTLSCSGLTLVLIGGKQGKGASDSNVYMLDTSRFRLGSVPTTSGRQRNTSFFSNSTGNTNPSAFNGLLTSSRIPSYNGSKVRSTSHPSRQQYIGSSNSRFNTRHQTISTPVSGRASNDLPSPVVPTRSNSSSILQPSYNLNSHSSDRRNTNDDDQSSLNSQQLSNQAKAQGEVSPTLSFVPSSHSMEQGNGSVASANNAQSEAATRSINSISEVSEVRFPEQSSVKTVDERKSLDGRITSVTLETLVEKYSELSKQQIVEWFKSKLYEILRDSASKIDSLTEKLKVANAEKNAALCEAALEKVPLAKHNKLSDGTFSTPDKENVQSTNDAHIMQENFSLHKALEVMRETSSDLDKQLKDATASQKELIVQTSSFQKELVEERERHNAISKRLQEIESLYRDRELLVTNLEDQLVDQTVTINKFAFERDQFRERSMGFENTIKDLTRKMEATDMLNVSLHESLRSVQTENSELVTEMALLKAELVKKQAIIDANANIYDKLTADHTNYETVSADINQNLKETLDKLLNGSSDFKNNEIELLHDQIRITNAKLEKREKLINASKYIEDTLRSEIQEAAEKVSNLEFSNFNLKEENSNMQLQLMKALEQRNTGAKQLVNLRMQLSTATSELDMLKLKLRTTALALEESPDDYSDILSILRADMSPFHDLHKQCGVLIDTLNGVKRGFGIFEKKFTDYHKFLENISDKLKSEEDTSLETPIHENQSIQSDQIKEVGEVLSAIKSLSDSVMLLKNQIDDLAKEKLPLSSSDDEKVNIKEKTDFMKLLVKSGLSNPPAKEPVHDNEN

SEQ ID NO: 13539 - protein, 576 aa, Schizosaccharomyces pombe
MQPQEVDLMENSTMRNGARVLPPEAISKRHIGPYIIRETLGEGSFGKVKLATHYKTQQKVALKFISRQLLKKSDMHMRVEREISYLKLLRHPHIIKLYDVITTPTDIVMVIEYAGGELFDYIVEKKRMTEDEGRRFFQQIICAIEYCHRHKIVHRDLKPENLLLDDNLNVKIADFGLSNIMTDGNFLKTSCGSPNYAAPEVINGKLYAGPEVDVWSCGIVLYVMLVGRLPFDDEFIPNLFKKVNSCVYVMPDFLSPGAQSLIRRMIVADPMQRITIQEIRRDPWFNVNLPDYLRPMEEVQGSYADSRIVSKLGEAMGFSEDYIVEALRSDENNEVKEAYNLLHENQVIQEKSHLSKSKRVDSFLSVSPPAFSEYTSELQKKSKQELIDPTLEGPRWTVSDPPTYAKQTIDSNICVLVPTAEKNKLEMRTLADAASAVDTSQSTRKKSRRNKWHFGVRCRGDAPEILLAVYRALQRAGAQFTVPKPVNGKYRSDMYTIKSRWEIPHCKREGKNTYAYIELQLYEVMPGCFMLDVKSNGYKDIYSHPERTADHGMDDLKSSFPFLDLCAMLVCKLFSA

SEQ ID NO: 13540 - protein, 2344 aa, Schizosaccharomyces pombe
MYSQHELRNKVSLALSSLLRYTFELTPFFELYEADFAYALYAGFELATNRKVVGKFSFQNVHLENEYNILTEIAKDERASKFSPTPIEFTSFPHIDLSACIAYDFGHGAELSTSYAYFRENPAEFVRFCIAICKCIEYLHSKGMVHGEIRLDSFIPISSYDNVYMLTVGSGASYFHNCLQAHNWRKYSEDSESMSRILFISPEQTGRTSYSVGYRTDIYSLGVLFFHYLSDCSPYTGSFVQRIRSILTEPLPDISKSCPKLPHLIFKIIEKMTRKNPDERYTSCSGIVNDLEACLDDIDKGLILNDHVLEKTGRTSLFYLPCSIYGREHEIKLIRKILRNSPRAINHQDKKDLETFNPYYLNAIESESSSQSLSLSQRASEVMPLVILITGCEGIGESSLIQTICDRREGYMAITKFEVSQSIVYSAIVSAVAEFIRQILAEDQLLLNNFFEELKNKLESDLYLLDSVFDLVPEIRSLLQQFSTSSGNTRKTSLLGSNHSSYSDKLGSPTILSTSFSLARPYPEPALVSPSTERPPRSSFSAALMTLLNIIASFKKVTMVIENIHLADESSLIILQKIVYSDLPLTLMITCDKENDHVINRFRLANDRIHEIELKPLSFNAVNSYVQATLHRTDDGLARFSSYVYHISKGVPLLVRNVLLSIYENKIIYFDWKKNRWEVNYDEMYTLDNDYSEPDAFMTAKKKISKLNDSSRAILGWASLLGPSFSFATVKKLCKDTDNIELNVEALQSALREGIIYATSSDDTYTFSRSIYVKAMRDLLNEAKIQIMHACLIDVCLKNRDRYNIFDIAFHINAAFDFVKGDKRSVEYCHYLHLAAEEALKIGANQEALDLYNRCIKMIPHEIPEESDDSYIRCQLIGMYVGCAEAYWVNDNFDTASEMLKLAEEKACNNSEVFPARFLYSRILFEGVHIEECTQYVLSCLKPLGYELKRHSLEDSKSIISALIPRIIDKITKSSEESQSSTDDDDRRIFEILSFLYVGSVATSYFSETAEMAIDFGIAQVEFFLSTVVNSFSAFALVYFAILANSLLEPSEDILFIGNYGEKLNREAENPIIFSRTEYLYVQSLGFIDSTTKERRLTIDYLDRNCVTCSDKHVIISLLLVSSWEKFLTSNNYSNYLADFETTHAQIMEMKPWVGDTSLITQLKRFLMCLQDNIKLDLIKSKSFLSDHNIQLSSPAAQESAKLAFSLHGWINSWYLLALVMHGEWDMAISYGENFKREFKNALLTSSRVFGIFMFTWSLVNKMLICPEFTKQKKYYEQYKENLGFFDSLCIGDNECITRVYFLLLKACGLIMNGLNFEASVMLEEVISLTEKLELFLLQAFAFETVGSIFVSMELYTSATQYLEEAIRNYAALGVKQKARHLRDKFGDLLVSNNLQVSIDEATQTDFPLVFSPERSSIDINASSMRSEKASFEIPFPEEQIDDDVSPVAQDSSLEELLISLDIIDLTSVMRSCQTIASEIELTGLLSTMTQRMLEDSSANAAVIAIRDDVGFKIAAYRTGELNEVFAPPMPITEDQTYVPSRVINYVVHTQKALFSNNINHEFDLQQERWNIENHMGRSVIAIPLYQKKEVFAILYLQGPPSAFHSRHMSVLSILGAQASFAIVNISLFHKVKEATNVNTIIIKAQREALNLVQKSEAKYRSFVDTMPCLLSKLEFDEELRIELFGSFWKEYCGELNINDPNTWKEYVHLDDHLKLQDFLLSHLHNPLPFELEIRIKRKDGVYRWNLTRCTPTTNEKNRTSFLCATIDIDDQKKARATALELARLRSNFLANISHELRTPFSGFYGMLSLLDDTNLDSEQRDIVSAARISCEMLLRVINDLLNFSKLEAGKVTLESDLEFSLESVVCDCMQSVYSACAEKGINLSYNVSPDIPFFTAGDGMKIGQMLKSILDNSVKTVNNGFIRVRAFLAGSSKKNDRDQLQIAFIVEDTREESNAIFLANMINSLNRGCNDYLPMDLSGTALGMSTCLQLCKIMGGSVSVEVSQNNPTFKICYDLKIHELGKERYDIIATPLFQNLTEFNDLIKSKVAIRVSKTSTEYDNITTYLQAARKVLHVFKGLQDLASIFDLSPDSALLRCSVVVVDVYSMDDVKAVEKILKSYPDVHVIYLCCDPSRLNIEQELQKPSGRSFACKKRWGFLQMPCTRENFLKVTLQVFKSNEDTCNFYSYVNEYGESPKPDDDMDRLNKCVGSKILIAEDNPIVRMTLKKQLEHLGMDVDAAEDGKETLQIFESHPDNYYQVCFVDYHMPVYDGLEVTRRMRKIERKHGCAPLPIFALTADMQPTMETQFQEVGITHYLSKPFKKETLIKMLLQYLVNGTDGNANTS

SEQ ID NO: 13541 - protein, 312 aa, Schizosaccharomyces pombe
MAISKESKAQYFEKLRSLFEKYNSLFVVNIDNVSSQQMHTVRKQLRGTAELIMGKNTMIRRAMRGIINDMPELERLLPVVRGNVGFVFTNADLKEVRETIIANVIAAPARPNAIAPLDVFVPAGNTGMEPGKTSFFQALGIPTKITRGTIEITSDVHLVSKDAKVGPSEATLLNMLNISPFTYGMDVLTIYDQGNVFSPEILDVSEEDLIGHLLSAASIITAISLGANYPTILSVMHSVVNAYKNLVAVSLATEYTFEGTEQTKAFLADPSAFVVAAAPAAAAGGEAEAPAAEAAAEEEEESDEDMGFGLFD

SEQ ID NO: 13542 - protein, 266 aa, Schizosaccharomyces pombe
MPANYQSVPQDDPSVPNLAQAPPAYSEYNESATENPAVDQFKNTTPVAECAKSIRMAFLRKVYAILTAQLFVTSLFGGIFYLHPAFSFWVQMHPWFLILNFFISLVVLFGLIMKPYSYPRNYIFLFLFTALEGLTLGTAITFFSARIILEAVFITLGVFVALTAFTFQSKWDFSRLGGFLYVSLWSLILTPLIFFFVPSTPFIDMAFAGFGTLVFCGYILFDTYNILHRYSPEEFIMSSLMLYLDFINLFIRILQILGMLQNNDNN

SEQ ID NO: 13543 - protein, 425 aa, Schizosaccharomyces pombe
MSYNSNPYNGGQYPPYNTYTRPNYSPNNGSQSNNTVHQYQPPRMPPPSTRPQTDGNSNQIPMENVGHISLSSANSHAYAPPSGPPPNTGANSYGNPNYSGPQLPNTQTQSYNLAGGGNFQYQYSTCQGKRKALLIGINYLNTQNELQGCINDVMSMSQLLIQRYGYKQEDMVIMTDTASNQRAIPTRQNMLDAMRWLVSDAQPNDALFFHYSGHGGQTKDLDGDEVDGYDETIYPLDHQYAGQIIDDEMHEIMVKPLPAGCRLTALFDSCHSGGALDLPFTYSTKGVLKEPNMLKESGMDVLHAGLSYASGDIMGAINNVKNIFTSATNGFNNNALQYSRQVKFSPADVISLSGCKDNQTSADTSVNGFATGALSYAFREVVTQNPQLSYLQLLRGIRQVLSNKYSQLPQLSCSHPLDMNLAMVL

SEQ ID NO: 13544 - protein, 293 aa, Cricetus cricetus
LSVKFGATLRTSRLLLERAKELNIDVIGVSFHVGSGCTDPETFVQALSDARCVFDMGTEVGFSMYLLDIGGGFPGSEDTKLKFEEITSVINPALDKYFPPDSGVRVIAEPGRYYVASAFTLAVNIIAKKIVSKGSDDEDESSEQTFMYYVNDGVYGSFNCILYDHAHVKPLLPKRPKPDEKYYSSSIWGPTCDGLDRIVERCNLPEMHVGDWMLFENMGAYTVAAASTFNGFQRPSIYYVMSRPMWQLMKQIQNHGFPPEVEEQDVGTLPISCAQESGMDRHPAACASASINV

SEQ ID NO: 13545 - protein, 177 aa, Hordeum vulgare
LAGDSPGNVPGSWKEPGIGWMTGFLLACSFGGLLTLIPLRQVLAVDYKLVYPSGTATAILINGFHTDQGDKNSRKQIRGFLKYFGGSFMWSFFQWFYTGGDACGFVQFPTFGLKAWKQTFYFDFSMTYVGAGMICPHIVNISTLLGAIISWGIMRPLISKNKGDRYPAKVPESSMKS

SEQ ID NO: 13546 - protein, 344 aa, Schizosaccharomyces pombe
DLDEIDTDIVTLSSFILQEQRRYNQKHKNEEGKPCIIQEASGELSLLLNSLQFSFKFIANTIRKAELVNLIGLSGIVNSTGDEQKKLDKICNDIFITAMKSNGCCKLIVSEEEEDLIVVDSNGSYAVTCDPIDGSSNIDAGVSVGTIFGIYKLRPGSQGDISDVLRPGKEMVAAGYTMYGASAHLLLTTGHRVNGFTLDTDIGEFILTHRNMKMPLQHSIYSINEGYTAFWDEKIARFIAHLKESTPDKKPYSARYIGSMVADMHRTILYGGLFAYPCSKGNNGKLRLLYECFPMAFLVEQAGGIAVNDKGDRILDLVPKTLHGKSSIWLGSKHEVEEYINFIK

SEQ ID NO: 13547 - protein, 482 aa, Schizosaccharomyces pombe
MTTRRLTRQHLLANTLGNNDENHPSNHIARAKSSLHSSENSLVNGKKATVSSTNVPKKRHALDDVSNFHNKEGVPLASKNTNVRHTTASVSTRRALEEKSIIPATDDEPASKKRRQPSVFNSSVPSLPQHLSTKSHSVSTHGVDAFHKDQATIPKKLKKDVDERVVSKDIPKLHRDSVESPESQDWDDLDAEDWADPLMVSEYVVDIFEYLNELEIETMPSPTYMDRQKELAWKMRGILTDWLIEVHSRFRLLPETLFLAVNIIDRFLSLRVCSLNKLQLVGIAALFIASKYEEVMCPSVQNFVYMADGGYDEEEILQAERYILRVLEFNLAYPNPMNFLRRISKADFYDIQTRTVAKYLVEIGLLDHKLLPYPPSQQCAAAMYLAREMLGRGPWNRNLVHYSGYEEYQLISVVKKMINYLQKPVQHEAFFKKYASKKFMKASLFVRDWIKKNSIPLGDDADEDYTFHKQKRIQHDMKDEEW

SEQ ID NO: 13548 - protein, 865 aa, Schizosaccharomyces pombe
MVIEKRESFIEVVINSLLNDNPAQAKFDKYSILVSLGFSSLLSVILLCIFTLLRTKFNTYDRCIPPMKKSLWGWIEPLWSIKVEDCLYNMGADAVISLLFSRFCRDVFLILAAICCTILIPINIVATNKTLANSDSQNAYAKLSIQNVTGNWTWAHVVICYVFNVLVLFLLARYYQIVMRIRQRYYRSPTYQQSMSSRSLLIMDIPTTMRSNNGLSILASRLKSSEAPMHVHICHAIKNLPKILKKHDNAVRSLEAVLAKFFKNPKKLPDDRPVRRVKQGLLTSEKVDAIDYYSAKIENYGLRVDAARESLYENEFEHYGFITYKSSYIAHDTARHNSRVAGASVSMAPEPSDFLWDNLSLAWSTRLFNRMIGNILFIILIIAWIIETALVAIFISNLYHLGSVWPWLQQQLTSRSGFWSIVQGILSPAVAGFTFMILEIIMRRISYWQGSFTKSSRERGVLNKLHIIFTLDNFIIYTLMAVFWRLGVIIAYKTKEEGNFAEGMSAFATFDTVGLSVSSFVQFSTFWIMFIAHSTCSFFVEIAQPITLTIRLIKTKFFSPTPRDLLEWTAPTKYVYSQVLNKLIYFFTIAICYACINPLVLLFASVLFCVNYLTQKYILMYVSNSSTESGGGYWRPVVNRILLGLELANIILFLCLWVQGGRVRAYCIIPNFSFAIAFKIWCMFALDPKSHYMIEDPYMKVVEPLENEISESEMCFGHPSTYAPLLVPMVRSDARALLPLFYSGRTETHNKFDFATDSDDASEKHLRGEEEPLENVDFVDIDNVDTAKEVHDQQQVQQLKKNLSRSYTRSRGVSLRARLNEEELPLTESITQDSQISIPETLESQSTEITPINVSEHYDKYYHIF

SEQ ID NO: 13549 - protein, 676 aa, Schizosaccharomyces pombe
MLFAPAPRLPSRNGESSEKSIKAEKRAFSEIKNATFLNIPERVEHSLTFPTEIWETRDGLFEEPVGKGDSHLNHTSVMTGNWNILPYPSFGKVSPNVTWHTTLRNIVMSQSGRFSANLYEYVDGNSDGISFVLNLENNNDTSVYHMTFHGDRVKPINVFLGSTDVTPNFGGVDVIPWLLKDSPYKDAPPLDGTEYFPLLQNRSLERIETRLQDAQTVGWSPLVFEEEEVTCSAFVFLHNKNTGLDKETLKAIENEFYHPQGVSTQKMPEVFVSGLVYSPDCNVAFTFSNTKGPRNFVLENHLVRFSSLYIFIVLSQIFVLLRQMRINSPSHVQRLSFLTIAMQAGLDAYIAIFFLSTNAVIEKGYLPFVSVAFLSLVPSVMFTMRYLALILRVQNSNMPPPAPRPVTNNSSNNNTNQSNASNENSPNAPSAANDNTETTTVNPPQEDDQPMTQHERDQRDWSAVCLRFYFIILVVCIASLYSAFWPVIYRFYFISALIFTSYSFWIPQIIQNVKQGTSRSFTWTYILGASVLRLYLPLAIFIDSELILGFPPKYFFALGLVLWMLFQVLVLLVQDTLGPRFFLPKKFFLSSPVYDYHPVIQQDDLEAFMRDANVCPICMQPIELVSTGSTLNPASMMVRRNYMLTPCHHLYHRQCLLQWMETRSICPVCRCHLPAV

SEQ ID NO: 13550 - protein, 422 aa, Schizosaccharomyces pombe
MDRRHRVYRVFNQEMYVEPNFKVVKELGQGAYGIVCAARNVASKDQEAVAIKKITNVFSKSILTKRALREIKLLIHFRNHRNITCIYDLDIINPYNFNEVYIYEELMEADLNAIIKSGQPLTDAHFQSFIYQILCGLKYIHSANVIHRDLKPGNLLVNADCELKICDFGLARGCSENPEENPGFMTEYVATRWYRAPEIMLSFSSYHKGIDVWSVGCILAELLGGTPLFKGKDFVHQLNLILHQLGTPDEETLSHISSSRAQEYVRSLPKQRPIPFETNFPKANPLALDLLAKLLAFDPNRRISVDDALEHPYLAVWHDPSDEPVCDSVFDFSFEYIEDANELRRVILDEVLNFRQKVRRRSHPTNPTVNIPQPAQTVPSNDNGSFNVSSSSSSQTSNKKRHDHSYNETAAIDHKSDDNRHN

SEQ ID NO: 13551 - protein, 889 aa, Schizosaccharomyces pombe
MQCYLKRKERSVAFITEKYAAIIQKPSVKDSDCIITFTCISLEEFEKIKEYELLFGGEKILGTLGLFNYVCEDMKEGVFLCVARKAKLVLRIGNRDPISKLENVSFISLDQELWDEELFEPMPRNSSPSSTFSTSTSDLNNIEKDNLVNSEYSSKYSSTTRIYPYHSLSQLTDLLTDGSFYVSTNISCFSRFQSEQPYGPKDIYCWNRFLITELDNHFSEAHILEKFPNLLLHCFRGYVERMFIDSMSMSIISKVSSYGSRQTYPPSGIDDSSYCSMFVETEFIVEIAQTVFSFVQVRGTVPCFWEEQFSSWYGPSISFLRSSQASQSLFNFHFSKLYKAYGDIYVIDLLQTKGFEASLYEAYKHHLMLLPFPAVVKKFHFTPDPARPDIDPRLETDLADDLKEMGYTQKSIENDMLESFQKGVFRINDLDCLGRTNVIQYQISRLVLKDIFFNLQIGVTFNILEYLRHLWSNNGDAIAKLITGVGSIGSSATRRGRKSIAGSLSDISKSFGRMYVGRYPDVESQNAILLLLGCFPNQSPVLISESVSSYIQGVLRQRRSEYRVERDFSIFSSTFNANGKVPSTDEFKRLLLPFGERTSAYDLYVVAVQEIITLNMSHLVSSSNQKLRIWEEKILMILNSRDSNNKYMLISSIQMAGVFLGVFIRKDDHLVVSKVTKTTRKTGFGGFSANKGAVAIEMNVCDSDFCFVSSHFAPKVNNISERNMEYTSISDNLVFPSGMKIYDHTNILWMGDFNYRIDSDNEEVRKLVELDDLDKLASYDQLCTEMKKGTVFHGLVEPQLTFLPTYKFDNGTNDYDTSDKQRVPSWTDRILATKSFTRNCYKSCDIRCSDHRPVFATFSLKIFSTCMDKKAGIIRDARIAYIKSKNSNK

SEQ ID NO: 13552 - protein, 322 aa, Schizosaccharomyces pombe
MATSSAAAAASTPVNANTITETKNSTFFFDFMMGGVSAAVSKTAAAPIERVKLLIQNQDEMIRAGRLSHRYKGIGECFKRTAAEEGVISLWRGNTANVLRYFPTQALNFAFKDKFKKMFGYKKERDGYAKWFAGNLASGGAAGAASLLFVYSLDYARTRLANDAKSAKKGGERQFNGLVDVYRKTYRSDGLRGLYRGFGPSVVGIVVYRGLYFGMYDTLKPVVLVGPLEGNFLASFLLGWAVTTGSGVASYPLDTIRRRMMMTSGEAVKYSSSFECGRQILAKEGARSFFKGAGANILRGVAGAGVLSIYDQVQLLMFGKKF

SEQ ID NO: 13553 - protein, 1973 aa, Schizosaccharomyces pombe
SIALGQAFSNYAYDLFDLIFASGLSEASYRALSDLAHNIPPLLPVIQERLLDMLSKILSGRPFIPPGCPPQYVARSLKSSKSASLKTGFFPNDVYILALKVLGNFDFSGYILNEFVKDCVVVYLENNDPEVRKTASITCSQLFARDPILSQTSDHAIQVVAEVLEKLLTVGICDTVPDIRLTVLNSLDSRFNKHLAQADKIRLLFIAINDENFAVRESALRIIGRLNVYNPAYVMPYLRKIMLKTLTILDYSTIIRTKEENAKLLCLLIAAAPRLIESHVEPILQILLPKAKDSSSIVAASIVNSLGEICQISGEVIVPFIKDLMPLIIEALQDQSSPIRRAAALKALGNLSSSTGYVIDPYIEFPSLLDILIGITKTEQDITIRRETIKLIGTLGALDPNRHRVLEKGTEKVVPEQKNIPPDISLLMSGIGPSSDEYYPTVVITALMSILKDPSLTIHHTAVIQAVMYIFKTMGLRCAPFLSQIIPEFIAVMRTCPTNILEFYFQQLSILVLIVRQHIRSFLPDLFKLIKDFWNPHSNLQFTILSLIESLARAMQGEFKPYLPSLLVMMLQIFDSDVSVDSVSTKKVLHAFIVFGDTLADYFHMLLDPILRLYERNDVSIGIKESIMITIGRLSMVINLSEYASRIIHPVMRMLSCNNASLIRVSMDTVCALIYQLNVDFAIFIPMIDKCLKMNGVTHETYSILVEQFLQEQPLPIKLNPYEKYDKPKLDVVASAADITSKKLPVNQEILRNAWEASQRSTKDDWQEWIRRLGVALLRESPSHALRACAALAAAYQPLARDLFNASFVSCWSELYDHFQEELVKSIEIALTSPHISPEIIQILLNLAEFMEHDDKPLPIDIRTLGAYAAKCHAFAKALHYKELEFIEEELVTKPSVDTIEALISINNQLQQPDAAIGILKHAQQHDKMNLKETWYEKLQRWEDALSAYEKREAAGAGNFEITMGKLRCLHALGEWDRLSQLAQENWIHAGHDARRYIAPLSVAAAWGLGQWEQMDEYISVMKSESPDKAFFNAIVALHRSQFEEAASYITRARDLLDTELTALVGESYNRAYSVAVRVQMLSELEEIITYKKAEDKPEVREMIKKTWVRRLKGCQRNVDVWQRMLRIRSLVISPRDNMEMWIKFANLCRKSGRISLAKKSLNLLLEDDENLDNSLVLKKTHPSIVYANLKFLWAVDDKRKALNSMQEFTSQLISDINVDPALFVQSTSVNTQKSQEEIQYYFHLLARCYHKQGQWQQEIENNWSEGSFDGVLQSYMYATQFDSKWYKAWHSWALANFEAVKFLEQSEEQIPSAAYEQYIIPAVKGFFKSIALSKGNLQDTLRLLNLWFKFGNNSNVINTLNVGISTVNIDIWLDVIPQLIARIHASSLSVRKSVHQLLSDVGRAHPQALVYPLTVAAKSQSSARQNAALAIMDSLKTHSPRLVEQARLVSHELIRAAILWHEQWHEGLEEASRLYFGDHNIEGMFAVLRPLHEMLERGPETLREISFQQAFGRDLVEARDCCIRFEQTGDISDLNQAWDLYYQVFKKIRKQLPQLTTLDLQYVSPKLLHVHDLELAVPGTYVSGKPVIRIVKFYPTFNVITSKQRPRRLSIKGSDGKDYQYVLKGHEDIRQDERVMQLFGLCNNLLLADPETFKRLLSIQRYPVIPLSPDSGLLGWVLDSDTLHVLIRDYRESRKILLNIEHRLIIQMAPDYDRLTLLQKVEVFEYALLSTTGQDLYRVLWLKSRSSEAWLNRRTNYSRTLAVMSMVGYILGLGDRHPSNLMLDRYTGNIIHIDFGDCFEVAMHREKFPEKIPFRLTRMLVNAMEVSGIEGTFRITCEHVMRVLRTNKESVMAVLEAFVYDPLINWRLAPAYSPSIDEKQSNEPNTLLGETIDGLHRKRLNEEGITLEERQKPEILNQRAITVLNRVSNKLTGRDFKPQQQLDVPSQVEKLILQATSIENLCLCYIGWCSFW

SEQ ID NO: 13554 - protein, 221 aa, Schizosaccharomyces pombe
MSLILYPKPTSYLYQPFIKAYFSLNMAIFEINNSFLICAVSIALNPLLWNIAARSEYNHKTLTKLANGDSKKACYMLAACIFVAGIVRDLIYQNALKQQPTLGIFMNPLVQGIAKLIFCFGSVLVLSSMYKLGLVGTYLGDYFGFLLPERVSGFPFNVNDNPMYNGSTLCFLSTALRYGKVAGLLLTLEVFFVYRIALKFEEPFTAKIYAARDSKQAKKSE

SEQ ID NO: 13555 - protein, 161 aa, Schizosaccharomyces pombe
MSKIKLISSDNEEFVVDQLIAERSMLIKNMLEDVGEINVPIPLPNVSSNVLRKVLEWCEHHKNDLYSGTEEESDIRLKKSTDIDEWDRKFMAVDQEMLFEIVLASNYLDIKPLLDTGCKTVANMIRGKSPEDIRKTFNIPNDFTPEEEEQIRKENEWAEDR

SEQ ID NO: 13556 - protein, 295 aa, Schizosaccharomyces pombe
MSVYRDNMYMKYDRNFENRVARRNGQARNASLAKTLHDSGIAERARSPSGSAIPHAYRVMNGSGANDTSLPLTSNPAYVALTSRISSSKSENNQQLAANETAGAPEGTEETVDISNSISDDHANAKNLPAASVKALVGAGVLSDELSVIAYDMSFEDELIQDKQLIDHSVFDQLLEMDDDDEHEFSKSIVWNYFEQAETTIADLQKALEAKDLKKLSSLGHFLKGSSAVLGLTKMRKVCERIQNYGSLRSRDGVMKLPSEEIALDLISKSLSVVNDFYKDARAYLLDFYEKNSST

SEQ ID NO: 13557 - protein, 348 aa, Schizosaccharomyces pombe
MNELTSQTTDQLSVTPKKADNDSYYFESYAGNDIHFLMLNDSVRTEGYRDFVYHNKHIFAGKTVLDVGCGTGILSMFCAKAGAKKVYAVDNSDIIQMAISNAFENGLADQITFIRGKIEDISLPVGKVDIIISEWMGYALTFESMIDSVLVARDRFLAPSGIMAPSETRLVLTATTNTELLEEPIDFWSDVYGFKMNGMKDASYKGVSVQVVPQTYVNAKPVVFARFNMHTCKVQDVSFTSPFSLIIDNEGPLCAFTLWFDTYFTTKRTQPIPEAIDEACGFTTGPQGTPTHWKQCVLLLRNRPFLQKGTRVEGTISFSKNKKNNRDLDISVHWNVNGKADSQSYVLN

SEQ ID NO: 13558 - protein, 103 aa, Schizosaccharomyces pombe
MSGRGKGGKGLGKGGAKRHRKILRDNIQGITKPAIRRLARRGGVKRISALVYEETRAVLKLFLENVIRDAVTYTEHAKRKTVTSLDVVYSLKRQGRTIYGFGG

SEQ ID NO: 13559 - protein, 543 aa, Schizosaccharomyces pombe
MLVKPMACYFEIWTRKVTTIEDFSLAIANRFKQMGSHSDSEVDWDNEEEVWEDEVHEFCCLFCDSTFTCLKDLWSHCKEAHNFDFYQVKQQNNLDFYACIKLVNYIRSQVKEGKTPDLDKLSDILRSDEYMISVLPDDSVLFSLGDELDSDFEDDNTLEIEVENPADVSKDAEIKKLKLQNQLLISQLEEIRKDKMNELTSQTTDQLSVTPKKADNDSYYFESYAGNDIHFLMLNDSVRTEGYRDFVYHNKHIFAGKTVLDVGCGTGILSMFCAKAGAKKVYAVDNSDIIQMAISNAFENGLADQITFIRGKIEDISLPVGKVDIIISEWMGYALTFESMIDSVLVARDRFLAPSGIMAPSETRLVLTATTNTELLEEPIDFWSDVYGFKMNGMKDASYKGVSVQVVPQTYVNAKPVVFARFNMHTCKVQDVSFTSPFSLIIDNEGPLCAFTLWFDTYFTTKRTQPIPEAIDEACGFTTGPQGTPTHWKQCVLLLRNRPFLQKGTRVEGTISFSKNKKNNRDLDISVHWNVNGKADSQSYVLN

SEQ ID NO: 13560 - protein, 433 aa, Schizosaccharomyces pombe
MATQNYKVADISLAAFGRKELEIAENEMPGLIAVREKYAKSQPLKGARIAGCLHMTIQTAVLIETLVALGAEVTWSSCNIYSTQDHAAAAIAATGVPVFAWKGETEEEYLWCIEQQLKSFPSGKPLNMILDDGGDLTALVHERHPELLVDIRGISEETTTGVHNLYKMFKENKLKVPAINVNDSVTKSKFDNLFGCKESLVDGIKRATDVMIAGKVAVVAGFGDVGKGCSTSLRSQGARVIVTEVDPINALQAAMDGFEVTTMEEAVKEGQIFVTTTGCRDIIRGEHFNEMKEDSIVCNIGHFDVEIDVAWLKANAKDVVNIKPQVDRYELKNGRHIILLADGRLVNLGCATGHPSFVMSCSFTNQVLAQIALWTDNTSYPLGVHMLPKKLDEEVARLHLGKLGVKLTTLTSVQSDYLGIPVDGPYKADHYRY

SEQ ID NO: 13561 - protein, 400 aa, Schizosaccharomyces pombe
MKMQVSTREWILTLRLLKDLEDMDSIGDNVTEMDAFVRDLTMKPYAELEKRKAELHAQKLKLVQKRQQLLRDNYNVLVDYARNQDAFYQLLENSRHDFKELVLHTNQLYEPVKRSQNFLTSISEHYRDAKLMHQVQPQLSSILELPELMNACIERNYFSETLEFQALAYRLKDRFGTNSIIQELITQVETLVVKLTEKLILQLQKPLKLYSLIKVVTYLRVTAKLSEAQLKYVFLYFSWKQLQTSLRNLVPLLDYNNPELYLRRYIQVIRDRAFSLLFQYQSVFGESSNDRLNAAGTVDIPNSTSTSASPFEMDPEGFNNFGQNILSSFVRKLQLEICYVLQKFMPNVKDSTSKFSLLLQLYYCNQSLTKVGTDISIPLSKILGSEWLEMIHSQSSEKQA

SEQ ID NO: 13562 - protein, 297 aa, Schizosaccharomyces pombe
MENYQKVEKIGEGTYGVVYKARHKLSGRIVAMKKIRLEDESEGVPSTAIREISLLKEVNDENNRSNCVRLLDILHAESKLYLVFEFLDMDLKKYMDRISETGATSLDPRLVQKFTYQLVNGVNFCHSRRIIHRDLKPQNLLIDKEGNLKLADFGLARSFGVPLRNYTHEIVTLWYRAPEVLLGSRHYSTGVDIWSVGCIFAEMIRRSPLFPGDSEIDEIFKIFQVLGTPNEEVWPGVTLLQDYKSTFPRWKRMDLHKVVPNGEEDAIELLSAMLVYDPAHRISAKRALQQNYLRDFH

SEQ ID NO: 13563 - protein, 171 aa, Schizosaccharomyces pombe
MILRHAPRVHESAFSLTHKTFAFCNCNNRFKMMSGGGKGKHVGGKGGSKIGERGQMSHSARAGLQFPVGRVRRFLKAKTQNNMRVGAKSAVYSAAVLEYLTAEVLELAGNAAKDLKVKRITPRHLQLAIRGDEELDTLIRATIAGGGVLPHINKQLLIRTKEKYPEEEEII

SEQ ID NO: 13564 - protein, 276 aa, Schizosaccharomyces pombe
MKPFSPSQTNFEKEQLCFGVYQLKDCYQQVIEALSLGIRVIDSAITYRNEKECEQAIQDFCHQNVNIKREDITLITKIPDSLQGFERTWKAVEQSLRRTGRPKLDVVLIHSPKWPVRRIESWRALLQHQKEGRINKIGVSNYNIHHLEEIISLGLPLPAINQVEFSAFNNRPTFLSYCFNHGILVQAFSPLTRGYRLSDIRLLDLSLKYNKTPANILLRYCLQKGVSPIFKASSFVHIHENVKAEQFMLDPSDMDVMDTWDEEFVSKPTWNPIILP

SEQ ID NO: 13565 - protein, 310 aa, Schizosaccharomyces pombe
MAQNSTQLEKISGSFTRLAEAFQLALTACREIEESLPSILGEKSEVSKPFKPAVTDPSNAKKEINMAIESPSKKATSPKKATPAAVAPVEATSAVDTSEAVASMTPNKRKARDPAQPKRPPSAYNLFQKNQRSEIKESLGEKSNDVKEVNKAMHEKWGSLSEDDRKTYEEEASKLREAYEEEMAAYNASKENASVADSRVTAEETSTKPSEDLSSPTKKDLIDFSETRPLAQASRATPDIKEQHAKKPKRKHTRSTVPTSNVEPVSQPQPSPDKIVSSPNPPSAKREKKKRRKSSMSSSITTPPTAKVAN

SEQ ID NO: 13566 - protein, 524 aa, Schizosaccharomyces pombe
MSAFKPYTEALEVLKKYEKKDGLSIDDLIRHNFQGGLTFNDFLILPGYIDFVPNNVSLETRISRNIVLKTPFMSSPMDTVTEDQMAIYMALLGGIGVIHHNCTPEEQAAMVRKVKKYENGFILDPVVFSPQHTVGDVLKIKETKGFSGIPITENGKLRGKLVGIVTSRDVQFHKDTNTPVTEVMTPREELITTAEGISLERANEMLRKSKKGKLPVVDKDDNLVALLSLTDLMKNLHFPLASKTSDTKQLMVAAAIGTRDDDRTRLALLAEAGLDAVVIDSSQGNSCFQIEMIKWIKKTYPKIDVIAGNVVTREQTASLIAAGADGLRVGMGSGSACITQEVMACGRPQATAIAQVAEFASQFGIGVIADGGIQNVGHMVKSLSLGATAVMMGGLLAGTTESPGEYYVREGQRYKSYRGMGSIAAMEGTGVNKNASTGRYFSENDAVRVAQGVSGLVVDKGSLLRFLPYLYTGLQHALQDIGTKSLDELHEAVDKHEVRFELRSSAAIREGDIQGFATYEKRLY

SEQ ID NO: 13567 - protein, 362 aa, Schizosaccharomyces pombe
DPPLTVSSTQRISRPPSLQKSITMVGVEPLYQSNGNEKSSKYNVFSESAHGNHQVLSFSPGSSPSFIEQPSPISPTSTTSEDTNTLEEDTDDQSIKWIRGALIGSGSFGQVYLGMNASSGELMAVKQVILDSVSESKDRHAKLLDALAGEIALLQELSHEHIVQYLGSNLNSDHLNIFLEYVPGGSVAGLLTMYGSFEETLVKNFIKQTLKGLEYLHSRGIVHRDIKGANILVDNKGKIKISDFGISKKLELNSTSTKTGGARPSFQGSSFWMAPEVVKQTMHTEKTDIWSLGCLVIEMLTSKHPYPNCDQMQAIFRIGENILPEFPSNISSSAIDFLEKTFAIDCNLRPTASELLSHPFVS

SEQ ID NO: 13568 - protein, 398 aa, Schizosaccharomyces pombe
MNIDEWQRIEETAPGNKCLAKLNELESILKDAKKSCLKDPTTSMKELVACSEKTQQVFDDLKRTEKKFHTSLNRFGKTLEKKFNFDLEDIKLHSSFESKKREIDTALSLHFFRQGDVELAHLFCKEAGIEEPSESLHVFTLLKSIVQGIRDKDLKLPIEWASQCRGYLERKGSSLEYTLQKYRLVSNYLTTKDIMAAIRYCRTNMAEFQKKHLADIQKTMIALFFCSRNEVLSGTNDSHDSIHHIISNNAQLNIPQEYIDVLDLDWKSLELLFVREFCAALGMSLESPLDIVVNAGAIALPILLKMSSIMKKKHTEWTSQGELPVEIFLPSSYHFHSVFTCPVSKEQATEENPPMMMSCGHVIVKESLRQLSRNGSQRFKCPYCPNENVAADAIRVYF

SEQ ID NO: 13569 - protein, 258 aa, Schizosaccharomyces pombe
MQKLLLDPALRNWVLLPIMFVMILIGILRHNATILLQSSPKKLSKEEIREQRLLQRAYALRACSNSLLPESIEARKCFLIESLKSGKYLKPVDPNAPKAANPLMDDKTLEGLMESMKGNMLMVVPQTIIMTWINEFFSGFILLKLPFPLTLRFKSIFQSGVATQDLDVQWVSSISWYFLNLFGLKSVYALLLGENNAASNATNEMGMAGFSSAAATAQLIQPGQDISKMMLSEAENVQILKNESLLVDVEKRLLAQFA

SEQ ID NO: 13570 - protein, 439 aa, Schizosaccharomyces pombe [sequence omitted]

SEQ ID NO: 13571 - protein, 228 aa, Schizosaccharomyces pombe
MAANYWASSQLTQLFLSTDLESLEPTCLSKDTIYQWKVVQTFGDRLRLRQRVLATAIVLLRRYMLKKNEEKGFSLEALVATCIYLSCKVEECPVHIRTICNEANDLWSLKVKLSRSNISEIEFEIISVLDAFLIVHHPYTSLEQAFHDGIINQKQLEFAWSIVNDSYASSLCLMAHPHQLAYAALLISCCNDENTIPKLLDLIKSTDAFKVILCVQRIISIYYFEDIE

SEQ ID NO: 13572 - protein, 407 aa, Schizosaccharomyces pombe
MGCMSSKYADTSGGEVIQKKLSDTQTSNSSTTGSQNARVPVLENWLNIVLRGKPQNVESSGVRVKGNSTSGGNDIKVLLLGAGDSGKTTIMKQMRLLYSPGFSQVVRKQYRVMIFENIISSLCLLLEAMDNSNVSLLPENEKYRAVILRKHTSQPNEPFSPEIYEAVHALTLDTKLRTVQSCGTNLSLLDNFYYYQDHIDRIFDPQYIPSDQDILHCRIKTTGISEETFLLNRHHYRFFDVGGQRSERRKWIHCFENVTALLFLVSLAGYDQCLVEDNSGNQMQEALLLWDSICNSSWFSESAMILFLNKLDLFKRKVHISPIQKHFPDYQEVGSTPTFVQTQCPLADNAVRSGMYYFYLKFESLNRIASRSCYCHFTTATDTSLLQRVMVSVQDTIMSNNLQSLMF

SEQ ID NO: 13573 - protein, 254 aa, Schizosaccharomyces pombe
MSRKNLIKLNHDPTVTYSTKDDADELFDDLSSSPLHENVSWISWFCSRPGREYFVEVKEDFIEDLFNLTGLNLAVPFYNEALDLILDRTAPDTLENFDMDVIETSAQILYGLIHQRYIITRTGLHQMAEKYSMGIFGCCPRVNCCYTHVLPAGLSDIVGKMPVMLFCPNCLDLYAPSSSRYKNIDGSFFGATFPHLFFESYPELNPKRSIPCGKIYQPRIYGFKVSELSKTGPRMQWLRMYLEDSGSDSESESD

SEQ ID NO: 13574 - protein, 891 aa, Schizosaccharomyces pombe
MEYRTNNVPVGNETKSAALNALPKIKISDSPNRHHNLVDAFMQSPSYSTQPKSAVEPLGLSFSPGYISPSSQSPHHGPVRSPSSRKPLPASPSRTRDHSLRVPVSGHSYSADEKPRERRKVIGNYVLGKTIGAGSMGKVKVAHHLKTGEQFAIKIVTRLHPDITKAKAAASAEATKAAQSEKNKEIRTVREAALSTLLRHPYICEARDVYITNSHYYMVFEFVDGGQMLDYIISHGKLKEKQARKFVRQIGSALSYLHQNSVVHRDLKIENILISKTGDIKIIDFGLSNLYRRQSRLRTFCGSLYFAAPELLNAQPYIGPEVDVWSFGIVLYVLVCGKVPFDDQNMSALHAKIKKGTVEYPSYLSSDCKGLLSRMLVTDPLKRATLEEVLNHPWMIRNYEGPPASFAPERSPITLPLDPEIIREMNGFDFGPPEKIVRELTKVISSEAYQSLAKTGFYSGPNSADKKKSFFEFRIRHAAHDIENPILPSLSMNTDIYDAFHPLISIYYLVSERRVYEKGGNWNRIAKTPVSSVPSSPVQPTSYNRTLPPMPEVVAYKGDEESPRVSRNTSLARRKPLPDTESHSPSPSATSSIKKNPSSIFRRFSSRRKQNKSSTSTLQISAPLETSQSPPTPRTKPSHKPPVSYKNKLVTQSAIGRSTSVREGRYAGISSQMDSLNMDSTGPSASNMANAPPSVRNNRVLNPRGASLGHGRMSTSTTNRQKQILNETMGNPVDKNSTSPSKSTDKLDPIKPVFLKGLFSVSTTSTKSTESIQRDLIRVMGMLDIEYKEIKGGYACLYKPQGIRTPTKSTSVHTRRKPSYGSNSTTDSYGSVPDTVPLDDNGESPASNLAFEIYIVKVPILSLRGVSFHRISGNSWQYKTLASRILNELKL

SEQ ID NO: 13575 - protein, 583 aa, Schizosaccharomyces pombe
MGQGESIPSRQIQRDASMQAVSSESENINDSDRQNSGFSRLWNRFPSLQRVLGLRRAKRHRNDEGNSENGNRDRTTERSAFRSRYRGSLLNRNSPSLRSLSPPATPATPRSRIEGESQTSAIPQTDRLILENHQQEFERAARRFRSSIAALRNLNTQNNQSTLASNHEDENVSSSGGQEMQDHGSVNNLESPGTAIGRLPVRSVTSLADSNMEDYTRAVMNYINNSENTQQASVSPEESQLVMLSRFVFSVASGWVSVLMNSSSAHQSNNLEFPSSISGNVESGNVAFDEFLSLLHAGNLVQAMNAETNPRTAELIANAVDLEEESGPINLFRTFRFDNLHRNHEGQEVIPIIIVGIRSLRNSGSDEDDQPSADSPTLMHPSDLISSLVNSQNQTTSVSDNTGPNENVNEAEHISEDEQASTATDVNGISDNNGSSTQQAPETRNNNSQTDHQLPRSWAIYVREAFVPQNHPVLRAPSLFTDSPTYEDMLLLNSIIGIEKPPVASQKDLEKAGGVFPFSGTDERCLVCLSNFELNDECRRLKQCNHFFHRECIDQWLTSSQNSCPLCRTKGVASASTPSSPKP

SEQ ID NO: 13576 - protein, 516 aa, Schizosaccharomyces pombe
MYPHLPCKIPGLSLIYDDESKVEKSKQLSTNASSSNFVKEDQIPSNLSIDNINTPQGDPIDKNNLNTNTENNLPNIVNFQNISSANSGEIKQKDNEILFSSTEDINQHKENYQDENKIDLLDVALANPKDCVVPSSGLLMPKEEFISNEEVGIPATNSSEKSNVKIADEIAEVTHSNSSIGKSSADLSSDSSSDSESNTSFSETDVEEEKAEEKSDAESMAPSTPPKTVNELPEQIYEKPEIVLQPNSLIEPLGKIIQVLKREVVVKSDIDDEKIVFDEKTVLCFEDRSIIGYIHETFGPVSSPYYIVRFSTEEECSAINACMGRPVFYVPTMANKIDPEPLKYIKGSDASNVYDEEINPSEQEFSDDEAEVAAKQLKKKRKRKAKSMVSGNQALPGEANFQSLNQNNVRNYPFYQTNQGSNPPAKRFTQEPPSSSLYSLSESSINYSTQSPMYYNYNYPQPSFPPFHPIYNDSIGYYSQANPQMYYANQVSAPPPQGSFDPNSKFYRNSSDSYRK

SEQ ID NO: 13577 - protein, 2335 aa, Schizosaccharomyces pombe
MEYFSDLKNKNESIQLAAADQLKEFVHSSTKELSGESLARFNNDINRRIFELIHSHDSHERFGGILAIGKLIEFESEGDVTNLSRYANYLRMTLPSTDWHSMELSAKVLGHLAASGGTLAAEFVEFEVQRAFEWLQGDRQEQKRMAAILIIKALAQNSPTLVYLYISEIFQNLWTGLRDPKPLIRETAADALGASLDVVCQREAKVQLQCFNEVLLQAEHGLRQSSVEYLHGSLLAYKELFEKSGSFIREHYTEFCDLALRLREHRDNSIRRCIVFLLPTLSEYNPKKFQQRYLDSFMVYLLSHIRKDKEKSLAFEAIGRIAMAVNEAMIPYLQNILKVIRDTLTAKVREKTQYEKPVFECIGMLAAAVKLELLEDSRSLLGLIFSCELSVHLRQALVKMAENIPPLLAPIQERLLNMVSQILTGKNFEIRTNDTYTPSFTNIYSAREPDQRSKSTESIILALETLGTFNFTGYSLISFIQESVLSYLENDNSEIRIAAARTCCQVFARDPICRKTNPLAVESVAEVLEKLLTLGIADSDPKIRETVLSLLDERFDRHLAHPDNIRCLFIALNDEVFSIREIAIIIIGRLALYNPAHVMPSLRKTIIQLLSDMEYSGNSRQKEESAQLLKLLVSKARTLIKPYIQSIIHVILPKAADTSPGVSSAIISALGELASVEGEDMPVDVRGSFMKLILVNLQDQSSTLKRLASLKCLRKLCGRSGYVIQPYLDYPPLLGALIGILQSEQPTPIRREVLRTLGVLGALDPYTYLTTEEVSDDLQSSHNNAHGVPQISAAQYPSLENYAMVAVVTLIGILKDSSLSMHHSSVVQAVMHICSQMGSKSTVFLPQVVPTFLQVMQSLSASSAEFYFQQLTTLTSIIGPNIRDYVSDIFNLSKVFWESTTSLLLVILELIDAIAIALQDEFKFYLPQILSCMLKAFSLDNTSSRSVSYKVLQSFVIFGSNIEEYMHLVLPVIIRSFERDTIPLGFRKSALKCIAQLFQSVNFSDHASRIIHPLVRMLGKSNGDLRAVIMDTLCAIVSQLGYDYSIFIPMVNKVLVSHKISHPAYELLVSRLLKGEPLPKDVVVKEFKPRPSTKPFSTQDEVLTKLPVDQASLKAAWESSQKLTRDDWQDWIRRISIELLKESPSSALRSCSTLAGIYHPLARDLFNVSFLSCWDELTESNKKNLVKSIELAMNAPNISVEILQTLLNLAEYMEREDHTLPIPIKVISAHASKCNVYAKALHYTELQFVQETKEEVSISTIESLITINNHLQQSDAAVGMLQYTKEHKQFSLKETWYEKLHRWDDALAAYEHREREGDSSFEINIGKLRCYYALGDWDHLSELAQKAWVTSEQEHREAIAPLAAAAAWGLGQWNLISEYVSAMDRDPQDKEFFSAISAVHLGQYNKAYGHIERHRDILVNDLSSIIGESYNRAYGIMVKSQMLSELEEIIDYKKNMQYENNLDSLKKTWRKRLEGCQKNVDVWHNTLRFRALVLSPQDSPEMWIKLADLCRRSDRLKLSNQCLTYLMGRDPSNAYPLDSLKLLNPHVVYTYLKYLWATDQKNIAVSELEEFTSYLSSKHGYKMGDSSKLVDILASSSVSSEERSFLARCFHKLGKWKKSLQDSVNQESVRDILNCYFYATLFDKSWYKAWHSWALANFEVVGYYEQTEHGVTQDMYEQYIVPAIKGFFHSSVLNQKNSLQDILRLLNLWFKFGEHSDVAAAIVEGFSNVPMDTWLEVIPQLIARIHTSSSSVRASVHQLLSDIGRVHPQALVYSLTVSSKSTNPQQKHSAKSIMDSMLSHSDTLVRQALLVSQELIRVAILWHELWYEGLEEASQAYFSDHDISLMIDIVKPLHETLEKGPSTLSEISFAQTFGYDLRKARSYWQKFLQDGDPTELNQSWDLYYQVFRRIQKQLPRIKHLELQYVSPKLLDACDLELAVPGTYGHNKPVIRISHFHHTFEVISSKQRPRRLTIHGSDGKDYQYVLKGHEDLRQDERVMQLFGLCNTLLTTDSETFKRRLNIERYTVIPLSPNSGLLGWVPHSDTLHFLIKEFRSKRNILLNLEHRMMLQMAPDCDSLTLLQKLEVFEYVMANTDGYDLYHVLWLKSRSSEAWLDRRTSYTQSLAVMSMVGYILGLGDRHPSNLMMDRYSGKIIHIDFGDCFEVAMHREKFPEKIPFRLTRMLINAMEVSGIQGTYKITCELVMRVLRSNTESLMAVLEAFVYDPLINWRLMTKSSFGASTTLRPTSSSVEEKGRSYTHRARHADYAALSETNGVNAEGLNERSIQVLKRVSNKLTGKDFDLKEQLPVKAQVEKLIQQATAPENLCRCYVGWCSFW

SEQ ID NO: 13578 - protein, 1062 aa, Schizosaccharomyces pombe
MHNIQASSITLGDCLGKGAFGAVYRGLNIKNGETVAVKKVKLSKMLKSDLSVIKMEIDLLKNLDHPNIVKYRGSYQTNDSLCIILEYCENGSLRSICKNFGKIPENLVALYTFQVLQGLLYLHNQGVIHRDIKGANILTTKDGTIKLADFGVATKINALEDHSVVGSPYWMAPEVIELVGATTASDIWSVGCTVIELLDGNPPYYDLDPTSALFRMVKDEHPPLPSNISSAAKSFLMQCFQKDPNLRIKTRKLLKHPWVIMNQTSSKFSDAIDEVQKYNERVKESTLTAIIEPTSNRINPTLHSGRQSSYHMPESPKTPIAESPDHDNWDNEFQGTLKISDDVLKKSEHFMDFCSNFKGKNNSSSITSSPSKSRHAFNSDQISESNNFNASPLSTPLKAQFDPSKPALNRSIDHQKTPQHKRYLSTEFKENIPDGIEKFVETPRDSEFTDIFPTSSIKVQGLRKETGLGTLVLNKCYGSWNNEENEDGEESDIFDSIETNLENLDIENNIALDKRTHLASLLSSLLGSLRDKNIGSKDTTVSQIASILSEDLSLKREIIQAHGILPLLETLREIKTPDVQLLLLKLINTVAFDDHTTLQKVCFAGGLPLMLSFSNREHSFEFRYESAIFIQQMYRTSALTLQMFLSSNGLNSLLLFIKEDYGTNRDFVFVGVEGIWKLLRQQDYIPKNDICTMVVNDSLEPLTKAMLKALATDDDSSRMSLTRICEILLALSQADNYVKESLLCESALRRILRILLYLPHSDMAITLQFFKQLSMVPSSLSLLRKVHIIPLLTHILGDSKIEKGRKEIRSEALAALFNVCKLDKKSQEEAVISGAIPLLQEVIIKDRLFKEFALPILLALPQAGPVSRIYLWQNKCLDFFLSLLSDLNWQSAVFDTIASWLQFELREVQRVLAEKRNVQLVLKVFCISQSASSNRMLDTLGRVCQISPRLAASYGQPIIFQKFKEKLTHKGTKPIVVLNIFQIMKSMCEASSQSVAYIAHCGLPDVVANLNQTSDSVLVKELAKDLLKYLKVPQGPINEHKSPISKPHMPPPRWQPKQPLTQ

SEQ ID NO: 13579 - protein, 435 aa, Schizosaccharomyces pombe
MTDLRRNRYSISAGVGKSVLDSLGKFYGSPKRQLPNKFEAGKEYTGYNAPWIPFALDWLKQGKYSSEWIAMGSLNEEPNNMIQLLKLITGDDGNSHLEKAQAATDLEYPVTKLLWNPSSVGSNTDSQLLASTDQQLRLWKTDFEAGIDSPLLCQASLSTHVKTHNNAPLTSFDWCKTDPSYIVVSSLDTTCTVWDIVAQQSKTQLIAHDKEVYDVAFLKDSINVFVSVGADGSVRMFDLRSLDHSTIIYEGDSTFWKRNGDYTNASPPVSAPLLRLSACDSDVNLMATFHHNSSDVQMIDIRVPGTAYATLRGHKGDVNAVKWMPGSKSKLATCGDDCVVSLWDLDQPVNPSPAPTLSVSGTTPGMTGSTSEYVTPVSSVNSMRETASPLNADNQYSPLLSWKLEHEVNNLSWSVKNDGLAVVYGKSLEILKVPQ

SEQ ID NO: 13580 - protein, 294 aa, Schizosaccharomyces pombe
MPFIKAVKSSPYFSRYQTKYRRRREGKTDYYARKRLIAQAKNKYNAPKYRLVVRFSNRFVTCQIVSSRVNGDYVLAHAHSSELPRYGIKWGLANWTAAYATGLLVARRALAKVGLADKYEGVTEPEGEFELTEAIEDGPRPFKVFLDVGLKRTSTGSRVFGAMKGASDGGLFIPHSPNRFPGFDIETEELDDETLRKYIYGGHVAEYMEMLIDDDEERYQKQFSGLIADGIESDQLEDIYAEAYAKIREDPSFQKSGKDAAAFKAESLKYTQRKLTAEERKERFNAKVIEAGRA

SEQ ID NO: 13581 - protein, 182 aa, Schizosaccharomyces pombe
MASITRLDAVSPYLIRRFKNDLRALDAVKQSNCVYVGNLSFYTTEEQIYALFSKCGEIRRIIMGVDRFTKTPCGFCFVEYFENQDALDSLKYISRTSLDERIIRADLDHGYEEGRQYGRGASGGQVRDEMREEFDPGRGGYAKNRQPTSSRQLANYSGISSAPLGSSLELQSNPRYNRWKKN

SEQ ID NO: 13582 - protein, 618 aa, Schizosaccharomyces pombe
MSSIEEQITKSDSDFIISEDQSYLSKEKKADGSATINTADEQSSTDELQKSMSTGVLVNGDLYPSPTEEELATLPRVCGTIPWKAFIIIIVELCERFAYYGLTVPFQNYMQFGPKDATPGALNLGESGADGLSNFFTFWCYVTPVGAALIADQFLGRYNTIVCSAVIYFIGILILTCTAIPSVIDAGKSMGGFVVSLIIIGLGTGGIKSNVSPLMAEQLPKIPPYVKTKKNGSKVIVDPVVTTSRAYMIFYWSINVGSLSVLATTSLESTKGFVYAYLLPLCVFVIPLIILAVSKRFYKHTPPSGSIFVRVGQVFFLAAQNKFNLEKTKPSCTTTVGRVTLKDQWDDLFIDELKRALRACKTFLFYPIYWVCYGQMTNNLISQAGQMQTGNVSNDLFQAFDSIALIIFIPICDNIIYPLLRKYNIPFKPILRITLGFMFATASMIYAAVLQAKIYQRGPCYANFTDTCVSNDISVWIQIPAYVLIAFSEIFASITGLEFAFTKAPPSMKSIITALFLFTNAFGAILSICISSTAVNPKLTWMYTGIAVTAFIAGIMFWVCFHHYDAMEDEQNQLEFKRNDALTKKDVEKEVHDSYSMADESQYNLEKATAEEEIMKST

SEQ ID NO: 13583 - protein, 367 aa, Schizosaccharomyces pombe
MAGDSVKSAIIGIAGGPFSGKTQLCEQLLERLKSSAPSTFSKLIHLTSFLYPNSVDRYALSSYDIEAFKKVLSLISQGAEKICLPDGSCIKLPVDQNRIILIEGYYLLLPELLPYYTSKIFVYEDADTRLERCVLQRVKAEKGDLTKVLNDFVTLSKPAYDSSIHPTRENADIILPQKENIDTALLFVSQHLQDILAEMNKTSSSNTVKYDTQHETYMKLAHEMPLGKPYFNMPLLTMIKGIRHAELIAIEKILEHYPASVFKETTLYVTVEPCLMCAAALKQLHIKAVYFGCGNDRFGGCGSVFSINKDQSIDPSYPVYPGLFYSEAVMLMREFYVQENVKAPVPQSKKQRVLKREVKSLDLSRFK

SEQ ID NO: 13584 - protein, 607 aa, Schizosaccharomyces pombe
MARVKQKGKAGAARIYITRNQALKKLQLTLADFRRICILKGVYPREPKNKKKANKGSTAPVTFYYTKDIQYLLHEPIVQKFREYKVFARKLSKALGKGELETAKRLEARKPTYSLDHIIKERYPTFHDALKDIDDALSMLFLFSTMPVTDKIGAATVANCERLCAEFQHYVIRSNSLRKAFLSIKGIYYQAEIFGEQITWIVPYKFAQSVPTDVDFRIMHTFLEFYQALMGFVNFKLYNTLGLRYPPKIDVAKSESAAGLAAYELEESSSLPAIVHGNNKNARKNIATLKSKIRDIVNSDANVVEQSEKTTEDADEEPETEENLDEFKPADGADNEDSKSLVSHISSSNTSLFSNFTFFLSREVPRFSLEFVIRAFGGKVGWDPILGSGSPFSESDPVITHHICDRPHISQKYEGRIYIQPQWVYDSINKGILERTDLYACGATLPPHLSPFVKVGENDYDPEAELSAEENDDVSEALDDNISGEAVPISKKNDEPENVEQIDDAEEEDLEHQRELEAEAGGVAYSEYVKQNSKSAKKTKKRQRDTLTAEEKEEKEAKELSKMMMSNKQRKLYSKLKNENSKNENYNNALRNRKRDIEKRKKLKVEN

SEQ ID NO: 13585 - protein, 905 aa, Schizosaccharomyces pombe
MTNQIPSASSAADFGSSKSTSVDAVPNMDKSSSVRRKNIDSNGLQQTNQIEQAESSLNAEADHSEPERYGCTPSGKVFLLPKEQENRRSILETVDPRFSKTPWDWIVISSILAQVLLFFMTTGAVRRYSMMLCFFFWRISYDAGIGFLLHMQSNHRKVVTWISDFGFFDKENHPKLYDLTKKQLISKMDSSYNYDTSPLEFNSWLVFRHFVDLILMCDFCSYILMGLAWTCWPKVNIILQFLRIFGGIALIVFNYWVKMDAHRVVRDYAWYWGDFFFLLRSSLVFNGVFELAPHPMYSVGYAGYYGMSLLTGSYAVLFASILAHAAQFGFLLFVENPHIERTYGTDINHARLSPRGEDNEFELPPEHDLVGFVNFDFTRISDVALLIIALYSIFIILLSSNSHYSQFWAIFQAFVWRFLHSIIHAFILFYQSKSKAWTKHFIRNGESAAYAWSQWKGLYNLTLNMSYISFVMAAWKLYHLPSNWTYGLVSLRHALGFGLIALHIYTSVSIYEDLGQYGWFYGDFFLPSRSPKLVYQGIYRYVNNPERFLGCSAYWGLALISSSAWIFLIAILAQLSNLAIIRLVEQPHMQKVYGNTLRKEAGISKLIKQATSEKGNILPKTVETHMKALTTSVDKVLDQTAEALEEFVNTAPPKVQELLKGTESNLRKNAQLAILKLFAPQLSSSTHFDYKLEIKGIDNNQVLLGHPITVCWTASPNHEINDWIGLYKLSDNASDLYTQTSSEGRWSAIDANGYTSHCSSIKSLSNDKNSGEVEFSGDLLFWETGTFEFRYHYGGKHLVMAKTEPFVITATSMNTTDVDEVSAYLLKSIKFCDPNITPHDGDASLCDISEGSARKLTSIIKYSFGIDLSYRVVQVDGSCSALSRRIVNSLKILQSFDGPSGAKDD

SEQ ID NO: 13586 - protein, 423 aa, Schizosaccharomyces pombe
MKPNTTNLRNECWDTFSIPKRSQNIKINQSTKHQRSISDFVGTAGPGRQVGNWIIKKTIGAGSMGKVKLVVNILTGEKAALKMIPFTPNNTSQTVRVQREALLGRLLRHPNICRVIDCIRTPACTYILFEYVPGGQLLEYILARGKLDEDLARSFAMQLINALVYLHKNFIVHRDLKIENVLLTQDSRQVKLIDFGLSNFYSKDDLLRTYCGSLYFAAPELLDAKPYIGPEVDVWSLGVVIYVMVCGRVPFDDVSVPMLHSKIKSGKLEFPSYISEDCCSLIAAMLNVNPRKRCSLEQAAKFPWLKKNSFCLYLPIPLTSIPSTPSIRSHVFKPPFNLKVLQLLHEHGLASIPELKHELYMAYIERKTTSLVCLYLLGVESLAPALRIPTALPPVYSRHQRHHSEILGAMDLTEKITAMQCPP

SEQ ID NO: 13587 - protein, 376 aa, Schizosaccharomyces pombe
MEPNEGVQLFSAFPPPPPYYKLFTRENIEKVISNMEKEAKHEDDANTLQPKTEEEIESLAKLFKKPSCLTSGTYQMFGDTWRLDEAIPSLKEFGIPELYKDIKDGEDEIEVVEYDPKSNAIVGTSFTRVHDYDKNSPIENEKILEDDQHTAMKEKDNESDKTMKDVEEKTEPSLKKEEEDIQMKEPLDSQDTGAVSASSVNEGFRADQKSKDGETSDLIKIPRRAYELRFLSRSLMLNFLELLGIMAKAPEQFPSKVENIRVLLLNLHHLINDYRPHQSRESLIMLLEKQLKHEESQVELLRTHNRQMTETLEKYKSLDFNMEKEGDVIQQLKSSIKKPLSGAEDEQKSRSMFSKNDEKLKKSLELMEDVIKRDLS

SEQ ID NO: 13588 - protein, 159 aa, Schizosaccharomyces pombe
MSTLDLNHLADLYDRKDWNACKKELLKLKVELAKQNLFVPTSDKEKASFARNVFEYGVLVSIQTCDIESFARYASQVIPFYHDSLVPSSRMGLVTGLNLLYLLSENRIAEFHTALESVPDKSLFERDPYVEWVISLEQNVMEGAFDKVASMIRSCNFPE

SEQ ID NO: 13589 - protein, 378 aa, Schizosaccharomyces pombe
MSFEGKTITCKAAVAWGAKEPLSIEDIQVAPPKAHEVRVKVDWSAVCHTDAYTLSGVDPEGAFPIVLGHEGAGIVESIGEGVINVRPGDHVILLYTPECKECKFCRSGKTNLCSKIRETQGRGLMPDGTSRFSCRDKTLLHYMGCSSFSQYTVVADISLVAISHSAPLRSICLLGCGVTTGFGAVTHSAKVESGSTVAVVGCGCVGLAAMQGAVAAGASRIIAIDINADKEVYAKKFGATDFIDSSKVKDLVQYVIDVTDGGVDYAFDCTGNVTVMQQELQFCHKGWGKLCVIGVAAAGKTLDFRPFLVVTGRQVLGSAFGGVKGRSELPNFVDEYMQGHFKVDEYITNEEPLKNINKAFDHMHEGKCIRCVVDMNKP

SEQ ID NO: 13590 - protein, 325 aa, Schizosaccharomyces pombe
MSIKEFAKNAREAYFTLPNGDKIPSIGLGTWRSGKDETKNAVCAALKAGYRHIDTAHIYGNEKEIGEGIRESGVPRTDIWVTSKLWCNAHRAGLVPLALEKTLQDLNLEYIDAYLIHWPFALLSGPEELPRNEKGELIYEDVPIEETWQAMEELLETGKVRYIGISNFNNEYLDRVLKIAKVKPTIHQMELHPYLPQTEYLEKHKKLQIHVSAYSPLANQNDAYNSDISKLIEHKTLVDIANARGEGITPANIAISWAVKRGTSVLPKSVNESRIVSNFLYIPLTDKEMEAINNIGVVRRFSHGKFAPKPMFVGLQDGTPKQTHA

SEQ ID NO: 13591 - protein, 473 aa, Camellia sinensis
MALSAHLIYLSNDGSIGLCARRQLTCERLRRRVADPCCVVNVKMQPNRRIPKYFGLLRSYRMPCGLESKYSNLLSCGSMKISSVCENSTSIPEEKGIFEFQMEVIMSVLKSQLIRVAAVMACIFLVIPAADAVDALKTCSRLLKECGVELAKCIANPSCAANVACLQACNNRPDETECQIKCGDLFENSVVDEFNECAVSRKKCVPQKSDVGEFPVPHPNVLVRNFNMKDFSGKWFITSGLNPTFDAFDCQLHEFHMESNKLLGNSTWRIRTPDGGFFTRSAVQRFVQDPTQPAILYNHDNEYLHYQDDWYILSSKIENKPDDYVFVYYRGRNDAWDGYGGAVVYTRSAVLPNSIIPELEKAAQSVGRDFSKFIRTDNSCGPEPPLVERLEKTVEEGERTIIREVEEIEGEVEKTEMNLFGRLLEGFKELQQDEENFLRELSKEEMDILSELKMEASEVEKLFGQALPLRKLR

SEQ ID NO: 13592 - protein, 455 aa, Schizosaccharomyces pombe
MGRPLTEVKYLLINSAPVILGYALQNSLQTSSVIVTGRLGPSELSVAAFAYMFAMSTGWLIALGGTTAFDTLGSNLWGAGKKQELGILLQTGFIVLSILYLPICLVWWYSKPILIFLHQTPELAEASQKFLRYLIPGGLGYVCFELLKKFLQTQEITRAGSYILLVTSPLNVALNFLLVHYYGLGLKGAPLATGLSYWLSFILLTQYAKYVKGAEAWNGWNKRCLENFGPFVKLSLLGIVMVGTEWWAFEIVALVAGKLGAVPLAAQSVIMTTDQLLNTIPFGLGIITSNRVAYYLGAGLPDNASLTAKVAAIVGVAVGSVIMITMIAVRNIYGRIFTNDPDVIQLVALVMPLVAAFQISDSLNGTMGGALRGTGRQKVGAIVNITAYYLFALPLGIYLAFHGKGLVGLWIGQVIALSIVGILELKIVMATDWISQSRKAISRFGDSSELTALLN

SEQ ID NO: 13593 - protein, 349 aa, Schizosaccharomyces pombe
MAEFIRTQIFGTCFEITTRYSDLQPIGMGAFGLVCSAKDQLTGMNVAVKKIMKPFSTPVLAKRTYRELKLLKHLRHENIISLSDIFISPFEDIYFVTELLGTDLHRLLTSRPLETQFIQYFLYQILRGLKFVHSAGVIHRDLKPSNILINENCDLKICDFGLARIQDPQMTGYVSTRYYRAPEIMLTWQKYNVEVDIWSAGCIFAEMIEGKPLFPGRDHVNQFSIITELLGTPPMEVIETICSKNTLRFVQSLPQKEKVPFAEKFKNADPDAIDLLEKMLVFDPRKRISAADALAHNYLAPYHDPTDEPVADEVFDWSFQDNDLPVETWKVMMYSEVLSFHNMDNELQS

SEQ ID NO: 13594 - protein, 118 aa, Schizosaccharomyces pombe
MFRAGFKRFWNHPAGPKTVHFWAPAMKWTLVLSGIGDYARSPEYLSIRQYAALCATGAIWTRWSLIVRPKNYFNATVNFFLAIVGAVQVSRILVYQRQQKRITAQSEQRTELARSLAA

SEQ ID NO: 13595 - protein, 607 aa, Schizosaccharomyces pombe
MNRVNDMSPVEGDLGLQLSSEADKKFDAYMKRHGLFEPGNLSNNDKERNLEDQFNSMKLSPVASSKENYPDNHMHSKHISKLPIASPIPRGLDRSGELSYKDNNHWSDRSSTGSPRWENGSMNLSVEEMEKVVQPKVKRMATICQMFFLDHYFEQLHYLYTRKQRARLFEEQLLKEPDSRRDELVKRYNGRERVYLRKRRTRISHGDFQTITQVGQGGYGSVWLARKRDTKEIVALKIMNKSVLHKMDEIRHVLTERDILTTANSEWLVRLLYAFQDTSNIYLAMEFVPGGDFRTLLSNSGVLRDHHAKFYATEMFLAIDALHQLGYIHRDLKPENFLVGASGHIKLTDFGLSSGIISKKKIESMKIRLQEVNNVVVPERSMRERRQVFRTLLSQDPVYAHSVVGSPDYMAPEVLRGENYNHSVDYWSLGCIMYECLSGFPPFSGSNVNETWSNLKNWRKCFQRPHYDDPRDLEFNWRDDAWDFVCHCITDPKDRFCSLKQVMQHPYFSKIDWKNVRTAYRPPFVPDLNSEIDAGYFDDFTNENDMSKYKEVHEKQAAIANMVNTFNKPKRNAFIGFTFRHQKNSHPTSSSSALSSPLSAPSFGTLL

SEQ ID NO: 13596 - protein, 608 aa, Schizosaccharomyces pombe
MDKVQHVILVLSGKGGVGKSSVTTQLALSLHDSKVYSRPLKTGILDIDLTGPSIPRMFGKDAERNRIHQSSAGWVPVYTDETKEIGLMSLGFLLTSKNDSVVWRGPKKAAMIRQFISDVSWGELDFLIIDTPPGTGDEHLTIVESLLSETSTVRDVPIDGAVIVTTPQGIATLDVQKEIDFCKKASIKILGIVENMSGYICPHCADCTNIFSSGGGLTLSEKYKLPFLGSVPIDPKFGEMIENLTPDSNIVHLYSKTEMSKKFSFITNEFLNQLYGPRKLDTITTISGHTGRLWSVAAHPMLPLFATSSQDKSVRIYNSNTYNLVHVIDGFHTRSIRRVAWRPIERPVLAVASFDSVVSINEKIDDDWECTAALEGHENEVKCIAWSCNGNYLATCSRDKSVWIWEATEDDEFDCLAVLQEHTQDVKVVTWHPTEDLLVSGSYDNSICFWRDDGDDWALTCQLQGHTNTVWALAFSPNGNTLASADNDGNVFLWIKISSNEDVATIDSTNILRPALQEEWKQQTSLPHIHKGAVYTISWMNDATLCSAGGDGKIVVYQREKHDEALWHVAYEQDHAHGVYEINSLEYLRDDRLLSGGDDGECRVWSFK

SEQ ID NO: 13597 - protein, 871 aa, Schizosaccharomyces pombe
MSDSSSSSTSAFVSSLVFNFAIFCAFIGLFLCLRPREKHVYQPRCIIDTQPKEEKPEPSPSSPFGLFAYVVKRSETYLIQYAGVDGYFFIRYLFTFGALCILGCLVLFPILLPVNATNGVGEKGFDILSFSNVKNHNRFYAHVFLSWLFFGFTIFIIYRELRYYVIFRHAMQSSGLYNNLPSSSTMLLTELPNSVLNDEETLHELFPNASEFTCVRDLKKLEKKVKKRSDLGNKYESTLNSLINKSVKKHNKLVKKHKPLPSTLDYTAYVKKRPTHRLKFLIGKKVDTIDYCRDTIAELDEVVDKLQTSLEERKKVGSVFIRFRSQTDLQTAYQAFLYSKKFRKYRFGRALVGIAPEDIVWSNLDLSMYTRRGKKTISNTILTLMIIFWAFPVAVVGCISNVNYLIEKVHFLKFIDHMPPKLLGIITGILPSVALSILMSLVPPFIKFLGKFGGALTVQEIENYCQNWYYAFQVVQVFLVTTMTSAATSAVVQVIKEPASSMTLLASNLPKASNFYISYFLLQGLSIPGGALLQIVTLLLSKVLGRIFDNTPRKKWNRWNQLSAPSWGTVYPVYSLLVTIMICYSIIAPIIIGFAAVAFVLIYFAYSYNLIYVLGHNADAKGRNYPRALFQVFVGLYLAEVCLIGLFVLAKNWGATVLEAVFLGFTVACHLYFKYKFLPLMDAVPISAIESVSERPEIKYPMDLGTSEMKNVGRAYPEILEKLSSSSGSDEFLETSSRTSENTKEKIDKDDEGFAITNISSVHKMPSFVLSYFSDLAASNRILTGFDRVLQLLPSFYDIPVRVRNVQYVSPALKATPPSVWIPKDPLGLSTYAIEDARGKVDIFDDNTTFNEKGNLQYTGPPPDYDEAIRS

SEQ ID NO: 13598 - protein, 796 aa, Schizosaccharomyces pombe
MVFSTVILEKIRDSSLKTDPSSDLRTQFWLAFLLGASACVFFCFFRKRWKVLYAPRTTIEGLNLPTLSSSYYKWLMDLVNIPDDVVQNCAGLDGYVFLLFFKMGIKFLSFASLLGVLIIMPVNKHFRGDAFGNITLSMPAKSEYFFSSPLVKKSIVQSPIIANGSELNVGVLGPSLFNPIGNLSDIPGLPQPGDGFLYLYVLFTYFISIFLLYVLFSSTKSIADIRQSYLARQNRLTDRTVFISGLPNELCSTENLKAYFDKLDVGSIDSLSICRNYSYMDILLSKKSKYVKKLEKYWSIYLSNCKKLGISTLPPSNYLSPNRAELESTPEQLLEVPWQHHQCHPLIKTHFFGIFGQKIDAIDFYSAKLYKISQQIENARSFDYPTTGQAFITFESMATAQIVAQTHIDSKSLMGLHIELAPAANDIQWHNTYIGRWHKFFQGWFITLVTFMIILLWTVPVGAIAVFINLDTIRRLWPELGRMIEDLPFLNSLLRTFLPTLVYSLFISISPFLFRWLSSMQGLSSRAEEEIYAVGKNYAYLFVNFFLVYVIAGSTSIWELAKDTTSFAHFLANRLPHQAQFFIDLIVLQGIGMFPLKLIQLGKLSSYFVRRSFVPYSIASKKFETPDSFSVGIFLPQPMFIMLICLCYSIISPLILVFGLIYFIIGFLVYKYELIYQMEHPQHSTGELWSTIFLRMIFGCVIMQLTMMGLMSLRKAYWLSTVIFPLLCFTVISAYNFSTMIRSSMQFVSLYYIRTHQSNTLSSESESRNSESSGSYVHPGFDLSNEELPLIDLNTA

SEQ ID NO: 13599 - protein, 300 aa, Schizosaccharomyces pombe
MDYLLNYADQYALDSIYNAVYPLARDNIVRQSISLFFLTWFGGMFLYLTFASLSYQFVFDKSLMDHPKFLKNQVFMEVLTALQNLPGMALLTVPWFLAELHGYSYLYDNISDYGLKYFLCSLPLFVMFSDFGIYWAHRFLHHRYVYPRLHKLHHKWIICTPYASHAFKSADGFLQSLPYHLFPFFFPLHKLTYLALFTFVNFWSIMIHDGKYISNNPIINGAAHHNGHHIYFNYNYGQFTTLFDRLGNSFRAPDEAWFDKDLRQNEDVLRVELMEYEAIRNEVEGDDDREYIANSAKKNH

SEQ ID NO: 13600 - protein, 261 aa, Schizosaccharomyces pombe
MVAPAHNYESRNILDLLSLKGKNAVVFGGARGIGHAICSVFAEAGANAFIVYNTTPGEKAAKEIAQANGVKTYTCKCDVTIPKEVEHAFAEIQKVFDTIDIVVPNNGICTGKSAIDMTYEEFANEINVNLLGVFNVAHNAGPIFQKQGHGSLVATASMSGVVVNVPQQQCAYNTSKAGVIQLIKSLAVEWRKFARVNCVSPGYTTSDMTGGKFHKEWEPYTPFERNGLAKEIASAYLYLASDAASYASGTNLIVDGGYTSI

SEQ ID NO: 13601 - protein, 246 aa, Schizosaccharomyces pombe
MAAKHVKYMACLFDMDGLLVDSETIYTKTTNLILDRYGKDPLPISVKAQMMGRPGSAAAKVVIDWSNIPMTPQQFVDEQQVIRAKFWSSLKPMPGAESLINNLSNHGIDIGVCTHPYAIIKTAHLKHIFEKFGKNVITGDNPSIAPGRGKPFPDIWLKVLNLINESRKQRGLKALTPSQCIAFEDSIPGVKSAKAAGMHVIWVPDAAIKNLVGDQLNEIVDSQCETLPSLSEFDINKYLNINSKQA

SEQ ID NO: 13602 - protein, 775 aa, Schizosaccharomyces pombe
MSTISEVGPWELGLSLGSGGPNSSRLAKHRETGQLAVVKPIVGWSELTSSQQARIEGELVLLRLIEHPNVLQLIDVISAQEQLFVVVEYMPGGELFDCMLRKGSFTEQDTAKFLWQILCGLEYCHKLHICHRDLKPENLYLDAHGSIKIGEFGMASIQQPGKLLQTSCGSPHYASPEIIMGRSYDGCASDIWSCGIIFFALLTGKLPFDDDNIRSLLLKVCQGQFEMPSNISPQAQHLLYRMLDVDSSTRITMEQIREHPFLSCFVHPNISIPIISAPIQPIDPLIVQHLSLVFRCSDDPMPLYEKLASQSPLVEKTLYTLLSRHLHPPSSAAVDRNRAVVDDLLGTAASNGQQMDEEEIEQAINIPTLAPYPISYAAESVPRPATSASPFLTPVTTSGTFNYSFNATNPQSILQRPATTSSAVPQLPKSVTPGLAYPHDSSMLSSNYRPPSALSPRNFNVSINDPEVQLSRRATSLDMSNDFRMNENDPSIVGNLAASNFPTGMGPPRKRVTSRMSEHTGNRVVSFPRGSAFNPRVTRFNVGNEQFSNNIDNNNYNQPYANATMNNSRRLRTPSGERSMRADLSQSPASYDSLNVPKHRRRQSLFSPSSTKKKLSGSPFQPKRSFLRRLFSSEPSCKCVYASLVASELEHEILEVLRRWQLLGIGIADIIYDSVSASISARIKRQNSLNLKPVRFRISVLAEFFGSQAVFVLESGSSTTFDHLATEFQLIFEDKGFLDNLELSYFQASASRPVSRMSVSSSPFAVFRQRQSVQS

SEQ ID NO: 13603 - protein, 108 aa, Schizosaccharomyces pombe
MPRAAKSSRKKDPNTPKRNMSAFMFFSIENREKMKTDNPDATFGQLGSLLGKRWKELTSTEREPYEEKARQDKERYERERKEYDTKLANGEKTGKASAPAAAAAAKEE

SEQ ID NO: 13604 - protein, 557 aa, Schizosaccharomyces pombe
MDFNNIPLATIKSSDDKGKDFIVEMTTRPSETKKKVPFSEDMREIPSLPNEEEANATDPQANEVADENGEGFEAEKISSWIWVLSAVAGISGLLFGYDTGVISGALAVLGSDLGHVLSSGQKELITSATSFAALISATTSGWLADWVGRKRLLLCADAIFVIGSVIMAASRNVAMMVVGRFIVGYGIGLTSLIVPMYITELAPARLRGRLVIIYVVFITGGQLIAYSLNAAFEHVHQGWRIMFGIGAAPALGQLISLFWTPESPRYLLRHNHVEKVYKILSRIHPEAKPAEIAYKVSLIQEGVKVDFPEGNKFQHFFHSLKVLFTVPSNRRSLFIGCFLQWFQQFSGTNAIQYFSAIIFQSVGFKNSISVSIVVGATNFVFTIVAFMFIDRIGRRRILLCTSAVMIAGLALCAIAYHFLPADTTQNTNSGWQYVVLASIIIFLASYASGIGNIPWQQAELFPMEVRALGAGFSTAINWVGNLIISASFLTMMESITPTGTFALFAGFCFVGLVTSYFTYPELAGMSIENIHKLLEKGFWQAVKESTKRVRKGRIDEA

SEQ ID NO: 13605 - protein, 372 aa, Schizosaccharomyces pombe
MSYYQIIVCILASISYIILLEVIALDLGVLDNIFIPKRFAASTDVAIQLPDRNVTLWSRQAVFGKHFTNASATTVINLYLPSNFQEDMSGCPNRNDTDASYFYENDIIDYDIEYIEQKSYSSKPSARVQKDDGGESKDEAILDFLLVQRGKCTYFDKALEAQRLGFKGVIVGDNRSPSSFRLHYMVAPDKVDESKVHIPSLFVSTSSYNLLWSDLLHSYRQPLKLYAKPEELGDMFWPFLLCFSPSIIMLITVQALAIRKFIRTYRTKSKTRRFIEDLPSRTISREGFYSEEEEIENSTQNGELVPLMDESTRRATFGVECVICLESFTKGDKVVALPCKHEFHRPCIAKWIVDYRHACPTCNTEVPPPKPF

SEQ ID NO: 13606 - protein, 308 aa, Schizosaccharomyces pombe
MLMLDGGSTAILPKLPESISESRLWTSEALVRYPEIVVKHHEEFLKVCDIISTFTYQLDASIYDEKVEGVPLKQVYANSIGLPVYAREHLGLPNKYIALCLGSHAATIPGCMEYKMIYDKPTDFEMLYNFHKNRIEAIQASNPKAFEKIDFIAFESLPHVTEAEVVCQLIQDMKGWSKRCWITCTCPERSTIERVSSIISKILSINHDSIWGIGVNCFHLSLLEPIAKMLSSLLPSNITAILYPDGRGLYQNPDGTFSPGSTDHPAPSPEEWSTITAKYSNLHNGNLILGGCCETNYNHLSLLREKTK

SEQ ID NO: 13607 - protein, 1072 aa, Schizosaccharomyces pombe
MKSLKGRLLFLRKFVFFSLLILLFAHGASSSSSSFNYFDKRTNGKANNELALFSPTADSPSSVDGVLELPSAENVFAESSLYNAFIVATVDGSLHSYDRITGQELWSLFTNANPGLSYTKDENSLLSSKFLSQSNFKSYNSTHGEFYSDSTLNISYLSDDDTVWFVEPIDGGILYAFNLQTGLVRLPHSIKDLVHASPIRLLNNNVFVGSKNTTLFTIDVSNGDIVSQYPSGHRYETHHSVHNLGTKRDSVPSGADSDLSFKDPSGKKLSESLDLLDDFNYQVTVSNKSFVDIARTEYFITIYSDSNVILDLVYIDWTPTKNEIMYESFHSSSFDSKLALSSYDSSLHIVDTHSKFIKQNIPLMSPAATVFDIVTLPHNKKIDKSQTPAKFPTSVLLRQPIDTYLETMFPQIARNKTEHVYINHIGNAWFAMSERHYPLVSLAPEASFLYYNGFYIPLNSIFGLHSLMATPKPFFALPGLPGYDIPSYVESEGSTKTLPSIGKKPIPLLDPNPISSTPISITFWVIMFLSVSFTIVTFFSILRIRSSEVRPLKSQKNTVSINNKIDTSKRRRKGKRRKRVSDEHSASSNFNEIESQASFEQNQTLDILSENIVEIQDKSTDPLQKSLDSSLKSHLPEATVIQNTDGSVTVNSLTVYPEVIGYGSHGTIVYRGVYEDREVAVKRVLMEFYDLASREITLLQQSDNHPNIVRYYCKQKSDQFLYIVIELCKCNLSDLIEKPIAYDDLFKSIDLVSLLYQIAFGVSHLHSLDLVHRDLKPQNILLVVNNSPNLSKTRVRALISDFGLSKKLDFNQSSLRNTTFEAAGSYGWRSPEILSGSLSQQSKEIQVKTREGRIRQASHATDIFALGCIFYYTLTGGMHPFGSHYDCEGNILKGNYCLVHLQSLGECGVLAADLIEDMIAFEPSKRPTIEVVLNHPLFWDYAKKLDFLIDVSDRFEVEERDPPSPLLQMLENNSKSVIGENWTTCLHSSLVDNLGKYRKYDGSKILDILRVLRNKRHHYQDLPESVRRVLGDLPDGFTSYFVEKFPMLLLHCYHLVKDVLYEESQFKRYLEY

SEQ ID NO: 13608 - protein, 107 aa, Schizosaccharomyces pombe
MEDEMQIDKKEVEIEQKPPRFEIKKWNAVALWQWDIVVDNCAICRNHIMDLCIECQANTDSAAAQECTVAWGTCNHAFHFHCISRWLNTRNVCPLDNREWEFQRYGH

SEQ ID NO: 13609 - protein, 532 aa, Schizosaccharomyces pombe
MQTPSSASAESEKDSGNTYVGPWLLGRTLGQGNLAKVKLGKHFQTNEKVALKMVYNDELEDKDTWKRLQREVTILRQLHHPNIITLYQVFRVPKYTVLALEYMDTDLHSMVVKHNRLDECTTRKIFRQIVHAIDYCHLHRVAHRDLKLENILLNKDLVVKLTDFGLSNFMLDGSFLSTSCGTPHYAAPEVIQGRYYDGCDVDVWGCGILLYLMLVGEFPFEDVTISNVLSRVCKGIYTIPSFVSSSASDLIRQMLMVLPTSRIKVAEIMQHPWFIADLPTHSRLPSRTSSFSSKHRSVTFSPPDLAILFDPSITSPSSSVGQIPQPTDHSALSPSKPMSISGTESPNPDPASLCYSSYEDLYSATSWHSDMAESSGFLDPTDIPPIPSNVETLRSSLPQRHASFMNKVYNHPLSRPPAPNRLRSLRWHYGIQTAKNPIEVLRKLCEALLELGARFRPCDEESFLKENKYKVFSCITCHNSPVYLVIELFSIGPSASVIDIRFSSSDDSIKYTSSYSPMPFLEVVKQLILKIA

SEQ ID NO: 13610 - protein, 94 aa, Schizosaccharomyces pombe
MKVKILRYHAIANWTWDTPKDDVCGICRVPFDGCCPQCTSPGDNCPIVWGKCKHIFHAHCIQNWLATSGSQGQCPMDRQTFVVADSTNEKSETQ

SEQ ID NO: 13611 - protein, 335 aa, Schizosaccharomyces pombe
MQQTYKPNTSALKDGAPKATVDQKQLLPCKYRVGRVLGGGTYATVREAVHIETNKMYAAKIMNKKMMEKKQDFVKNEIAILKRVSYEHPNILHLVDFFETVNNLYLITELATGGELFDRICAKGSFYEADAAALMRTTTSAVKYLHDNGIVHRDLKPENLLYRSKDPNSDLLIADFGLSHFYEDSQYYMLMTACGTPEYMAPEVFRRTGYGKPVDMWAIGVITYFLLSGYTPFARPSQVEVIEAILANEYTFNDPCWSGISETAKDFIKKCLENDPSKRLTAADALKHPFLSEKRPATSNLLPNVRENFNARKTFRTAYNAVRAFNTWKKLENKH

SEQ ID NO: 13612 - protein, 1401 aa, Schizosaccharomyces pombe
MGLEHTFYPAEDRFEPLLEHSEPVNFVPKENAKSYVRQGFASPHQSLMDNLVDSTESTKRSENFVSHIPLTPSHSGQSEKLMSTRTSHSPYISPTMSYTNHSPANLTRNSSFNHQHYSTTLRSPPSMRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLRLAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHDDSKAETDSLAASYKEESALPVASNVGLRQPNELRIDSINLPPAIVTPDTINYSVD

SEQ ID NO: 13613 - protein, 1191 aa, Schizosaccharomyces pombe
MASRQGFSNVNEDEPELPPSVLSLKSKFESLSTGDLTNLDEKTAKRRTVKGCKNGTSEPNVFKARPIPPPRQVSSTIGSSTGRKVSGSIQRLASNFKNPSNPHADVSKIDRLPSDSSESHVATPSSPTISNSFVSVSPLLKRPQQKGPEISFQSSVQSTKGNDLMKHDDTNNHQIPPPKPNFSSKAGSSSPISVSPLKNVKAYISQSPTHSEASSVLSSEEEEENVINSSKSVPSFDLHDPFSQTFGKECPISTAPPVLNIGDRSLETPPPIPSPRPPQPVAVEAIQQSRAVISQQLPLHVSPRKPPKPPLRKVSTQRSSSPIENLATKSDASLVTGLQSSPYTHIAPASEMSLIPEKPRLPPRPSHTLSELSSPALTSENLSSKPSPLFPPPPPRVKSLATNKPVSMPVSTEQSDPSVAASSSSSSQLDVVLKGSIPDTSSVRRNPPCFVNGVESINVDFEARIFDVSGDRLVLAGNGGLRVYDTVTGLCHWHMPLGDTKVTSLSFKSSPENYSDDGRFVWFGTRDGMLWEVDVQNHHIVTKKSVSNCPITYVMVYKNEMWTLDDMGKLYVWQEDEIMGLSIQSTPHSIRTIPHATHAMVLDNRLLWVVVGKSIYVYDPSTSENESASVLAKPMTPPGLIGDISCGTTISNFTDLVFYGHVDGKISIFSKTQYRFLELITSSSFYRICSLVGVGNTLWAAYTTGMIYVFDVSESPWRLLKSWHGHKASHNGATTILGIDVNSVWKAKRLQVVSMASSVVKFWDGLMMGDWLATEMRSRFPEYSNFTDVSILICSWNAGASKPSDLDSDTIGASMIPMMIRDNGYPDIVVFGFQELVDLENKRLTARSILSKSSSKGGSSNSANISSQYRLWREKLESEMMRVSSNDDYQVLVCENLVGLFSCVFVKNKLQSKIRMLQSTTVKTGLGGLHGNKGAIVVRFLVDDTSYCIVNCHLAAGQSNKAARNNDLATILDNASLFPENDETDQLNTFVGGGDGSLIMDHEVCVLHGDLNYRINTLRPKALDLIKKNDIKTLLQSDQLLVERKRNAGFRLRTFTEPEITFAPTYKYDVHSEQYDSSEKKRVPAWCDRICYRGSPDYISAENYTRYELKASDHRPVSALIHSKAKMVNAQSQGSTWDVVKRKWIEYADEFKRKAKITYVMNYTSVSYQTAEQYLSGNNWNVQNALKQVSS

SEQ ID NO: 13614 - protein, 293 aa, Schizosaccharomyces pombe
MDSADIRSAKAALEKAIQGKNIETIINIMTRLKNEVVATEELLKETRLGLVVGKLRSHPNEKVGEQAREIVKKWKADVSKGRPLKTTTTTSSTPSKHADVGSQAQKQVQKQSSSGQRTFKSDNVNVNVTDDKIRNNCIGLMYNALVIDSDESSSLIIAKAKEIDAQVLARAAGKTGSEYRNRMRSLYMNLKDKNNPKLRASVLRNEITPQRLSTMTSAELASEDRRKEDAKLEQENLFHAQGAKPQKAVTDLFTCGKCKQKKVSYYQMQTRSADEPMTTFCECTVCGNRWKFS

SEQ ID NO: 13615 - protein, 116 aa, Schizosaccharomyces pombe
MSADGLDYTNLLPIANVARIMKSALPENAKISKEAKDCVQDCVSEFISFVTGEASEQCTQEKRKTITGEDVLLALNTLGFENYAEVLKISLTKYREQQARSASMKETKQSRSEEPQ

SEQ ID NO: 13616 - protein, 332 aa, Schizosaccharomyces pombe
MNQTEAAPVVSVSRVYAHVNEEMPREYWDYENMQEVFGYQDNYEIIRKVGRGKYSEVFEGLNVLNNSKCIIKVLKPVKYKKIKREIKILQNLAGGPNIISLLDIVRDPESKTPSLIFEFVDNIDFRTLYPTLSDYDIRYYSYELLKALDFCHSRGIMHRDVKPHNVMIDHKKRKLRLIDWGLAEFYHAGMEYNVRVASRYFKGPELLVDFREYDYSLDIWSFGVMFAALIFKKDTFFRGRDNYDQLVKIAKVLGTDELFAYVQKYQIVLDRQYDNILGQYPKRDWYSFVNRDNRSLANDEAIDLLNRLLRYDHQERLTCQEAMAHPYFQVLK

SEQ ID NO: 13617 - protein, 2670 aa, Schizosaccharomyces pombe
MSVEEPGIEAHGHKDRMLYAMLLSKDTSLAFLGSKKIMIDILQHICRTQDIDEESAIAALEDIFETLPRNLSRDARKQIEITINHLVSRLPSIVLPFLVRRLTTIAGRLDRFRSTVSVSFDCLNWVNSMIPNLPEKELQYWILELLPLQSSFLSYALRDGKPSVADSAIKSTRRCYRSLFCKKMDSLKKLVSFLLTETENAILPPKSLPLYGVIISTCYYFHQSPNPRNEISQQAELFSKIMAQNVLMAKPALEKYLYHEFCYSLGLLLSVDQLKLYLLPSIEKALLRSPEIIFSGILSSLAHGFADSKVDASSLILSSVLTSFVNGLKSSNAEVRRNCFQTFKDLSANASDNESLSRVASELITSLRTGKVTASDQRVLFVDALSSLSLKHIDASMLLNELLPLFTKAKESDFNSLASLIVKTLKFLLMNGRNPGDKIYDFLSKSLQRPVAHESMFWLTSLATMAWDLPASDDVQIEFINFFLNNLSILTEKALMSVSGATQNGTYLAPIIYLSFGVNKLSVWNSERISHTLELQDILVKLSTPKNNDVFIFSSKITNKLNDDQSKLWYFQGLCDFAKVSDNLLFSNFVERWFQSVIGVFSFASRENSNRALKILKSAILYRPHLRMSICSQLWNYHADFEKSKSVGKFDSAKYDEISSLFQSLILSSMSADTSNFSNQELVDFDKYLVELLFLSFAFKDKFDWIRFCQVSKRDPATLVSERIHSIIEEIELLLSSAIKDSKETAAIASISMIVFVAPEESIPLFVNVFRNQLLHLNISSVSSTDLEIWKTPEGVLWDNVLEKKSSKKLDKNTKDYETKRWEAEVRAKQSAKKPAKLSKDQQALVDAQLDAEAKIRSRVNLIALSLERGLGIIRSLGEAVQLAPALWVEDAIDVLLFHNVLKYSEPFLKNLAYDTFLLTLKASGFSERLGDRSYSSSLASILAHTFSVNSSENIKELTKSILYKLRFAIEQNYFEPQMFACIFPLLYDLTFNITNSDEEDEAELQLLVTEILEFQALYSASLRRMRSKLIKSLLHLLEIAPTQYQENKNSLLSLCEGLHSTYTDEELNLLLSNLFHPESSIRSAVLQALQAFDLSRFEFIKEIFLELYDDNETNASIAHQISTQNGLDATETSFFELQIFFTQDSDYLQQIIGKSLIDLLDEFEELGQFIPKELMRTYRENALPSAPEYDEYGIIKKETIGRDLGRIARESVAVSFFHISKYLSSNLLLPFLEFLLTASEAEAQIPVTDASQKVSSKMLEAGKLAIFQSGAHQVEALMELFEQKLNVDSLPTDANDRLREATVVLFGTVAQHLPSNDPRLAVVMDSLLSVLSTPSESVQLAVAVCLPPLVKKSLGKSKEYYELLSNKLMNSTSLADQKGAAYGLAGLVKGYGIKAFQDFNILDSLSELISNRQNATHRQVALFAVEAFSRILGIYFEPYLPDLLPLLLTSFGDNANEVREATMDAVKQIMSQLSAFGVKLLLPTLLDGLNEYNWRSKKASVEILGLMSYMAPKQLSVFLPTIIPKLSEVLTDSHSQVRNTANKSLLRFGDVISNPEIQTLVPTLLKALSDCTRYTDDALEALLKTSFVHYLDPPSLALVIPILKYGLRERNAGTKRQSAKIFGLMASLTEPENLAVYLESLMPRLREVLIDPVPDTRATAAKALGSLIEKLGEKKFPTLIPELFNVLRSECSEVDRQGAAQGLSEILAGLGLARLEDVLPEILKNTSSPVPHIRESFISLLIYLPATFGSRFQPYLARAIPPILSGLADDSELVQTASLRAAKMIVNNYATKSVDLLLPELEKGLFDNAWRIRLSSVQLVGDLVFKLAGINRKALQEDEEEEGTHSDVSRKALLDIIGQERHDRILSTLYIVRQDIAAVVRTPAIQIWKAIVVNTPRTVREILPTLTSIIVSNLNSSSNDRRTMCVKSLGDLLKKAGFDVLPQLLPVLKQGLESANSGDRIGVCIALEELINSATPEQLEIYSDDFVYAVRRALMDGDLEVRETAAEAFDSLQSILGDRAVDDVLPQLLKLLESENQSEQALSALREIISRRSSTIFPVLIPTLIKKPVSAFNARALSSLAQVAGVTLNKRLPSILNALMESSLASTGDDLVALNGAIDKVNLSVKDQEGLQILMAHFYSFSESEDFRKRLFAAEHMLVFFQNCKLDYYRYVGDWVRHFITLFEDKSQDVVVAAVAAQNTLVSALRKDQLDSLVSIAYHSLRDVGSQGVNLPAFEVAQGVNSILPIFLYGLMHGTMDQREQSALGIADIVLKTEPSKLRPFVTQITGPLIRIIGERFPVEVKCAILYTLNIILSKISTFLRPFLPQLQRTFAKCLGDPSSEVIRSRAATALGTLITLQTRLAPIITELVSGARTPDAGVRKAMLNALFAVVSKSGQNMNEASAEAIEQLLDEISAESSEHMVICAKLYGALFSHLPDAQAKQLLESKVLSLEIQSEFSVLILNAAVKFGSQKIIELKLSDIVCSIISTASLQKEVTIAENGILALGKALLADIPQSFGNAKNLVEALKVNIEAPPSTSQDSRRLALLIIRVVSKENYSLIKPHISILAPAIFGCVRAIVIPVKLAAEAAFLALFQLVEDDSVLNKYIETLEGPRARSFVDYSRRVAVKLAAAERDRINSGSERVKLEEVEDLAEINAVGRDNEVSTNDP

SEQ ID NO: 13618 - protein, 314 aa, Schizosaccharomyces pombe
MPEQLVLRATLEGHSGWVTSLSTAPENPDILLSGSRDKSIILWNLVRDDVNYGVAQRRLTGHSHFVSDCALSFDSHYALSASWDKTIRLWDLEKGECTHQFVGHTSDVLSVSISPDNRQVVSGSRDKTIKIWNIIGNCKYTITDGGHSDWVSCVRFSPNPDNLTFVSAGWDKAVKVWDLETFSLRTSHYGHTGYVSAVTISPDGSLCASGGRDGTLMLWDLNESTHLYSLEAKANINALVFSPNRYWLCAATGSSIRIFDLETQEKVDELTVDFVGVGKKSSEPECISLTWSPDGQTLFSGWTDNLIRVWQVTK

SEQ ID NO: 13619 - protein, 354 aa, Schizosaccharomyces pombe
MTIFNGLSESGESKKLNSKIEKQIENASKKDKKIYKVLLLGASDSGKSTISKQIKILNKNGFSQEEIMTFIPVIRRNLLESAKTLVKIIVQKGINLDPLGTHNCEIIEKFNPTPGELINANIGQAITSLWSANSVRSCTYGNDSVLIDSAPYFFSRADEICSRHYVPTIDDILRSRNSTLGISEISFTLDHLQIRMFDVGGQRTERRKWIYCFENVNSIIFCVSLNDYDKKLYERAAPERNRLVESISLFDSIINSQWFMHSSIILFLNKFDLFRKKLEHVPFQDYFPQYEGKNSVKSITRYILWLFVNPSINRAKHNIYPHITTAVDTSNIKVVFSAVKETILQHSLKEAGMF

SEQ ID NO: 13620 - protein, 229 aa, Schizosaccharomyces pombe
MAQKKQLYVFSDFDGTITLQDSNDYLTDNFGMGNANRVNLNQQVLDGSISFRDAFAKMLDSVHLSYDEALEVLKKNVAIDPSFKPFYEWCKSQDIRVIILSSGMEPFIRALFEQYLGKEEASSIEIVSNDINVHPDGQWNIVYHDDSHFGHDKSLTIRPYAQLPESKRPHMVYCGDGVSDLSAAKETEHLFAKKGRDLIKYCEREKISFSEFETFADIHKDLQKLFFSS

SEQ ID NO: 13621 - protein, 593 aa, Schizosaccharomyces pombe
MVKRHKNTIGVWRLGKTLGTGSTSCVRLAKHAKTGDLAAIKIIPIRYASIGMEILMMRLLRHPNILRLYDVWTDHQHMYLALEYVPDGELFHYIRKHGPLSEREAAHYLSQILDAVAHCHRFRFRHRDLKLENILIKVNEQQIKIADFGMATVEPNDSCLENYCGSLHYLAPEIVSHKPYRGAPADVWSCGVILYSLLSNKLPFGGQNTDVIYNKIRHGAYDLPSSISSAAQDLLHRMLDVNPSTRITIPEVFSHPFLMGCTSLSSMDSTTPPTPSLSIDEIDPLVVDCMCVLWKKSSSKKVVRRLQQRDDNDEKYVYKVLSEILRDDMLKKQRFDENKYLSLYDLIHDNNLFTKASISTTSLVKSNVSTNSRKSSNFEDELARRVSSPLSALNQMSQSPIPIRVSSDKDYDSYACHEVVSNPSTLDDDYNYMFVCPPEEYTYSTDNVRTDSLDLQSLPTPTLEQLESVPFNRYGYVRIFPSTTLSSTASGYYTPDSLSTPEPSIDGLTNLDDVQVGGFVQGSGNQNRRPISFPVISNMQPNITNVRSASAPLCSSPVPSRRYSQYATNARYTPRKVSSGSVLRKISSFFRKD

SEQ ID NO: 13622 - protein, 411 aa, Schizosaccharomyces pombe
MALYSISKPVGSKINKHSYQDENTLVGKQALSKGTEKTKLSTNFEINLPRRTVLSDVSNVGKNNADEKDTKKAKRSFDESNLSTNEEADKPVESKFVKKLKVYSKNADPSVETLQKDRVSNVDDHLSSNPLMAEEYAPEIFEYIRKLDLKCLPNPKYMDQQKELTWKMREILNEWLVEIHSNFCLMPETLYLAVNIIDRFLSRRSCSLSKFQLTGITALLIASKYEEVMCPSIQNFVYMTDGAFTVEDVCVAERYMLNVLNFDLSYPSPLNFLRKISQAEGYDAQTRTLGKYLTEIYLFDHDLLRYPMSKIAAAAMYLSRRLLRRGPWTPKLVESSGGYEEHELKEIAYIMLHYHNKPLEHKAFFQKYSSKRFLKASIFVHQLVRQRYSVNRTDDDDLQSEPSSSLTNDGH

SEQ ID NO: 13623 - protein, 122 aa, Schizosaccharomyces pombe
MSSKSGLFLPLSSVITSYNENTNLSLKTIDAFLGFLVVVGGLQFGYALLVGTYPFNSFLSGFISCVGQFVITVGFRMALTQQELQSSSSKKKSPVVSPYKRAFLEFCFSSLVLHFFAVNFLG

SEQ ID NO: 13624 - protein, 372 aa, Schizosaccharomyces pombe
MASATSTPTIADGNSNKESVATSRSPHTHDLNFELPEEYEMINLIGQGAYGVVCAALHKPSGLKVAVKKIHPFNHPVFCLRTLREIKLLRHFRHENIISILDILPPPSYQELEDVYIVQELMETDLYRVIRSQPLSDDHCQYFTYQILRALKAMHSAGVVHRDLKPSNLLLNANCDLKVADFGLARSTTAQGGNPGFMTEYVATRWYRAPEIMLSFREYSKAIDLWSTGCILAEMLSARPLFPGKDYHSQITLILNILGTPTMDDFSRIKSARARKYIKSLPFTPKVSFKALFPQASPDAIDLLEKLLTFNPDKRITAEEALKHPYVAAYHDASDEPTASPMPPNLVDLYCNKEDLEIPVLKALIFREVNFR

SEQ ID NO: 13625 - protein, 780 aa, Schizosaccharomyces pombe
MSSYRGSTRPRKRTREGENYGFRPHRGNSQELLAARIKKDITFLADPRGNSVAADDINYVAMSLSREANDPETISTILDCIQTTAFIIPVKIPHLATLIIRASLRVPLILEKAAAYFCLQYFTNLNSFLYYEAKVDLRMLICMSFALQPGTLKPLFSLLADAISKETKPSVWGDNFLRIILINLPYFIAANNDLGKKDFANEILDQCEIYVRHRKSSITLSNPLSIHDNLSEEELDLLYKQLILSRENDFTFPYISQPWKFFESDFVHIVPVSPSIPEWTFQPTPQQNELPSFKRFFELFNNFEIRTTPDASDVAASIFRDISVDVINHLEFNRVEAAQVLTDLDVYFTYKTFALRGTPVNELPNLDPSESRWKAEDIIVEAVLGELLGSQNTTYKPVYYHSLLIECCRIAPKILAPTFGRVIRLMYTMSSDLPLQTLDRFIDWFSHHLSNFNFHWKWNEWIPDVELDDLHPKKVFMRETITRELILSYYTRISDSLPEELRCLLGEQPSGPNFVYENETHPLYQQSSQIIEALRLHKPLEELDIILQSEEIQNSETSAVRLVMSCAYSLGSRSFSHALNVFEKHLNTLKHFSRKSLDSEIEVVDELFSFWKLQPFNAVMWLDKMLNYSIISITSIIEWLIKQDVTIWSRSYTWSLVNTTFNKLAARLRRSVSNKEDSSLINEANEEKEIVTNLLLSALRALISENAENIWVSHWLNLMLKYVESNFLSVKKDTIEEANEPVQENTSEEQEDTKMQPVDAVDEQPSENNQTAADATNEEK

SEQ ID NO: 13626 - protein, 255 aa, Schizosaccharomyces pombe
MTSMFSLKGKTTLITGGSGGIGFSIAKAFAAAGSNVGLLYGRNKKALEYAAELRDKHGVQAKAYSCPIENRSAVIETTNQAVEELGGRLDVMIANAGIAIPHLSLEDKNEDIWTKVVGINLNGAYYTAQAAGHHFKKQGKGSLIFTASMSGHIANWPQQWASYHATKAAVKHLARALAVEWAPFARVNSVSPGYIDTDLTLYADENLRKKWKEYTPQARIGLPDELPGAYLYLASDASSYCTGSDIIVDGGYCSR

SEQ ID NO: 13627 - protein, 270 aa, Schizosaccharomyces pombe
MSTTSREDAVYLAKLAEQAERYEGMVENMKSVASTDQELTVEERNLLSVAYKNVIGARRASWRIVSSIEQKEESKGNTAQVELIKEYRQKIEQELDTICQDILTVLEKHLIPNAASAESKVFYYKMKGDYYRYLAEFAVGEKRQHSADQSLEGYKAASEIATAELAPTHPIRLGLALNFSVFYYEILNSPDRACYLAKQAFDEAISELDSLSEESYKDSTLIMQLLRDNLTLWTSDAEYSAAAAGGNTEGAQENAPSNAPEGEAEPKADA

SEQ ID NO: 13628 - protein, 283 aa, Schizosaccharomyces pombe
MSESQTESTTVTLTNGMVIPRIGFGAFMLKYNECYGLVTQALDSGYRHIDTAAVYGNEDICGKAIVDWCEKNNVKRTDIFLTSKLANCSDYYSTRAAIRSSLHHLGTYIDLFLIQSPAGGKKSRIASWKAMEEFVDSGDIRSVGVSNYGVKHLQELYASNPKFYPCVNQIELHPFLSQDDIVKYCQSHDIAIEAYSPLTHGIRLNDEKLVPIAKKLNISVAQLLIRWSLQKGYIPIIKSTKKEHMLSDLDVFNFTIPDDVVQELSSFDEHWHAGTTYDPTVCD

SEQ ID NO: 13629 - protein, 513 aa, Schizosaccharomyces pombe
MESQPVIWYCHSCSNEFQRPGNCPRCNSDFVEMVEPNTAPEDDPRAANFVNATEFNDPNAMLQNILQSLGQGVVPNVNPTDANRTANPNTNSNPNPNATNAQPNPTMFSTGQFSTEQGLPNVFFGAAAAQPGSGTPFVMPGIVNAAQIRNFFQNIMGGNAPQPEANSEQARNANTETSNPPFASAQTQGQEHRPSSPNPAEHMTGAYVNTPLNQPPSYAASTQPEFQQTTSPIFSSSSTPPPPPPRPSQPTSGESQNTNPRFPFSAQSFVFSVGPNGALHQVNTSTENPQNAQAGAIPITDLGSILERIFGSLNQPGAQQGEGEPFNPANMFSNIFNLSGNPGDYAWGARGLDDIISQLMEQAQGHNAPAPAPEDVIAKMKVQKPPKELIDEEGECTICMEMFKINDDVIQLPCKHYFHENCIKPWLRVNGTCAICRAPVDPNSQQRNNTSTDSANGHNPSNHANPSTSTTNDQGATLRNESFNAASQSNLSSEHGHSSRTPMDDFVDEEPLE

SEQ ID NO: 13630 - protein, 294 aa, Schizosaccharomyces pombe
MPFIKAVKSSPYFSRYQTKYRRRREGKTDYYARKRLIAQAKNKYNAPKYRLVVRFSNRFVTCQIVSSRVNGDYVLAHAHSSELPRYGIKWGLANWTAAYATGLLVARRALAKVGLADKYEGVTEPEGEFELTEAIEDGPRPFKVFLDVGLKRTSTGSRVFGAMKGASDGGLFIPHSPNRFPGFDIETEELDDETLRKYIYGGHVAEYMEMLIDDDEERYQKQFSGLIADGIESDQLEDIYAEAYAKIREDPSFQKSGKDAAAFKAESLKHTQRKLTAEERKERFNAKVIEAGRA

SEQ ID NO: 13631 - protein, 547 aa, Schizosaccharomyces pombe
MYYYLEIECESPVKDIFTCNKRRASKVVGNSFGGDHFNFRLGEIKLLSMDFPSSKVPEVEETSLGHGVVHLYRVFPSESHEFDAPGLILAILAIPLYMSPSDVLGFLGEKHCKSIQHIRLLKTKDPNRIMALLKFKDQASVIRFYTEFNGKAFSQIDPETCHVLHIDKVNIKYPMESSDSSSTEQQLVGPSSKPFASTTPALIELPTCVVCLERMDSSITGLITIVCQHTFHCPCLQKWGNSSCPVCRYTQKVQSSEFQSKCTVCCYDKDLWICLICGNIGCGRYHDAHAKQHYVDTAHCYAMELETQRVWDYAGDNYVHRLLQSETDGKLVELSTDGKSSGWTGSSATESKLRDKMGLEYTQILVSQLESQRLYYESHLSNMSQKLSRVNEELVLKTKIATASSNANTDLRSRVDISESKLKKRDDKLKRVSSQLEHLKHNYEEEKSMNENLLVRIQTLEKQNTTKSDQIVSMQFQINDLNEQLRDLMFTISASQEIQKMGQSEELQNGTIVLPNNSTVRSNSVKSKKKKKKKPVVPSSSGSLGTD

SEQ ID NO: 13632 - protein, 270 aa, Schizosaccharomyces pombe
MSNSRENSVYLAKLAEQAERYEEMVENMKKVACSNDKLSVEERNLLSVAYKNIIGARRASWRIISSIEQKEESRGNTRQAALIKEYRKKIEDELSDICHDVLSVLEKHLIPAATTGESKVFYYKMKGDYYRYLAEFTVGEVCKEAADSSLEAYKAASDIAVAELPPTDPMRLGLALNFSVFYYEILDSPESACHLAKQVFDEAISELDSLSEESYKDSTLIMQLLRDNLTLWTSDAEYNQSAKEEAPAAAAASENEHPEPKESTTDTVKA

SEQ ID NO: 13633 - protein, 539 aa, Schizosaccharomyces pombe
MPSSNGSSDFVRKLFNMLEEPEYRHILRWSDSGDSFIVLDTNEFTKTILPRHFKHSNFASFVRQLNKYDFHKVRHEEGAPSIYGEGAWEFRHDDFQLHHKDLLDNIKRKAPSKRNLANENTAPVIENLKQQVDSILDFQKLLDRNLSGLATSYQTILLKMFELKRGIESRDLLMSSIISYLCDLEGSTQRQANPGAMFVPSHPLQELLNAYQALAKGQVATTSPQQIPNQIQQASAATTASSKMTVDTNLGTAQPSLYNTPSSDYELANQEKPADSMASAASLNTPLSSNDHSLNPHAHGSYPMYEKFQPIQHPNPGSFTTHLDSNASMAKSFSQISNDSLAKASSVATSMSQMGAAVPTTGLWKRQPRILLVEDDELSRRMTIKFLTSFDCQVDVAVDGIGAVNKANAGGFDLILMDFILPNLDGLSVTCLIRQYDHNTPILAITSNISMNDAVTYFNHGVTDLLVKPFTKLTLLQLLKKQLLNLLQADNSINMSDVPSTKEAKDDKAPVTFYLENDAPMYPQQMLQDPIQADLQHPH

SEQ ID NO: 13634 - protein, 569 aa, Schizosaccharomyces pombe
MPDSKHWVILLFRRDGDDDDDDGQDPALQELYSSWALFILLVLLIGALLTSYYVQSKKIRAIHETVISVFVGMVVGLIIRVSPGLIIQNMVSFHSTYFFNVLLPPIILNSGYELHQSNFFRNIGTILTFAFAGTFISAVTLGVLVYIFSFLNFENLSMTFVEALSMGATLSATDPVTVLAIFNSYKVDQKLYTIIFGESILNDAVAIVMFETLQQFQGKTLHFFTLFSGIGIFIITFFISLLIGVSIGLITALLLKYSYLRRYPSIESCIILLMAYTSYFFSNGCHMSGVVSLLFCGITLKHYAFFNMSYKAKLSTKYVFRVLAQLSENFIFIYLGMSLFTQVDLVYKPIFILITTVAVTASRYMNVFPLSNLLNKFHRQRNGNLIDHIPYSYQMMLFWAGLRGAVGVALAAGFEGENAQTLRATTLVVVVLTLIIFGGTTARMLEILHIETGVAADVDSDTEIGMLPWQQSPEFDLENSAMELSDASAEPVVVDQQFTTEHFDEGNIAPTLSKKVSSTFEQYQRAAGAFNQFFHSSRDDQAQWLTRFDEEVIKPVLLERDNLKNGTKK

SEQ ID NO: 13635 - protein, 110 aa, Schizosaccharomyces pombe
MTSIAKAFVEKAISNNPVTVFSKSFCPFCKAAKNTLTKYSAPYKAYELDKIENGSDIQAYLHEKTKQSTVPSIFFRNQFIGGNSDLNKLRSSGTLTKMIAELKENKSSIL

SEQ ID NO: 13636 - protein, 533 aa, Schizosaccharomyces pombe
MKRFFSKLFSKSPTSGRVPSPDSDYSEEEQRLLAEENGYFQDSNEYVEPNIPAVYGSMIPVAQQLQQHHVHTPGESFADNASGYPVIKHELSELLRLGSPTVIAYLLQSSEQFSTVFTLGHLGKEYLAASSLSTMTAAISAFSIFQGVISSLDTLATQAFGANKPYNVAIYLQRCLLILAVLHIPVALIWLNLEHILIFLHQDPMVAHLCGRYMRVFILAAPGYAVFEALKRYLQAQGIFTPITYVLCFAAPLNILLNYLLVWHPTIGFGFLGAPVAVATTFWFQSICLILYICFSSTPIPWPGFSRQALKNLSPMLHFSFHGMLMIVTEWAAYEMTSLGAGYLGTAPLASQSILLTSTSLLFQIPFAFAVASSTRVGHLIGSGRANLARLCSRVAYSLALCISIFDGSLIFCFRDVWGSLFTSDPEVLAVVKDIFPILSLFIVTDGLNAVGGGLLRGTGKQYIGGLISIGSSYLFALPVTVFVVVYFNTGLKGIWCGMILSSVTAITCQFTVLFNTDWHRVLQEARHRLTHV

SEQ ID NO: 13637 - protein, 275 aa, Schizosaccharomyces pombe
MLGSFVKLNNGLKCPQFAYGSYMVNRTKCFDSVYAALQCGYRHIDSAQMYHNEADCGRAILKFMEETGTKREDIWFTSKLNDLSGYKSTLSSIDASVKACGLGYIDLFLLHSPYGDRIESWKALEKGVEEGKLRAIGVSNFGPHHIQELLDSHPKIIPCVNQIELHPFCSQQKVVDYCESKGIQLAAYAPLVHGEKFGNKQLLAIASKYNKSEAQIMIRYCLQRGFIVLPKSSTPRRIKENGDVFDFEISKEDMEKLYNLDEDYHSDWNPCVSPL

SEQ ID NO: 13638 - protein, 553 aa, Schizosaccharomyces pombe
MSVDENQLENGQLLSSENEASSPFKESIPSRSSLYLIALTVSLLGVQLTWSVELGYGTPYLFSLGLRKEWTSIIWIAGPLTGILIQPIAGILSDRVNSRIGRRRPFMLCASLLGTFSLFLMGWAPDICLFIFSNEVLMKRVTIVLATISIYLLDVAVNVVMASTRSLIVDSVRSDQQHEANSWAGRMIGVGNVLGYLLGYLPLYRIFSFLNFTQLQVFCVLASISLVLTVTITTIFVSERRFPPVEHEKSVAGEIFEFFTTMRQSITALPFTLKRICFVQFFAYFGWFPFLFYITTYVGILYLRHAPKGHEEDWDMATRQGSFALLLFAIISLAANTALPLLLEDTEDDEEDESSDASNNEYNIQERNDLGNIRTGTNTPRLGNLSETTSFRSENEPSRRRLLPSSRSIMTTISSKVQIKGLTLPILWLSSHVLFGVCMLSTIFLQTSWQAQAMVAICGLSWACTLWIPYSLFSSEIGKLGLRESSGKMIGVHNVFISAPQVLSTIIATIVFIQSEGSHRDIADNSIAWVLRIGGISAFLAAYQCRHLLPINF

SEQ ID NO: 13639 - protein, 2310 aa, Schizosaccharomyces pombe
MSLYKSLDVAIDYAISQLGEFQFQPIRTQSNPSSLLSACLVRAVHVETRRKVIFKFSQQTFKLENEYFLLRQLSSHPNGRNYAIAPAYILLLNETLGALIYDDPGPNILDEWLGNPNPLDLKLFLKFALGVSYVLCFLHEKKIVHGEIRLDTFHYDLNAPIHAKLLTIGSSVSPIRFTLSSLNWKRLYQVQNICHKLQFFSPEQIGNVGRPLDSRSDIYSLGILFYVILTKQYPWGGQSMRIVQSIHMRQFPSVLPRRPDAFPALDQLIQKMTAKSMNSRISSATDLCYTIVELMQEFSTITSSPLLDQKLLSINKPQQEKLKFPKLLLTNSSDYVRIFHELVAFSSKRDLLTSAKRVDKLPKQHLFKYRPVDNEATYCQVVTVTGEKGSGKSNLLNAVADEARKFGYFAMSSFKGHHFSPYSAIFKCVSLIMQQTLREEKQLVTDYFTSLWEFLGFQLIYMGELFEYVPELNSLLSPKYNLHCKRENYFKLKKRDPQQFRSASGRLGFMVCLLEILSFTSRVRPVIIILDELHLADHPSLSLIIGMISHRLPILLILAWDEPVMFKDFSKCLHEAPYAMVTDIRMNLFDRKNITEFLDSTLESPTQALGPLVLLMQKLSKGNPLVLKSLLLIAFANNGFAFHPKSSSWTYDLPVINRSFEALSSYDIPPLLASLLDALLPARCIEFLLWAALLVEPFPFELLRLITTSMHLFIPKEEILDFPLNVLQFDNDNESCQFSETFFREGILSKISLRRAESMHAQIAKELITGTAKEFYDIRTVHHILKGLGVIKKFDNTKPYILALKESADALMQFGSYEYATELLKSCLFLLPRNFWNSKLYTRKDLISIHISLAMCYWWSKDHENAIKVLKNPKLSSSNVYDYLPAFRLLTKIEYYKYQSLRSIDKAQELLSNLGLKLKEPTDDVLREFYDRLSTKFLECDFLVKQSEPLDRKRIDAISVILSECGFVLFNFSQPYYYYFSFLLAEMYLRYGNPSLRYSVMFLASYCFVTRRKPEFLLRISQVDSDLFVIKDRSAVAHAELIYWGLKRELCSTETGSAVTLESILLQCVMFGDKIYGAYCLACLMAQRVFRGDHIHQLLLDQENSETLLLLWDCEPPFTYYLMLIRNSLLALFGLTNNDDPNNILTTKQRTQKDLHDKLTSKKVPCTFCCWYYAGIIFLNTLFHHYEYVMSIAQEVRKLVDGKLYERYYLITRSFIGVAALQLLFYKKNISEFEREKVEDVAHWAQSSLSEMAKCFHAELYKLWVCLLEGLRQRNLGNYMEALRLFEKVTSMGASVFSPIEFPFVLELIGEFYYGRGHKFLAKSYITRALSCLKNIGCYGVENKLRSRYSDLISDVESRGTTVVSIATTTGDYAEKLKLLRNQDINDFSLGLASYSDIFDKPLVTLPVKKSSAVDESENDFYDRNDEESFDIVSLVSVIKCGQLLSSKLRLGPLLTTVIKLVIEYSQAKHAAIILKDASNYTLAAHGNVEKAESFEPPVILSQSDVKIPDSLLSEVFDHCRIVSLYTVSASQDAELLRWLQEEHDMDFFAIIPLQFKESVIGALYLCLSRRAIRTGNVTFLKLLSQQIAISVSNALLFQSLRRTITDNVTLIELQRLSYQRYKAIEEKCITLLDSLPCIVWTLDSDIGEIEYTNASKRNYFGVPEDCHDSLSWKTFIHPDHHHQFQEKLLNLKTLELGDIELLLRMEDGNYHWHLCRGLSFKEDANAKKWIVVCIDINDEKEAREAAMHAVNLKTNFLANMSHELRTPFSSFYGMLSLLSDTKLNEEQYDIVSTAKQSCTSLVQIIDDLLNFSELKSGKMKLEPDKVFDVEENIADCIELVYPSLSSKPVQISYDIYPNVPALLAGDSAKLRQVITNLLGNSVKFTTEGHILLRCMAIDEEINAEENQCKLRFEIEDTGIGLKEEQLKLLFNPFTQVDGSTTRIYGGSGLGLSICLQICKIMDGDIGVQSVYGEGSTFWFHVQLRNVTSKLSQKHFEESHERFANIRQSLKNAKILVVKSFTTSRSIFRSLFSLAVVDTTTIYSDIEQQLIDSLDKRQPYDFLCIEAASGQTEQIITQILSNQKLNKVLLIVLLPSIQRTKVRSDGDPFITSLNKNQSRIFCFREPIRISKLLQNFPALLSKWSTPTKLVEPSQFRASPRKVDQAVVLSSEEKEILQKKYALIAEDNLIARKLLTKQLSNLGFQVHAAVDGVELVKMYEAKQFGFYSVIFADYHMPIRDGAEAVMDIRAYERENNCSTPIPVIALTADIQKSAKQRCLEVGMNFYLTKPFTQKQLVNAVREFVLLEKSAR

SEQ ID NO: 13640 - protein, 131 aa, Schizosaccharomyces pombe
MSGGKSGGKAAVAKSAQSRSAKAGLAFPVGRVHRLLRKGNYAQRVGAGAPVYLAAVLEYLAAEILELAGNAARDNKKTRIIPRHLQLAIRNDEELNKLLGHVTIAQGGVVPNINAHLLPKQSGKGKPSQEL

SEQ ID NO: 13641 - protein, 284 aa, Schizosaccharomyces pombe
MLIAAMGPKIPVPAYGVGTALFKKEKGEINRTIVDSVKNALAAGFIHIDCAEVYGNEEEVGVALKEANVPRSKLFITSKVMHNVDNIPEALNESLRKLGTDYLDLYLLHSPIPFYEKKIPISEGWKAMETALGTGLVHSVGVSNFRIPDLEELLKTSTITPRVNQIEFHPQVYKAAKPLVEFCQSKGIIVEGYGPLSPLVRDAQGPVAEFTKSLESKYHVSDTQILLKWAYSKGVIPITTTSKIERMKECLNFDSFTLDKADIDELGTLGVQHHKRTFMKHMDE

SEQ ID NO: 13642 - protein, 622 aa, Schizosaccharomyces pombe
MNKFFSFPILGLLLTCVRFVVAKERLFEWNVTDVYDVDPDGSGNSRWVIGVNNKWPIDPLVVDYGDQVIIKMTNSLANNRTTSLHSHGLFQKFTPYMDGVPQSTQCEIPPGATFYYNYTALQNGTYWVHSHDMSQYPDGLRTPFIINALEEPYDYDEEYIISMTDWYYTPFNILVPDEFKTWKNPTGAEPVPDTGLFNDTANATFAMEPGKTYRLRFINIGAFNNYDVMIEDHNMTIIEVDGEYTEPQEVSSIHLTVAQRYSVLVTAKNSTDRNYAITAYMDESLFDTIPDNYNPNVTAWLSYNSDASYDLGPDIDEIDSYDDAELNPLYSWDVTESNHSINIWFDFFTLGDGANYAEINDSSYVFPKVPSIMIANSTNVDGYNLEPVTYGPYTNAYIFEYGDVVDVIIDNHDTGKHPFHLHGHTFQVLERGEENAGLYSDQESHTYYDNPMRRDTVEIEPGSFIVIRFIADNPGAWVIHCHIEWHMESGLLATFIEAPEMIPSISSPDFVKEQCMLDGVPTIGNGAGNYKNISDLSGAPSPPGEMPAGWTSKAIGTMAACVISACIGMGSIIFYGASIHPVPTEELDENDDLQEAALENAAMFLDTDKAVEKVVEGKDEIK

SEQ ID NO: 13643 - protein, 231 aa, Schizosaccharomyces pombe
MQLYSSESESDDSQYWVDWFLGLKGNEFFCEVDEDFIQDRFNLTGLSHEVPHYSQSLDLILDVLDPDLPEEVQDEVEASARHLYGLIHARYILTAQGLYKMLEKYKKCDFGHCPRVLCNGQPMLPVGLSDIAHTKSVKLYCPRCEDVYTPKSQRHASIDGAYFGTSFPHMLFQVYPELAVPKSQERYIPRIFGFKVHSYSATFKKQDVYKEKQKKRLQGAEAESKNKLAIT

SEQ ID NO: 13644 - protein, 317 aa, Schizosaccharomyces pombe
MQIQETVPLDAPEHCPGPSSENAGTASACEGCPNQQICASAPRGEDPDLPLVVERLKEIKHKILVLSGKGGVGKSTFSSQLAWGLSLEEDKQIGLMDVDICGPSIPRIMGVEKEEAHQSSKGWSPIYVCPNLAVMSIGFLLPSEDSSVIWRGPKKNGLIKQFIKDVNWENLDYLIVDTPPGTSDEHLSLVQFFKNSGIDGAVVVTTPQEVALQDVRKEIDFCRKASIPILGLVENMSGFVCPSCKGKSNIFTITTGGGEALAKEMGLPFLGKIPLDPLIARSCDFGKSFIDECPESPASEIIIDIINKIDESLQKRQ

SEQ ID NO: 13645 - protein, 432 aa, Schizosaccharomyces pombe
MPAIMEKNMLVSESLRTTELLGHVKPIDSVVTWSSPGSSRQAIGEAFKNTIEEIERAAVRGEPADSDAFFVADLNGVYRQLLRWHAKLPRVQPFYAVKCNPDPKVLALLNKFGTGFDCASKGELEQILGLGVSPDRIVYANPCKAITYVRYAASKGINLMTFDNADELYKVKQHHPNSRLLLRISTDDSNSLCRLSLKFGASLDDTGKLLDIAKSLELNVVGVSFHVGSGSYDPSAFLDAIQRSRQVFDQGLERGFNFDLLDIGGGFMNDSFDGVADLIRSALDTYFDPSIRVISEPGRFFVSSSFTLAVNVIAKRKLDDEEKVMYYVNDGVYGSLNCILFDHQHPVARVLKCGSRFVYNDLVGTGQHRCFIWGPTCDSLDVIANDAHLPYELNVGDWIYFEDAGAYTVAAASCFNGFKTSRIVYLDTDILD

SEQ ID NO: 13646 - protein, 1639 aa, Schizosaccharomyces pombe
MRPPDDQINNNVGSNSHLEKLKEAMDHQLQKSSKIVGSFTNSQNSSVGSVHSPILESPTSLNRQHRNSFSFNNVSSPSLEDERLINFPRVNPNRLMTSKRPNELFKTSSMSSDCYSPQKSRESLNSLCHSPAPSVSSCGNALNNDNTSASHSLTDEQPFETDSSANLFKQLQEKRNRTIGNVYEMACLLVFKTGLMNFWKNIIDFFAQQFFSTQISVVEPRDLSDIYNTPWQLRCYYDGGSHYDPYSNPISVNDNLASSSYVTVVASDGSKGIIYKDPASLKHEGDLLIDSKVVQTVLERATLLVYTRKQQHIVKNTKVHDNDYFSSIPNVDDIRSIKNSWKVFHDEKLNELKKQVEISASAAQLNGLYPQKKRAFVSHFSQNRKPYSQSDISKAQSSSFSEEPSNIYDEYEQNLLSPWSRSPVASPSIQTDPNRNPFFQNCLQESSFATESSTEKSASESVSETAVNDDCKGMNFSGNRRQEDHLNDFTSFPTETAVSIVHVPLMFPCSDQTSSRGRAPIAILSFKSNLVPYPENLIASIERLIPFIFSSYSNSQSVPLLPCPTQRHLLFNTSSTDNTKELSMSASSENSDCPHKEGECVGSFCNINAKGSSLNNIPKLPRFVPVPSEFFKKNQRSWVTLKKHRLLARLKSRISKKNSKVNENLRFSLNDGENYSNETITLKKDEIVLDKSKSYACCTSESHKYVQGHCGGQAPPFPLLKVIIDSIPVHVFTADPGSGKLTWVNRKTLLYCGLNMNEQIELQFSRIHPDDLPNFLNDWKSSLFSGSGFYHEIRLQRFDNVYRYFICRAVPLRDCTGSVLHFFGTMTDVHDQKLAERELQKQSAIAANENSYRSLAEASPQIVFAANGKNGIIYANAQWLSYSGLSLESSLGLGFLSAVYHADRKKCLLPESLEGTFNNQDESNGTKTFAAEIRFRSTDGHYRWHLVKSVCVNNSADTSTNLWLGTCTDIHDHKMLEEKLQESNIEAQRIVRSKMQYLSNMSHEIRTPLIGITGMVSFLLETQMSAEQLSYARIIQQSAKSLLTVINDILDLSKVRAGMMKLTSQRFSVRAMMEDANETLGTLAFSKGIELNYTVDIDVPDIVFGDNMRMRQVALNVIGNAIKFTNVGEVFTRCSVEKIDYSTNTVVLKWECIDTGQGFNRDDQLQMFKPFSQVESSTLPRHGGSGLGLVISKELVELHNGSMSCQSRRGVGTRFMWTATFTMDKTPLKFEPPDGCCPVCFCPYEKSKQSTEDYYCADDGNDKSATNFVKLAVNKADPGRESNRRKLESDKNVQSNKYVNPFASESEFCRCGASADPYTVLFWRLYRNKPSGIKLDKSALAVVVSHTKYSSEAIGNMLQSIIDISSFKDIVRYGNTYEAFEELLENPMQSKVTHIILNLPDIEAYVLFVKSLQLCSLYKDTKFILVTSTRQKESLSKIFSDSEDCNSESIHYVLKLVKPSKFFPLFYSDSEEKGKIGALNDMTRKAAMEQKADAETLRYNLAKSGFSVLLAEDNIINIKVISRYLERIGVKFKVTMDGLQCVEEWKREKPNFYSLILMDLQMPVMDGYQACNEIRKYELENDYPKVPIVALSANALPHVVLSCKDSGFDSYLAKPITLQHLSLIISGILNYTNQSKLHK

SEQ ID NO: 13647 - protein, 383 aa, Schizosaccharomyces pombe
MSSKLTVNAHYSPLKDEDPLDHIDSQTALDSMETDSTGKSSLYFSKSDDPLSKDIEDGISTRKLEEMSVLEANAKEPDSENAPVSRLTIFFAVSSQIVFAILVTILNKQALNIINAPLLMLSFQMAFTSLMVKMYWRFSSVHFQTLRLASAIQLKKFIFVKILGIVSKTYCLAFVPVSFYQISRGLLLPFTILLSFVLLKQKTRLFPFGGCLLVMLGFGFGVRFESHVAPIGIILGVWSSFTTAIESVAVKHYVHEYPTLDLIYIFSALMSVFCLLLSVASLELLHTVQEVVGMQAIKFFIVLILSSLSNFYLNIATFTQIKVTSPVTYMISVSARSILQTLLAVAFLGETLYGNRIYGVILILVGTLLYTLAKEHERRVASA

SEQ ID NO: 13648 - protein, 899 aa, Schizosaccharomyces pombe
MNCEMVTSPESVNLGDSNRAVSPFCLPDCSENAVAQTRSKTLDNAALDLPYVGNRKKSEQDFFKMLSSRDRDAHSTLRKRSNSLSSFLSTKSTSASENKFHGGLNWLSLKLNLLLRLQGRMNSARTNTSMNPYSCDSNENLSTLSSVNQNFNSRQLLATIVPESIQNGCSLLRITKKKVRQRKVSLDPISGYLMLDKNTGKAYKKLCVDDIKEIRQGRDARNYREQYKISSENEKRWFTIIYCADNKLKAMHMISPTLDAHNQWIMALEGLKTYRLNEFIIGLNLVCHQGEKMIDYSENLNPWEKLEKEQSAQLDLGDVHRMCQMLHLNASMEFLEETFQKADADHSGKLSFEEFQHFVSLLKTRSEIVDIFKEYTSGSDKMSLEQFRHFLSTSQKARLDSDSIRTLYVSFCSNDDSKMGLIEFTSFLLSPHNSPVVPVIQDMSRPLNEYLISSSHNTYLLGKQFGGESSIEGYIRSLQRGCKCIEIDCWDGPNGPVVCHGHTFTSMIKFNDVIDAIRKYAFVVSPYPLFISLEIHCCPDQQRQMVSYMKQAFGDTLVMKPVTANESVLPSPEDLLNKILLKVKCSATPLHQFSTDILKVGITDSSTDTTESSELENSELTGLRKGKRRMKNIIVQELQQLAPYARSLKFRNFSLPESKTYSHIFSFSERTIKKHGKAMVPRLSKHNLRYLCRVYPGPLRVGSTNFNPQVYWRLGVQMVALNWQTYDTGLQINDALFIADPPTGYLLKPPCQRIIGTTVGEEGLPRKIKLTIDVISGQQLRRARELSNSETLSPYVEIQVHSMEESPFRWCSKVVHENGFRPFWGETMVYESIISDDFYSMIRFLVHHRGSNGNDSIFANFTCPIDRLQQGYRHIRLLDMQGENLLFSSLFLKIKKEDI

SEQ ID NO: 13649 - protein, 101 aa, Schizosaccharomyces pombe
MSSVESFVDSAVADNDVVVFAKSYCPYCHATEKVIADKKIKAQVYQIDLMNNGDEIQSYLLKKTGQRTVPNIFIHQKHVGGNSDFQALFKKGELDSLFNTA

SEQ ID NO: 13650 - protein, 339 aa, Schizosaccharomyces pombe
MPGNTKKSADSGLTAKDYYFDSYSHWGIHEEMLKDDVRTLSYRDAIMQNPHLFRDKIVLDVGCGTGILSMFCARAGAKHVYGVDMSEIIHKAVQIVEVNKLSDRITLIQGKMEEIQLPVEKVDIIVSEWMGYFLLYESMLDTVLVARDRYLAPDGLLFPDRAQIQLAAIEDADYKSEKIGFWDDVYGFDFSPIKKDVWKEPLVDTVDRIAVNTNSCVILDLDLKTVKKEDLAFSSPFEITATRNDFVHAFLAWFDIEFSACHKPIKFSTGPFSRYTHWKQTVFYTHKDLTVKAGEYIRGTITCKPAEGNHRELDIDISYTFNPREPNREPVSEDLSYRM

SEQ ID NO: 13651 - protein, 258 aa, Schizosaccharomyces pombe
METDPILKVEREPEFTPSPAPEAIVKDIEQGVAPVSQNEPDRPQHWITRVVIIVLIVLAWYFFSLLLSMMNKWIFSESKMDFQFPLFLSSCQMLVQMGFAKLTILAFPRYQPNKKDNFSWLEYFYRAGICALVTGLDIGLSNASLETITLSFYTMCRSSILIFVFFFSVIFRIEMFDWILLCITLVISAGVVLMVATETQFVLSGFLLVMASSVLSGLRWALTQKLLLDHPWTSNPFTSLFALTPLMFLFLLVAGLIF

SEQ ID NO: 13652 - protein, 609 aa, Schizosaccharomyces pombe
MIQTASTISSNGGTNQGMESSSANSPEMNGTQNSMSVGMSGSGSSQNRKITQFSNKLYNMVNDSSTDSLIRWSDRGDSFLVIGHEDFAKLVLPRYFKHNNFSSFVRQLNMYGFHKVPHIQQGVLQSDSPNELLEFANPNFQRDQPELLCLVTRKKAGSQPVEESNTSLDMSTISSELQNIRIQQMNLSNELSRIQVDNAALWQENMENRERQRRHQETIDKILRFLASVYLDGKQKPPSKVMPKSRRLLLEAKYPTVSPTNEPSAHSRPSPQGTTANSSSASISSLHNTTPDGEGKYRSVQNGRALNYVSSFNSDSHSPKDYISQSYTNEPGLKKESADSFNNSIDSYISPNQSPNTDVPSLNRDDTTDPKVVNTGDIINMLDDANSIEGSNMNSLSPLLFDYPNSLYPVNNTSSEQHHNSYRGSVSNSQPSGNLSESTNLQPVQPVDYMSNSNPSYGSYNAEDQLTNFHPGYAMDQKRISKLSDGITKQDQNIQALADILGIPLGDGKIDDAGFSANSPTNLNLPVSSDLDSVLNIPPNEDVFPDSNPVFDEFTNISNLTSPIEASNGNTFGSNPVSLPNQQKSVNPSLMTVSSPRQVRKKRKSSIGA

SEQ ID NO: 13653 - protein, 488 aa, Schizosaccharomyces pombe
MFCSISGETPKEPVISRVSGNVYEKRLIEQVIRETSKDPVTQQECTLEDLVPVKVPDFVRPRPPSATSLPALLSLFQEEWDSVALEQFELRRNLTETKQELSTALYSLDAALRVISRLTKERDEAREALAKFSDNIGTVSSKTIEVQEVEMGESDDQLKTSLRSTVEKTFQELSSKRKRTKLQPKWATDDAVSQLLQATPSTILENLETESTTSFFPSPENSSFVLCLHKDELLCLDIQSNSTLKIFEGSALACCWLTSSKIAVATADAISIFEFPVSSSGLQSVGEPTSSIPIDEKVNFLQAHPSGEYLLAASNEKCYIFSLKSQVYNITVAQHITSLAVHPDGNLFVAGLENGELRFFETSSGNELTKFGPHSSPVKTLQFGENGYWLVVTTNDDSDIFIWDLRKSELVQKIPLQTKVAAVSLDITSQLLVSSDGETLYVHIYVKSSKSWRCMSQTHVSSISNLVWLNELHQLLFSTSNGAILRLG

SEQ ID NO: 13654 - protein, 321 aa, Schizosaccharomyces pombe
MSAEQKYFENAQNVHFTLADGSKIPGLGLGTWRSEPNQTKNAVKTALQYGYRHIDAAAIYGNEDEVGDGIKESGVPRKDIWVTSKLWCNAHAPEAVPKALEKTLKDLKLDYLDEYLIHWPVSFKTGEDKFPKDKDGNLIYEKNPIEETWKAMEKLLETGKVRHIGLSNFNDTNLERILKVAKVKPAVHQMELHPFLPQTEFVEKHKKLGIHVTAYSPFGNQNTIYESKIPKLIEHETIQKIAKSKGEGVTGATIAVSWAITRGTSVIPKSVNEQRIKSNFKYIPLTKEDMDEINSIGIRARFNQATFSNEPVFAGLEDGRT

SEQ ID NO: 13655 - protein, 270 aa, Schizosaccharomyces pombe
MTVQTAERTITLVQAIWPKLRKEAEKQCEVNPWLAKDLARKILSKKTLRESLSCVLALPLDHVTGSSESMENWFYSILGLNDEKIIRSAMIDLDRLYTTNPACPDLISAFLSFRGFHALQLYRIAHGLWSEGDKTSAVLVQNWTAVAYGVDIHPAASIGDGLFLDHALGIVIGETAIVEDGVSIWHNVTLGSTFKDSGARHPVIRKNAMLCTGATVLGRVEVGENAVVAAGALVTKDVAPNRLALGSPARDVGPVPQYFGALTNPNCTNK

SEQ ID NO: 13656 - protein, 436 aa, Schizosaccharomyces pombe
MISISFLNCFFLVFLFLFFSDVHGSYNGLGLKPQMGWNSWNKYACDIDESIILNNAKAIKEEGLLDLGYEYIVMDDCWSKHERNATTGRLEANPDKFPNGIGSMAKKLHDMGFKFGMYSSAGKYTCAGFPGSLNHEQIDADTFADWGVDYLKYDNCFNEGKSGVPLISYERYKRMSDALNKTGRPIFYSLCQWGEDFVWNWGNTIANSWRISGDIFDTFSRKDVRCPCETIECFALQGDHCSVMNIISKASFLSSKAGMNSGWNDLDSLEVGNGGMSFEEYKTHFTMWAILKSPLILGNDVSSMSPMDKLIVSNKELISINQDIGTNPAALIWKKKYGDEYIELFSGRLSNNDWVVAVLNAASEPLKMGIHLSDIFVDALGNAEHDWLATDLWNNNVKLVSDRIRANVASHGVQVWRFQQYKVKNTNDKFFSFNKH

SEQ ID NO: 13657 - protein, 427 aa, Schizosaccharomyces pombe
MSSVEVNRENADVANTNRQANLAEGYEIKELNESQKQYIRSSIPILESSGVNLTKAFYQKMLGNYPEVLPYFNKAHQISLSQPRILAFALLNYAKNIDDLTSLSAFMDQIVVKHVGLQIKAEHYPIVGHCLLSTMQELLPSDVATPAFLEAWTTAYGNLAKILIDSEKKVYQSQPWNGFVEFKVTELINESSDVKSVYLGPKDPAFRISHAHPGQYVSVLWEIPGLSHKTLREYSLSNRVDTCRNQFRISVRRVAGGVVSNFVHDNLKVGDIVGVSPPAGNFVYKRSEENVNRPLLCFAGGIGITPLIPIIETALLDGRKVNFCYSSRNYVSRPFKQWLEQLKLKYKENLKLKEFFSEESSVTKEQIVDEVMTRIINEEDLEKLDLSECDIYMLGPNNYMRFVKQELVKLGVEPNKVQSEFFGPYIP

SEQ ID NO: 13658 - protein, 789 aa, Homo sapiens
MLCGRWRRCRRPPEEPPVAAQVAAQVAAPVALPSPPTPSDGGTKRPGLRALKKMGLTEDEDVRAMLRGSRLRKIRSRTWHKERLYRLQEDGLSVWFQRRIPRAPSQHIFFVQHIEAVREGHQSEGLRRFGGAFAPARCLTIAFKGRRKNLDLAAPTAEEAQRWVRGLTKLRARLDAMSQRERLDHWIHSYLHRADSNQDSKMSFKEIKSLLRMVNVDMNDMYAYLLFKECDHSNNDRLEGAEIEEFLRRLLKRPELEEIFHQYSGEDRVLSAPELLEFLEDQGEEGATLARAQQLIQTYELNETAKQHELMTLDGFMMYLLSPEGAALDNTHTCVFQDMNQPLAHYFISSSHNTYLTDSQIGGPSSTEAYVRAFAQGCRCVELDCWEGPGGEPVIYHGHTLTSKILFRDVVQAVRDHAFTLSPYPVILSLENHCGLEQQAAMARHLCTILGDMLVTQALDSPNPEELPSPEQLKGRVLVKGKKLPAARSEDGRALSDREEEEEDDEEEEEEVEAAAQRRLAKQISPELSALAVYCHATRLRTLHPAPNAPQPCQVSSLSERKAKKLIREAGNSFVRHNARQLTRVYPLGLRMNSANYSPQEMWNSGCQLVALNFQTPGYEMDLNAGRFLVNGQCGYVLKPACLRQPDSTFDPEYPGPPRTTLSIQVLTAQQLPKLNAEKPHSIVDPLVRIEIHGVPADCARQETDYVLNNGFNPRWGQTLQFQLRAPELALVRFVVEDYDATSPNDFVGQFTLPLSSLKQGYRHIHLLSKDGASLSPATLFIQIRIQRS

SEQ ID NO: 13659 - protein, 324 aa, Candida tropicalis
MSTTPTIPTIKLNSGYEMPLVGFGCWKVTNATAADQIYNAIKTGYRLFDGAEDYGNEKEVGEGINRAIKEGLVKREELFITSKLWNNFHDPKNVETALNKTLSDLNLDYVDLFLIHFPIAFKFVPIEEKYPPGFYCGDGDNFHYEDVPLLDTWKALEKLVEAGKIKSIGISNFTGALIYDLIRGATIKPAVLQIEHHPYLQQPKLIEYVQKAGIAITGYSSFGPQSFLELESKRALNTPTLFEHETIKLIADKHGKSPAQVLLRWATQRNIAVIPKSNNPERLAQNLSVVDFDLTKDDLDNIAKLDIGLRFNDPWDWDNIPIFV

SEQ ID NO: 13660 - protein, 324 aa, Candida tropicalis
MSTTPTIPTIKLNSGYEMPLVGFGCWKVNNETAADQIYNAIKTGYRLFDGAEDYGNEKEVGEGINRAIKEGLVKREELFITSKLWNNFHDPKNVETALNKTLSDLNLDYVDLFLIHFPIAFKFVPIEEKYPPGFYCGDGDNFHYEDVPLLDTWKALEKLVEAGKIKSIGISNFTGALIYDLIRGATIKPAVLQIEHHPYLQQPKLIEYVQKAGIAITGYSSFGPQSFLELESKRALNTPTLFEHETIKSIADKHGKSPAQVLLRWATQRNIAVIPKSNNPERLAQNLSVVDFDLTKDDLDNIAKLDIGLRFNDPWDWDNIPIFV

SEQ ID NO: 13661 - protein, 372 aa, Drosophila melanogaster
MTTAQHQHYTVEVGDTNFTIHSRYINLRPIGSGAQGIVCAAYDTITQQNVAIKKLSRPFQNVTHAKRAYREFKLMKLVNHKNIIGLLNAFTPQRNLEEFQDVYLVMELMDANLCQVIQMDLDHDRMSYLLYQMLCGIKHLHSAGIIHRDLKPSNIVVKADCTLKILDFGLARTAGTTFMMTPYVVTRYYRAPEVILGMGYTENVDIWSVGCIMGEMIRGGVLFPETDHIDQWNKIIEQLGTPSPSFMQRLQPTVRNYVENRPRYTGYSFDRLFPDGLFPNDNNQNSRRKASDARNLLSKMLVIDPEQRISVDEALKHEYINVWYDAEEVDAPAPEPYDHSVDEREHTVEQWKELIYEEVMDYEAHNTNNRTR

SEQ ID NO: 13662 - protein, 315 aa, Drosophila melanogaster
MTTAQHQHYTVEVGDTNFTIHSRYINLRPIGSGAQGIVCAAYDTITQQNVAIKKLSRPFQNVTHAKRAYREFKLMKLVNHKNIIGLLNAFTPQRNLEEFQDVYLVMELMDANLCQVIQMDLDHDRMSYLLYQMLCGIKHLHSAGIIHRDLKPSNIVVKADCTLKILDFGLARTAGTTFMMTPYVVTRYYRAPEVILGMGYTENVDIWSVGCIMGEMIRGGVLFPGTDHIDQWNKIIEQLGTPSPSFMQRLQPTVRNYVENRPRYTGYSFDRLFPDGLFPNDNNQNSRRKASDARNLLSKMLVIDPEQRISVDEAL

SEQ ID NO: 13663 - protein, 386 aa, Catharanthus roseus
FLPNSEQERKMKDLNFHAATLSEEESLRELKAFDETKAGVKGIVDTGITKIPRIFIDQPKNLDRISVCRGKSDIKIPVINLNGLSSNSEIRREIVEKIGEASEKYGFFQIVNHGIPQDVMDKMVDGVRKFHEQDDQIKRQYYSRDRFNKNFLYSSNYVLIPGIACNWRDTMECIMNSNQPDPQEFPDVCRDILMKYSNYVRNLGLILFELLSEALGLKPNHLEEMDCAEGLILLGHYYPACPQPELTFGTSKHSDSGFLTILMQDQIGGLQILLENQWIDVPFIPGALVINIADLLQLITNDKFKSVEHRVLANKVGPRISVAVAFGIKTQTQEGVSPRLYGPIKELISEENPPIYKEVTVKDFITIRFAKRFDDSSSLSPFRLNN

SEQ ID NO: 13664 - protein, 382 aa, Catharanthus roseus
SEQERKMKDLNFHAATLSEEESLRELKAFDETKAGVKGIVDTGITKIPRIFIDQPKNLDRISVCRGKSDIKIPVINLNGLSSNSEIRREIVEKIGEASEKYGFFQIVNHGIPQDVMDKMVDGVRKFHEQDDQIKRQYYSRDRFNKNFLYSSNYVLIPGIACNWRDTMECIMNSNQPDPQEFPDVCRDILMKYSNYVRNLGLILFELLSEALGLKPNHLEEMDCAEGLILLGHYYPACPQPELTFGTSKHSDSGFLTILMQDQIGGLQILLENQWIDVPFIPGALVINIADLLQLITNDKFKSVEHRVLANKVGPRISVAVAFGIKTQTQEGVSPRLYGPIKELISEENPPIYKEVTVKDFITIRFAKRFDDSSSLSPFRLNN

SEQ ID NO: 13665 - protein, 360 aa, Rattus norvegicus
MSQERPTFYRQELNKTVWEVPERYQNLSPVGSGAYGSVCAAFDTKTGHRVAVKKLSRPVQPIIHAKRSYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLAQMPKMNFANVFIGANPLAVDLLEKMLVLDSDKRITAAQALAHAYFAQYHDPDDEPVADPYDQSFESRDLLIDEWKSLTYDEVISFVPPPLDQEEMDS

SEQ ID NO: 13666 - protein, 608 aa, Gaeumannomyces graminis var. tritici
MKFLVVSLFALVCGSAALATPANSSVSSSSGQHHPKPHHPHQPLDSGCKNGPKSRNCWGKHSIDTNYYETAPDTGVTREYWLSVEEGICNNDGYKRYCQTFNGSFPGPLIWANWGDNLVIHVTNNMKTNGTAIHWHGLHQRGSVEYDGVPGVTQCPIAPGKSLTYKFRVTQYGTTWYHSHFSLQYTEGLFGPMIFYGPTTANYDEDLGTLFLQDWDHDTAWHGWENVASKGAGPLPANGLINGTNTFDCKNSTDTNCLGGGKKFSATFKKGKKHLIRIINNSADAHFQFSIDGHSLIVVSNDLVPIKPFKTQSVRVSIGQRYDVIVEANAKPGDYWLRSGMSCVPGDTGALRERVTGIIRYDKKSKADPKTTSDVVVDETCSDEDPKKLVPHVALDVTHMGEIVQSDLGFKPNGTPAEGQNWFQWTLNNSSLVLDWHDPTLERIFDRQSIFPTKYNVIKAEPPATAPASKWFTLVIQSNEILLTPLPSHSLTHPIHLHGHDFWVLSQSKAKWDGTPRGFNTKNPARRDTAMLPAGGHLAIAFQLDNPGAWLVHCHIAWHAGQGLSLEFVESQGRIALGMPDHHVFQQTCREWDAVRNKMPFPQHDSGI

SEQ ID NO: 13667 - protein, 578 aa, Gaeumannomyces graminis var. tritici
MVAHHSFMLLSLAALALGSPFGELQQRAEPRIQQRAACAGNTATTRSKWCDFDIKSDYYTGQHPNTGVTREFWLELTDSVKLAPDGVPRYAQAFNGTVPGPTLVMDWGDDVVIHVTNKLTQSINGTSVHWHGLHQKDTVLSDGVVSVTQCPAVPGTTQTYKFKATNYGSSWYHSHFALQAWQGVFGGIIINGPASANYDEDVGMVVLSDWGHKTPDELWHQAETQGPPTLENALINGMNVYGAEGNQTGKRWETSFESGKSYRVRLVNTAIDTHFKFGIDNHTLTVIALDFIPVEPYEATMINIGMGQRVDVIVKADQAAVASDFWMRAIPQSACGTIQMAKNTRAIVHYGASKGVPATTGHTYVDACEDEPLEKLKPIIRIDAEEATYQQLKIATAGVNAKSVFRWYLNSTTMELDWSKPTVSQLANNASVAFSNSNAVMELPEADKWAYVIIQTNFGVAHPVHLHGHDYSVLAQGSGAYQPGVTKLITTNPMRRDTAILPAAGHLVLAFKTDNPGAWLMHCHIGWHTAQGFAMQFVERRSEMFSKNIINNNDIEGLCEPWRTHVGKHNIKLEDSGI

SEQ ID NO: 13668 - protein, 581 aa, Gaeumannomyces graminis var. tritici
MKSFGLIKGLALLAGLVASAPVASRDESLDLFPQLAGLRASTSTRDYESNTPNTGVTRRYNLVVTEVDNYVGGDGLVKSKAMLINNQFPGPIIKADWGDWVEVTVTNRLRTNGTSMHWHGVRMLNNNPNDGANGITECPIPPNASKVYRFRVEQYGTAWYHSHFSGQYGNGVVGTLLFNGPASLPYQEDLGVYPITDWYYRGADEIQFSLIPSPGVPPPSDNILFNGSHVNAQGGGSYNRVKLKPGRRHRLRIINTSVDNTFTVSLVGHQFTVIQTDFVPVNAFTTSQIFLGIGQRYDVTIEANQPVGNDWFNVTFAASGLCGTSLIQKPASIFQYEGASDTALPTNPGPTPTESLCEDLNSWTPVVAKNVPRASFSAVPGNTLEANTNVENWEGRQRVYWEINGSDMNITWDEPTLEYLVKGNMNFPQNFNVFQVPQGNQWSFWIIQNPTVAPHPMHLHGHDFYLLGRSPAQTNPFAGPVRRFNAATDLATLRFDNPVRRDVTMLPANGWIVVAFRTDNPGAWLFHCHIAWHVAQGLSVQFLERVQDIPSAFPLSAIEPTCSQWTAYYATSPHKQHDSGL

SEQ ID NO: 13669 - protein, 438 aa, Streptococcus agalactiae
MAIITDVYAREVLDSRGNPTLEVEVYTESGAFGRGMVPSGASTGEHEAVELRDGDKSRYGGLGTQKAVDNVNNVIAEAIIGYDVRDQQAIDRAMIALDGTPNKGKLGANAILGVSIAVARAAADYLEVPLYSYLGGFNTKVLPTPMMNIINGGSHSDAPIAFQEFMIMPVGAPTFKEALRWGAEVFHALKKILKERGLETAVGDEGGFAPKFEGTEDGVETILKAIEAAGYEAGENGIMIGFDCASSEFYDAERKVYDYSKFEGEGGAVRTAAEQIDYLEELVNKYPIITIEDGMDENDWDGWKALTERLGGRVQLVGDDFFVTNTDYLARGIKEEAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLDKCGR

SEQ ID NO: 13670 - protein, 152 aa, Mus musculus
DINKDKFAKAKELGATECINPQDYSKPIQEVLQEMTDGGVDFSFEVIGRLDTMTSALLSCHAACGVSVVVGVPPNAQNLSMNPMLLLLGRTWKGAIFGGFKSKDSVPKLVADFMAKKFPLDPLITHVLPFEKINEAFDLLRSGKSIRTVLTF

SEQ ID NO: 13671 - protein, 523 aa, Apium graveolens var. dulce
MAGAFNVSGDDSGGSKDVGSPVIFDAVKKPKRNKYAFGCAILASMTSVLLGYDIGVMSGAAIYIKDQLHVSDVKLEIVVGIINFFSLVGSALAGRTSDWIGRRYTMVLAGAIFFVGAILMGFATNYSFLMFGRFVAGIRSRLCPHDCSGVHGRGFFSIISWISYFIPGSFINIGVLLGYVSNYAFSKLPANLGWRFMLGIGAIPSIGLAIGVLGMPESPRWLVMKGRLGEARQVLDKTSDSKEESRLRLSDIKQAAGIPEECNDDIVVMPKRRNDEAVWKELLLHPTPSVRHAFIAGVGLHFFQQSSGIDAGGLYSPRIFEKAGITSTDLKLLATIAVGISKTLFILVATFLLDRIGRRPLLLTSMGGMIISLTLLGTSLAVIATQITQFIGPGHWQSSEVYHTWAVFFWLGPIAWGYSSEVFPLRLRAQGCSIGVAVNRGTSGIISMTFLSLYKAISIAGAFYLFAAIAGVAWIFIFTLLPETQGRSLEEMGLLFGTYFGWRKTLKGLKNREAEEAKNANVI

SEQ ID NO: 13672 - protein, 235 aa, Sandersonia aurantiaca
MSGYLPFDEPNILALYKKIWKANFSFPSWFSSGAKKLIKRILDPNPHTRITIPEILEDEWFKKGYMPPHFQQGEEVNLDDIDAVFNDSKEHLVTEKKEKPESMNAFALISRSQVFDLGNLFEKQRGLIKRETRFTSQCPPNEILSKIEETAKPLGFNVRKHNYKMNLQGDKTGRKGHLSVATEVFEVAPSLHMVELRKTGGDTLEFHKFYKNFSSGLKDIVWKAEALPEQEETRS

SEQ ID NO: 13673 - protein, 492 aa, Encephalitozoon cuniculi
MQESRSKESTLSGDEDKDVHRFLDEFDDKCTCKLLKEMKETLEGLKKSHPNPTNLDEFYRLFERYLRTRHEKIVWEKIRSPKDRIVQYNEIPEPTEKSKELLRKLAILKLNGGLGTTMGCVGPKSAITIKDGKNFIDLVVKQIRYLNSKYKIDVPLILMNSFNTEGMTDKIIFRYDGIKKFSQSKFPRISSETLLPVSPSHGDKGMYPPGHGDLFYSMKNSGMLEELLEGGYEYLFVSNIDNLASTVDLKLLEYFATNELGFLMEVTDKTRADVKGGTLIEYKGALRLLEIAQVPSNKKSEFTSFKKFTIFNTNNLWINLKEMKKKLEEGFFDLDIIENKKALDDETVIQLETAIGSAIKYFPNSCGVVVPRSRFLPVKTCSDLFLVESNLFVEKNGTLQLHPSRVPETCPTVKLIGENFSKIEKYEKCFKGIPDILELEVLTVSGNVLFGKNVVLKGTVIILADEKSKICVPDGSVLEDNIIYGNLPIIDH

SEQ ID NO: 13674 - protein, 157 aa, Encephalitozoon cuniculi
MVTLERYFGGEPRGYFYREKTFVGTDEEYLEAKRSSSTVFVSNISTSVREERIWELFLLCGPVRRVVMGLNRNTLRFCGFCFVEFYSTDSANVAVRYLNGFRLEQSPLAIDKDYGFVDGRQYGRGVFGGRVKTDRMYLEDRHQRDNNKRRKHGRHLR

SEQ ID NO: 13675 - protein, 566 aa, Encephalitozoon cuniculi
MRSEEEMQSCTDSEMEGGEDETSGFMDESAISNPFREREMRGMIGDFEYIEGKWIGSYRFVKQLGTGSSSKVVLGRDVRSGEKVAIKIIPRRVNGGETGDMEMRCDQRVFREVIISSVLNHPHIARLKNFLYSPTHYFLIFEYVKGRQLYDIIISSGPLKEKEGQRYFRQLLSAIDYIHRNSVVHRDLKIENILIDENDNVKLIDFGLSNFYDNKTLLNTFCGSLYFAAPELLQGQRYCGPEIDVWSLGVVLYAILCGCVPFDDEDVQGLQAKIMDADFKFCKTISREAMELIRGMIVAQPSSRMGLSQVIGSEWVNKGQKSRINSYAAKRYPIMKLNEKYIRPISRAIRFQFPNMEREIRRFHKICREEIGTLEQIYWSRRPVVSLYYLVSENLGGDDENEAYTDDGEEEPPQELPEAVHDFVRFMFSKEKGCGPRHVKKEVFLTSTSQDSLCSVKGKDCGLPQVRQTYLKGFFKGIRVKHIGSHNALKKVLLDIFNANNIIYEITEKSYFCSAYHEDLECLFKVSMYFNVLLNEYYLTVTPLNSERKVFRNVYEWISSGLRNRV

SEQ ID NO: 13676 - protein, 258 aa, Encephalitozoon cuniculi
MASKQYEEALQKANLSDMAERYDDMAKEMRLAVTLAHEDKHILNVMARNLFSVAYKNLVSSRRSSWRMLCSERQKLEGKDPSVVHVINEKIKVVEEELLRFCDEVLDIITTYILSLEEAQKNIEYNIFFLKMKGDYYRYKAEVVTGPEHSEVSKHAAESYKEATEKAKTLPPTNPIKLGLALNYSVFHYEILNDSEKACSIAKGAFDEAIKELDTLSEEHYRDSTLIMQLLRDNLTLWTSREEGNVMGDEGKGDPDEN

SEQ ID NO: 13677 - protein, 166 aa, Encephalitozoon cuniculi
MAEVSKKRCEHNSDSQCEGCKANDKACEARDKTKETAGSAKDKTKETAGSAKDKTKETAESAKDKTKETAGSAKDKTKETAESAKDKTKETAGSAKDKTKETAESAKDKTKETAGNVRDNVENKDKNEVYENIKEGGSKAWNKTKEVANSMKDGIKDLANKDEQKK

SEQ ID NO: 13678 - protein, 103 aa, Encephalitozoon cuniculi
MNTQSIGAKGKSKAAKGIAKRHRKQSSLSDSISKPAIRRIARRAGVRRVGGGCFKEINNAAREYIRDTLSIACIYATHAKRKTITCSDILHSLKRMGIKYIGY

SEQ ID NO: 13679 - protein, 408 aa, Encephalitozoon cuniculi
MKSLRIAMVSDFFYLLKGGVETHIKYLSEELIAMGHKVIIITHRAGNLVGCRMVGNIKVYFLDIPVLCRNTTFPSLYSNFPLFKEIFDNEEIEIVHGHQTMSNMCIEGLFHARTLNLKTVITDHSIFEVGPFENIVVNALCRLALKNIDRCICVSYTSKENTHIRTMIPLERIHVIPNAIVSDIFRPSEKKHSGGKVVVVVSRLVFRKGIDLLIGAIPLICKGDRSVRIVIVGDGPMRDGIEQVLDENELYDRVEIIHEVDHERVGEIMRRGDVFLNTSLTETFCITIVEAASCGLHVVSTNVGGIHEILPPDMITFSRITPEDIARKVLEVLGKSGHNPQDYNKRLKNVYSWERVARMTEKVYMEIEKTSLSYRDRRKLYQGVTGFLSRFMITIEYLFLFVLSLRNV

SEQ ID NO: 13680 - protein, 537 aa, Encephalitozoon cuniculi
MSSRRIGSNLQLMTSSLTNESINSCSKLWRLLFPMGENDGRNKLGKTLLDPASGMHKSTSLEFRKEAGQVLMIDDKHASPSEERRSKVGGFQTFVVKIVIPRIDPGPRGAFFTFTNTSIRTEDDPALRFIPYMPGTSGFISLSEFKEMELVKGFCDPGEGDIGQVLRKEHDLGHGKDHRMPEKCGWDDELLMMRKLFCSVCFIFGCKWHSRTEGICIKPVGFEKDMLNAHIEPWGVCGDVCKKMKGLCSDTARNGLERDAYDALCRACEESQGYECIASLLFYFRFRRYVSCKKIREASMVLMGRHRYVVGNKNRSNVDVAAFFTPCDHPGSCTEGNGCTCISNRTNCEMSCLCTECRNFFMGCRCPAKCNSKCACRQASRECTQVCLCKQCGNKDLQMGKAAPTFVAPSRVEGYGLFAKEKMSKGRFVIEYVGEIISNEEAERRGTFYDLRGCSYLFDLYSREGKALYVIDSRFIGNRSRFINHSQRNSNLYAFVLIVNGVRRIGFYASRDICEGEELLFDYKYSEEHKRKHNIAD

SEQ ID NO: 13681 - protein, 150 aa, Encephalitozoon cuniculi
MTAHSTTHSFFMEMAVKEAMRAFDALEVPVGCVVVRNGIVVSKSHNMTNANKSPLDHAEVISIRDADCSNSTFYVTCEPCIMCMGILGRLKGVEVYYGCRNEVFGSETVCGIGIKSTYLPDSRCFEILQRFYTRENVFAPDERRKLKNHQ

SEQ ID NO: 13682 - protein, 300 aa, Encephalitozoon cuniculi
MVVSFRKSEPLKNVTNKIGRRAEKTVLPLTKMEEIVYKQQRVGEASQIVMVDKYSDDVFEYFSTIDKPFVYINDGVSWKMRSLLVDWIIDIHDKLGLCHDTLFLAINFIDRFLSMRSIPSSKLQLVGISALMIACKYEEVVCPALQTLVLLTEKTLTGEDVRKAEKYMLHTLNYDLQYVSPLNFLRKCSKANNYEICSRTVGKYLLELMTLYEEFLRFKGSVRAAAAMYLARKITSQDQCKNLFIMYSGHTKDDIKECFNALVHTISESIPFENIQNKYNTPKFLHAASFVKEYAEKNFK

SEQ ID NO: 13683 - protein, 239 aa, Encephalitozoon cuniculi
MSRIAVMSGKGGVGKSSVSIMLSTVLSEKGRTLLLDFDLCGPSIASGFGAKENVYKGEKGLVPIRVSKNLYILSMALLMKDSDSVIWRGPKKMSVLSMFYESIDGFDNVVFDMPPGISEEHGFLIGKDVGALIITTPQNVSLGDSSKAIDFCASNGIRILGLVENMSGYCCECCGSSVNIFGSKGGERLAEETGIPFVCRLPIDSLLCEALDEGRFVERCGSIEAYMKFRKAVLGLADI

SEQ ID NO: 13684 - protein, 295 aa, Encephalitozoon cuniculi
MMSMRLATGSEFVVKLFQILEEPENYPYISWMPDGRSFVISDQQGFSEFVLEKHFRHKNWSSFVRQLNKYDFYKVRRDGERTGCIEAMWEYRNKHFQRGKHELLSKIRRKKAPSEGCGAGGTNPKQIESGIVYQSHVLDTVRSISKYLQTVVEDINEIKKYIYHERMRIALKTSVLFVREGVPGSEWVYGALKIPNYSLTVVEESADVGSIMRWRYDVVVLYANSPRCITAVSRIRDEDEEVPIVLVVDEGFKSEYANILGIRATEALLMPFDPSELVDAINRHGSQRSPEGVHG

SEQ ID NO: 13685 - protein, 334 aa, Encephalitozoon cuniculi
MSSAELEVLEYLNGHKDEVKGLKIVRVSGREILYSSSRDKKVFSWDLHSKIDSEFGKILKLYDGGHSKRINGLDVSKDGNMMVTVGSDGIGRIWDTESKKSILLEGHGRDVLCVSINSNDTKIVTGSVDRTMNLYNTKGDLVLKMGRDMEMMHRGWINCVTFHPTEESILASGSADGTVKIWDLDTQEHLQTYLGGAYVDYEKAKEKKTSPVDYDESKSVTAMAFSKDGSILTYGEKSGKMYLVKVDSKECIQSFDAIVPVRSIAVGETEPVIALGTDESVIIWETISSRVIASYNLKEIGNGVRCLSLAFSGSTLYCGLSTGAIVPLELRKSD

SEQ ID NO: 13686 - protein, 559 aa, Encephalitozoon cuniculi
MNEVENNNHSFPREDIPTEDEIEEEANSRQGILRYFRVARAEYTKFALLGLMFGIIGFIYSFMRILKDMFVMVRQEPTTILFIKIFYILPVSMALVFLIQYMLGTKTVSRIFSIFCGGFASLFFLCGAVFLIEEQVSPSKFLFRDMFIDGKMSSRSLNVFKSMFLTLNEPLATIVFISAEMWGSLVLSYLFLSFLNESCTIRQFSRFIPPLIIITNVSLFLSATVAGAFFKLREKLAFQQNQVLLSGIFIFQGFLVVLVIFLKIYLERVTMKRPLFIVSSGSRRKKAKANVSFSEGLEIMSQSKLLLAMSLIVLFFNISYNMVESTFKVGVKVAAEYFNEEKGKYSGKFNRIDQYMTSVVVICLNLSPFSSYVETRGFLLVGLITPIVTLMAIVLFLGSALYNTSMEESGLGIVNGLFPGGKPLYVLENYFGVIFMSLLKITKYSAFDICKEKLGMRINPTYRARFKSVYDGIFGKLGKSIGSIYGLLMFEALDTEDLRKATPITAGIIFIFIVMWVKAIIYLSRSYESAVQHNRDVDIDMTEKAKKSLETPEEPKVVD

SEQ ID NO: 13687 - protein, 370 aa, Encephalitozoon cuniculi
MEGEETNSGNILAEHQLKYCSQILTRLKRNSNAPPFLEPVDPVKLGIPDYPEKIKHPMDLSTIRKKLDSKEYEGPEGFDGDMRLMFSNCYTYNPPGTVVHEMGKGLEAVYTDLMAGMPQEIPKKRKKTEMPAVGRPKQVKRNVKGSDGMKAEDYEFCSETLSDLVKPKHKAYNWPFLEPVDGDLVPGYYSVIKEPMDLQTMRSKLEQRRYQSVEEFGRDLELIVENCKKFNAPGTEVYVCGQEFEKAVKMHMQKVSPHDIKSRITELKRKVMSYSREIRMLESKLMEQTGEMPTSRAYSLNERVSIGNAILNMSKEQTESVAKIVLKNGAGEFVENDEIEVDMRTIPDHVVEEIDMYIKSINVGEDVRDE

SEQ ID NO: 13688 - protein, 296 aa, Encephalitozoon cuniculi
MTESFQKLEKIGEGTYGVVYKARERNTNRVVALKKIRLENENEGIPATTIREILLLKNLKHSTIVELSDVIYNNNKMYLVFEYVELDLRRYLDRMSDEGRLVEEGFVRKMSQQLLTAMEYCHSRNIFHRDLKPQNILVDPKENIKLADFGLGRAAGIPLRTYTTEVVTLWYRPPELLLGCKYYDASVDVWSAACIMAEVVLMRPFFPGDSEIDQLFRIFKVLGTPNNSRWSNVENFPNYKVEFPVWDPVDLKTIFRGDPDFVDLISKMLEYDPKMRMTAKNGLSHKYFEGMPLIME

SEQ ID NO: 13689 - protein, 319 aa, Encephalitozoon cuniculi
MVVVTVARSNADVNEKKDERYWNYECYTITTGSIEKYQIYQRMGRGKYSEVFEGRKDREKIVIKALKPVRKAKICREVLILRNLSHKNIIKLMDVVVDPESQIYSLIFEYIEHEDYAKIFEKLCYKDIVEYSRQILSALSYCHSMGIIHRDIKPQNMVINQARRELKIIDWGLAEFYHPKKEYSVRVASRYYKGPELLVDYPYYDYSLDIWSFGCVLAELVFKKRPFFHGESNSDQLVKIARILGYTHLKKYVRKYKMAPLNPKYEGVGERVLLSSFTPPGKTGLYTNAIDLLEKILIYDHQDRPTADECLRHPLFESR

SEQ ID NO: 13690 - protein, 624 aa, Actinidia chinensis
MPPGMEFHHIVPHEGDMDGETEGNEDQPTSPDPPIWPEIVRFFTNPLKPMILALARPDPKKNLATLVEAFGECRPLRELANLTLIMGNRGDVDEMSSTNSSVLLSILKLIDKYDLYGQVAYPKHHKQSDVPDTYRLAAKTKGVFINPAVIEPFGLTLIEAAAYGLPIVATKNGGPVDIHRALDNGLLVDPHDQKSIADALLKLVADKQLWSKCRQNGLKNIYLFSWPEHCKTYLSRIAACKLRQSWWQRSDDGDENSESDSPSDSLRDISLNLKFSLDGEKNEGSGNADSSLEFEDRKIKLENAVLTWSKGFQKGTQKAGVTEKADTNITAGKFPVLRRRKNIIVIAVDFGAISDYSDSIRKIFDAVEKERTEGSIGFILATSFTLSEVHSFLISGGLSPSDFDAFICNSGSDLYYSSLNSEDNPFVVDLYYHSHIEYRWGGEGLRKTLIRWTGSINDKKGENEEQIVTEDEKISTNYCYAFKVRNAGKVPPVKEIRKLMRIQAHRCHVIYCQNGNKINVIPVLASRSQALRYLYLRWGVDLSKMVVFVGESGDTDYEGLLGGIHKSVILKGVCSGPTNQLHANRTYPLSDVLPIDSPNIVQAAEECSSADLRTSLLKLGFIKG

SEQ ID NO: 13691 - protein, 1156 aa, Actinidia chinensis
  unsure (1)..(1156): unsure at all Xaa locations
MAGNDWINSYLEAILDVGPGIDDAKSSLLLRERGRFSPTRYFVEQVIGFDETDLYRSWVKAAATRSPQERNTRLENMCWRIWNLARQKKQLEGEEAQRMAKRRLERERGRREATADMSEDLSEGEKGDTVSDLSAHGESNRGRLPRISSVETMEAWVSQQKGKRLYIVLISLHGLIRGENMELGRDSDTGGQVKYVVELAXALGSMPGVYRVDLLTXQVSSPEVDWSYGEPTEMLPPRNSDVLMDEMGESSGAYIIRIPFGPRDKYVPKELLWPHVPEFVDGALNHIIQMSKVLGEQIGSGHPVWPVAIHGHYADAGDAAALLSGALNVPMLFTGHSLGRDKLEQLLRQSRLSKDEINKTYKIMRRIEAEELSLDASEIVITSTRQEIEQQWRLYDGFDPVLERKLRARIRRNVSCYGRFMPRMVVIPPGMEFHHIVPHEGDMDGETEGNEDQPTSPDPPIWPEIMRFFTNPRKPMILALARPDPKKNLTTLVEAFGECRPLRELANLTLIMGNRDDVDEMSSTNSSVLLSILKLIDKYDLYGQVAYPKHHKQSDVPDIYRLAAKTKGVFINPAFIEPFGLTLIEAAAYGLPIVATKNGGPVDIHRALDNGLLVDPHDRQSIADALLKLVADKQLWAKCRQNGLKNIHLFSWPEHCKTYLSRIAACKLRQPWWQRSDDGNENSESDSPSDSWRDIQDISLNLKFSLDGEKNEGSGNADSSLDFEDRKSKLENAVLTWSKGVQKGTQKAGLTEKADQNSTAGKFPALRRRKNIVVIAMDFGAISDLSESIRKIFDAMAKERTEGSIGFILATSFTLSEVQSFLISGGLSPSDFDAFICNSGSDLYYSSLNSEDNPFVVDLYYHSHIEYRWGGEGLRKTLIRWAGSITDKKGENEEQIVTEDEKISTNYCYAFKVQNAGKVPPVKEIRKLMRIQALRCHVIYCQNGNKINVIPVLASRSQALRYLYLRWGVDLSKMVVFVGESGDTDYEGLLGGIHKSVILKGVCSGPTHQLHANRTYPLSDVLPIDSPNIVQAAEECSGADLRTSLGKLEFIKGQKFCTIALRVSLSMVVIWSFLNASRSLTFFGKYIHHHSWKCPEACVWFLHENLVTIHSFVFLPVSLDQKSILRWFCWHIESNLSCTSIVIFVLERIMEPYRVK

SEQ ID NO: 13692 - protein, 655 aa, Actinidia chinensis
DGFDPVLERKLRARIRRNVSCYGRFMPRMVVIPPGVEFHHIVPHEGDMDGETEGNEDQPTSPDPPIWPEIMRFFTNPRKQMILALARPDPKNNLTTLVEAFGECRPLRELANLTLIMGNRDDVTEMSSTNSSVLLSILELIDKYDLYGQVAYLKHHKQSDVPDIYRLAAKTKGVFINPAFIEPFGLTLIEAAAYGLPIVATKNGGPVDIHWALDSGFLVDPHDRQSIADALLKLVVDKQLWAKCRQNGLKNIHLFSWREHCKTYLSRIAACKLRQPWWQRSDDGNENSESDSPSDSWRDIQDISLNLKFSLDGEMNEGTGNADSSFEFEDRKRKLEKAVLTWSVQKSTQKSGLTEKADQDSTAGKFPPLRRKNIIVIAVDFGAISDLSESIRKIFDAVAKERTEGSIGFVLATSFTLSEVQSFLISGGLSPSDFDAFICNSGSDIYYSSLNPEDNPFVVDLYYHSHIEYRWGGEGLRKTLIRWAGSITDKKGENEEQIVTEDEKISTNYCYAFKVRSAGKVPPVKEIRKLMRIQALRCHVIYCQNGNKINVIPVLASRSQALRYLYLRWGVDLSKMVVFVGETGDTDYEGLLGGIHKSVILKGVCSGPTHQLHANRTYPLSDVLPIDSPNIVQAAEKCSGADLRTSLGKLGFIKC

SEQ ID NO: 13693 - protein, 182 aa, Actinidia chinensis
TRQISSPEVDWSYGEPTEMLTAGADDDADVGESSGAYIVRIPFGPRDKYMRKELLWPYIQEFVDGALAHILNMSKALGEQIGGGQPVWPYVIHGHYADAGDSAALLSGALNVPMVLTGHSLGRNKLEQLLKQGRQSKEDINSTYKIMRRIEAEELSLDVAELVITSTKQEIDEQWGLYDGFD

SEQ ID NO: 13694 - protein, 197 aa, Actinidia deliciosa
MPGVYRVDLFTRQISSPEVDWSYGEPTEMLTAGADDDADVGESSGAYIVRIPFGPRDKYMRKELLWPYIQEFVDGALAHILNMSKALGEQIGGGQPVWPYVIHGHYADAGDSAALLSGALNVPMVLTGHSLGRNKLEQLLKQGRQSKEDINSTYKIMRRIEAEELSLDVAELVITSTKQEIDEQWGLYDGFDVKLEK

SEQ ID NO: 13695 - protein, 467 aa, Desulfovibrio gigas
MLPPAIASRWAAPNGYRDVLRISLPMIASMGAHTVMLTTDRFFLSQHSLEAIAASWPAGMANFAFMALFMGTAQYVNVFIAQYVGSEAPARVGAAVWQGVWFCLAAGLLMACTALLARPIFSLAGHEPMVLQMEVEYFQILSVGAIFGLLQNTLSCFYSGQGLTRPVMYVNIAGALVNVPLDYCFIFGVGPFPAWGVAGAAVATVIGAMVSAGLFALLVFSRENERRFGTRSQWRLDRELMRRFLRYGLPGGTQFGVEILAFTVFLFLAGRLGTEALAATNMAISINTVGFLPMVGLHIALSTMVGQAIGGGSPAMARRAIRSGLHLALLWTSFAVAVYVLLPEPLIAIFLDPDSPGAPAVLALGVELMRFVSAYAFFDALILVFFAALKGAGDTVFIMRSIIVVALGAMIIPGVAVVEWLDGNIYFLWSLLTAYVAILGVGGVLRYRGGKWQGMRVVETAAQVVDT

SEQ ID NO: 13696 - protein, 948 aa, Oryza sativa (japonica cultivar-group)
SLDKRSQSSEVLLKRKKLRVATDMESPLSNDGVRSPPKSCKRYAENTLSSTPRLLKADSPRNHDVFSRENSFKSSNKGSIKSPDNAPMRSQAVNSSVTLPRSYSLGNLANVKTPGPSPRGLLSKQPSFNNSSNEPKVKQLAEPVLSKLKPSKHSPRDPRESIRKVMKSGPLKHEASICKGSSSSKQKQSVHSSQNEQPRILKPVKPTILLERGASFNLQKPNISSSPRPDSSIKSGDPRNDQDSPRPGPSILKSSKKPGIVENKHSSILSKSDEQGITSTGVVCSKDTCVVKASDPLIPMDKIKNDSTDGACESPLILVNNDNEMSTKPEVLSIPRASKTCGSDFQDIAPTSSSEDLPPEEVQYEQKVVESDGNISCKSAAAIQASEDLLPESPQGCLVAQNPYSPDTKSNDLNLKQQALVDQSSTVGSSLGALVIPEQSYIWQGTFEVSRPGSSPEMYDGFQAHLSTCASLKVLEIVKQLPQRIQLVEVPRHSSWPLQFKEVKPNEDNIALYFFAKDVESYERAYGKLLENMLAGDLSLTANICGIELLIFTSDKLPERTQRWNGLLFFWGVLYARKASSSTELLVKGMNHSPLEQINGPVNQLVCSPKMPQSLGIDLNECPVDELYDPAVSVQTEMENRGASVNHETLLRSNHEAERLNLCEIHFPETAGTGKILLGTPTAVPYGVHVHTSSKRECLNIKPEYPSDIIGSEGTAGRDNMEEEESFTKNGVPCFTKQHTGATTRSVSDEILANTQARVSFQEVSPQHSVRPKLSDDPSDSVLKDFVLPDSSSIYKRQKTSEGKYSTCSFGDGQLTSKCLSKIPLPADQHTSLDDVQYIGRVPADPCSPTKPILDHVIHVLSSDDEDSPEPRNNLNKTSLKEEEGPSPLLSLSLSMASKKHNLTGSDTGDDGPLSLSLGLPGVVTSNQALEMKQFLPEKPGMNTSLLL

SEQ ID NO: 13697 - protein, 473 aa, Bacillus megaterium
MKQNRNSLYIFSITLVAAIGGLLFGYDTAVISGAEESLKVYLIDSLGLGSLAHGVTVSSALIGCIIGGLVSGYFATKLGRKQSLILAAILFIVSALGASYPEFLFFTKGEPTLSLLLAFNFYRIIGGIGVGLASAICPIYIGEIAPADIRGRLVSFNQFMIIFGMLVVYFVNWGIANGETLEWINDVGWRYMFASGAIPALLFAALLFLVPETPRYLAIQNQDQKALAILTKINGSSEAKAILEDIKQTISTNVSSEKLLAYGKLVIVVGILLSVFQQFVGINVALYYAPRIFESMGAAKGSSMLQTIIMGLVNVIFTVIAILTVDRLGRKPLLITGSIGMAIGMFGVASMAFSNIIGIGTLVFIIIYTASFMMSWGPICWVLISEIFPNKIRGRAVAIAVAAQWAANYFISSTYPVMMEYSGGLTYGFYGLMSVLSALFVWKFVPETKGRTLEQMENMWRKKQGASKSKKAI

SEQ ID NO: 13698 - protein, 775 aa, Paramecium tetraurelia
MLLQILLLCLINCQYEPVLIARFGRSKNKLEKNPAPQFECVDEINEDEEKPKEYSIKVGTLYQLTDGTWYLKSTDPASGQTYLMNLNDITRVKYVPKEEEDDNKKKKTEDRPEQVLKEFEWTPLIAYESFPRNRGGHSMHAIGDIIVVFGGCFLDIKCFDDLFLFDARTRVWTSPRVFGIPPVGRTGFGALVNGAKLFIFGGSTLQGLTNDLFVFDLESKSWNQLFWPGIVPTPRAGHKMVLTAIGGIVFGGFMGERYSNDVYVLDILNEQWLKPVVSGDIPIGRESFSMVSHHGVVYVFGGYATGTVLDDVYTINEDLTWEKKEPAGKVPSPRQGAALAEYDHRIFVAGGCNPKTFECYNDLYAFDTTTNHFSTVNAFKKKNLKSVEFAGMAFAGQLLIHFGGCKLDKTCSDSLTAVLLNSNEYCPPCRNGGVCRVGHCSCQQGWQGIDCTMKVLCRQNCLGQGTCLSNGYCRCYPGFTGTVCQLQIPCPSNCTDAEHGECQLDGKCKCKEGFSGSTCGEDPKEEDKKEEEICKNKCNRHGKCNYYTGLCECEYGFSGPDCSVVSSSDDYKSIWQLLKDDDNEPETGTTNVNMQDFIATGHKFKKQQTYQMSSEDEGEEDVYDENQDQENVFKRTRRSQTKSLQSNDQNMTNYQLTMVPPKAQKEEDPYQLMLLSECHKRCSEHGVCIEHVCYCWFGYSGDHCQASKIGDFYLGWRKKKVMIACLISLLVGMLMGYGVVMLMRKRGNDDEFRNMSEVPSQKIDDNEGEVDEIIV

SEQ ID NO: 13699 - protein, 544 aa, Homo sapiens
MCTVVDPRIVRRYLLRRQLGQGAYGIVWKAVDRRTGEVVAIKKIFDAFRDKTDAQRTFREITLLQEFGDHPNIISLLDVIRAENDRDIYLVFEFMDTDLNAVIRKGGLLQDVHVRSIFYQLLRATRFLHSGHVVHRDQKPSNVLLDANCTVKLCDFGLARSLGDLPEGPEDQAVTEYVATRWYRAPEVLLSSHRYTLGVDMWSLGCILGEMLRGRPLFPGTSTLHQLELILETIPPPSEEDLLALGSGCRASVLHQLGSRPRQTLDALLPPDTSPEALDLLRRLLVFAPDKRLSATQALQHPYVQRFHCPSDEWAREADVRPRAHEGVQLSVPEYRSRVYQMILECGGSSGTSREKGPEGVSPSQAHLHKPRADPQLPSRTPVQGPRPRPQSSPGHDPAEHESPRAAKNVPRQNSAPLLQTALLGNGERPPGAKEAPPLTLSLVKPSGRGAAPSLTSQAAAQVANQALIRGDWNRGGGVRVASVQQVPPRLPPEARPGRRMFSTSALQGAQGGARALLGGYSQAYGTVCHSALGHLPLLEGHHV

SEQ ID NO: 13700 - protein, 263 aa, Equine herpesvirus 1
MGGLMGGLMGGLMGGLMGGLMGGLMGGLMGGLMGGLMGGLMGGLMGGLMGGLMGGLMGGLMGGLMGGLMGGLMGGLMGGLMGGLMGGLMGGLMGGLMGGLMGGLMGGLMGGLMGGLMGGLMGGLMGGLMGGLMGGLMGGLMGGLMVPAPPLPAPPLPAPPLPAPPLPAPPLPAPPLPAPPLPAPPLPAPPLPAPPLPAPPLPAPPLPAPPLPAPPLPAPPLPAPPLPAPPLPLRHYRLRHYRTPPLPLPATPLPVTSQEVTSL

SEQ ID NO: 13701 - protein, 540 aa, Homo sapiens
MSVLFFYIMRYKQSDPENPDNDRFVLAKRLSFVDVATGWLGQGLGVACGMAYTGKYFDRASYRVFCLMSDGESSEGSVWEAMAFASYYSLDNLVATFDVNRLGHSGALPAEHCINIYQRRCEAFGWNTYVVDGRDVEALCQVFWQASQVKHKPTAVVAKTFKGRGTPSIEDAESWHAKPMPRERADAIIKLIESQIQTSRNLDPQPPIEDSPEVNITDVRMTSPPDYRVGDKIATRKACGLALAKLGYANNRVVVLDGDTRYSTFSEIFNKEYPERFIECFMAEQNMVSVALGCASRGRTIAFASTFAAFLTRAFDHIRIGGLAESNINIIGSHCGVSVGDDGASQMALEDIAMFRTIPKCTIFYPTDAVSTEHAVALAANAKGMCFIRTTRPETMVIYTPQERFEIGQAKVLRHCVSDKVTVIGAGITVYEALAAADELSKQDIFIRVIDLFTIKPLDVATIVSSAKATEGRIITVEDHYPQGGIGEAVCAAVSMDPDIQVHSLAVSGVPQSGKSEELLDMYGISARHIIVAVKCMLLN

SEQ ID NO: 13702 - protein, 370 aa, Vibrio cholerae
MKVLHVYRTCYPETKGGVEQVIRFIASGTKPLGIETKILTLSDNQTSSYYCEGTEIISVKKSIEISSNGFSWKLIRQFKKLSKWADIIHYHYPWPTGDFLSLFGSSNPSIVTYHSDIIRQKCLKKLYQPLESHFLNQANILVATSPQYAHTSENLLRHKNKVKIIPLAVDENTYPIPSNDNINKWREKVGEGFFLFVGVLRYYKGLDFLLEAAKINQLPVIIAGDGPERVKLESYIAKHNLENVKLVGFISEEDKVILHLLSKAFVFPSHLRSEAFGISLIEAQMYCKAIISSDIGTGSSYVNINGETGLVVPPADSQSFSDAMLKIEHDTKLCEKLGINARKRFEQEFTAHRYAQSYTKLYSELFGNVC

SEQ ID NO: 13703 - protein, 574 aa, Aspergillus fumigatus
MSDPVDAADLVAVAQAHAPKQSLEVVPVKEHETRVVATARRLDDQGREIPTEEEEHTLRRVAGKVHWTAYTIAFVELCERFSYYGTTAVCTCQLHSAASPRWFEHWSRVCLTLAIVNTFWCYLMPILGAYIADEFWGRLKTIQVSIAFAMVGHIILIISALPSVIAHPHGALGCFAVGLVIFGIGVGGFKSNIAPLIAEQHKETRSFIKVIPKTGERVIVDPAQTITRIFLYFYFMINVGALVGSIAMVYAEKYVGFWLAFLLPTIMFAFCPAVIFACRNKYEVTPATGSVSAKAFKLWAFALQGRWSWNPVRLVQNKPEWMTFDDQWVDEVRRAVKACAVFLWYPVYWLAYGQMTNNLTSQAATMQLNGVPNDLINNLDPLALIIFIPIMDQFIYPGIRRMGFNFTPLKRIYVGYFLASMSMIAAAVTQYYIYKMSPCGDHPSDCDKPAPINVWVQTLPYVLIAFSEIFTSITGYEYAFTKAPKNMKSLVQSIYLFMNAISSAIQQGLTALSTDPLLIWNYGFVAVLAFVAGNLFYLTHYSLDKEEDRLNNLEASAYLGTNPGARDEKIDPEP

SEQ ID NO: 13704 - protein, 607 aa, Gaeumannomyces graminis var. graminis
MKFLIVSLFALVCGSAALATPVNSSVSAWSGQHHPKPHHPHQPPHSGCKNGPKSRNCWGKHSIDTNYYETAPDTGVTREYWLSVEEGICNNDGYKRYCQTFNGSFPGPLIWANWGDNLVIHVTNNMKTNGTSIHWHGLHQRGSVEYDGVPGVTQCPIAPGKSLTYKFRVTQYGTTWYHSHFSLQYAEGLFGPMIFYGPTTANYDEDLGTLFLQDWDHGTAWHGWDNVASKGAGPLPANGLINGTNTFDCKNSTDTNCVGGGKKFSANFKKGKKHLIRIINNSADAHFQFSIDGHDLTVVANDLVPIKPFKTKSVRVSIGQRYDVIVEANAKPGNYWLRSGMSCVPGDTGALRKRVTGIIRYDKKSKADPKTTSDVVVDETCSDEDPKKLVPHLALDVTHTGEIVRSDLGFKPNGTPAEGQNWFQWTLNNSSLVLDWHDPTLERIFDGQSIFPTDYNVIKADCQLWPQQAMVHTGDSEQRPPTDPLPSHRLAHPIHLHGHDFWVLSQSKAKWDGTPRGFDTKNPARRDTAMLPEKGHLAIAFQLDNPGAWLVHCHIAWHAGQGLSLEFVESQDRIALGMPNHDVFRQTCREWDAVRTKMPFPQHDSGI

SEQ ID NO: 13705 - protein, 578 aa, Gaeumannomyces graminis var. graminis
MVAHHSFTLLSLAALALGSPLGELQQRAEPRIQQRATCAGNTATTRSQWCDFDIKSDYYTGQHPNTGVTREFWLELTDSVKLAPDGVPRYVQAFNGTVPGPTLVMDWGDDVVIHVTNKLTQSINGTSVHWHGLHQKDTVLSDGVVSVTQCPSVPGTTQTYKFKATNYGSSWYHSHFALQAWQGVFGGIIINGPASANYDEDVGMVVLSDWGHKTPDELWHQAESQGPPTLENALINGMNVYGAEGNQTGKRWETSFEAGKSYRFRIVNTAIDTHFKFGIDNHTLTVIALDFIPVEPYETTMVNIGMGQRVDVIVKADQAAVASDFWLRAIPQSACGTIEMAKNTRAIVHYGNSQGVPSTTGHTYVDACEDEPLEKLKPIIRIDAEQSTYEQLKIATAGVNGNGVFRWYLNSTTMELDWSNPTVSQLASNATVAFSNSNAVMELPEADKWAYVIIQTDFGVAHPIHLHGHDYSVLAQGSGAYQPGVTKLITTNPMRRDTAILPAAGHLVLAFKTDNPGAWLMHCHIGWHTAQGFAMQFVERRSEMFSKNIINNNDIEGLCEPWRTHVGKHNIKLEDSGI

SEQ ID NO: 13706 - protein, 447 aa, Xenopus laevis
MAFPGSGRSIPGQLCAGVFSGLIQPPLGQKFYCPNGGGAVPSPLPQALSAPQCNGEGRDPEPDRPIGYGAFGVVWSVTDPRDGKRVALKKMPNVFQNLVSCKRVFRELKMLCFFKHDNVLSALDILQPPQIDCFEEIYVITELMQTDLHKVIVSPQPLSSDHIKVFLYQILRGLKYLHSAGILHRDIKPGNLLVNSNCVLKICDFGLARVEELDESQHMTQEVVTQYYRAPEILMGSRHYRSAIDIWSVGCIFAELLGRRILFQAQSPIQQLDLITDLLGTPPLTAMRSACEGARAHILRGPHKPPSLSVLYMLSGEATHEAVHLLCRMLLFDPLKRISAKDALAHPYLEEGRLRYHTCMCHCCYSVSSGRVYTADFEPTATNRFDDSYEKSLTSVWQVKELVHRFITDQHQGKRPPLCINPHSAAFKTFIRSTAWHSSKVSKKEER

SEQ ID NO: 13707 - protein, 738 aa, Asterina pectinifera
MPLHQLADPWQKVAVKEQAEGKSSEEMLVDSTNETEDQEMREINITSMAAEGLQKSDPSQFELLKVLGQGSFGKVFLVRKVFGEDSGTLYAMKVLKKATLKVRDRMRTKMERNILVDVNHPFIVKLHYAFQTEGKLYLILDFLRGGDLFTRLSKEVMFTEDDAKLYPAELALALDHLHSLGIIYRDLKPENILLDASGHIKLTDFGLSKESVDNSKTYSFCGTVEYMAPEVVNRRGHTTAADWWSFGVLMFEMLTGALPFQGQHRKETMAMIPKAKLGMPQFLSPEAQSLLRQLFKRNPANRLGAAENGVEDIKKHAFFAHIDFEKLLRKEISPPFKPAVSNADDTFYFDTEFTSRTPKDSPGLPPSASAHQLFRGFSYIAPVLLQEDEMKAATNNTHTQPAKETLPVKHARVTSIAEEYELQDVIGLGSFSKCLRCLHKSSGQQYAVKIIKKGKKEVQEEIEVMLRYGHHPNIITLRDVYDDGQNVYMVMELMKGGELLDKILKKKCLSEREACEIMHVVTKTVDYLHQQRVVHRDLKPSNILYADDSGNPSSLRISDFGFAKQMRADNGMLMTPCYTANFVAPEVLKRQGYDAACDIWSLGVLLYTMLAGYTPFAHGPEDSAEIILARIGEGKFPLNGGNWDHVSPMAEELVRWMLHVDPFKRPSAAKVLQHPWMQHCESLSQNRLTTQDYDLVKGAMKATYLALNNQPKVENLEPVTSSMLAQRRKLKKLSSTTL

SEQ ID NO: 13708 - protein, 770 aa, Arabidopsis thaliana
MVAPALLPELWTEILVPICAVIGIAFSLFQWYVVSRVKLTSDLGASSSGGANNGKNGYGDYLIEEEEGVNDQSVVAKCAEIQTAISEGATSFLFTEYKYVGVFMIFFAAVIFVFLGSVEGFSTDNKPCTYDTTRTCKPALATAAFSTIAFVLGAVTSVLSGFLGMKIATYANARTTLEARKGVGKAFIVAFRSGAVMGFLLAASGLLVLYITINVFKIYYGDDWEGLFEAITGYGLGGSSMALFGRVGGGIYTKAADVGADLVGKIERNIPEDDPRNPAVIADNVGDNVGDIAGMGSDLFGSYAEASCAALVVASISSFGINHDFTAMCYPLLISSMGILVCLITTLFATDFFEIKLVKEIEPALKNQLIISTVIMTVGIAIVSWVGLPTSFTIFNFGTQKVVKNWQLFLCVCVGLWAGLIIGFVTEYYTSNAYSPVQDVADSCRTGAATNVIFGLALGYKSVIIPIFAIAISIFVSFSFAAMYGVAVAALGMLSTIATGLAIDAYGPISDNAGGIAEMAGMSHRIRERTDALDAAGNTTAAIGKGFAIGSAALVSLALFGAFVSRAGIHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIATSASNTGGAWDNAKKYIEAGVSEHAKSLGPKGSEPHKAAVIGDTIGDPLKDTSGPSLNILIKLMAVESLVFAPFFATHGGILFKYF

SEQ ID NO: 13709 - protein, 263 aa, Prunus ilicifolia
AHYKTEVDVGNAIAEAIRSGLVKREELFITSKASNHGHVVEACKNSLEKLQLDYLDLYLVHYPLATKHSGVGTTASLLDENKVLDIDVTVSLESTWHDMEKTVSLGLVRSIGLSNYELFLTRDCLSYAKIKPQVSQFETHPYFQRESLVRFCKKHGVTPMAHTPLGGATANVKSFGSISPLEDPVLLGLAKKYKKSVAQIALRWNIERDTPVIPKSSKVERLKENLEVLNFKLEKEDIELINTIDKKSRTTLPSKTWGLDVYA

SEQ ID NO: 13710 - protein, 250 aa, Prunus andersonii
LKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVNAFGSISPLEDPVLIGLAKKYQKSVAQIALRWNIERGTPVIPKSSKVERLKENLEVLNFKLEKEDIELINTIDKKSRTTL

SEQ ID NO: 13711 - protein, 251 aa, Prunus andersonii
AHYKSEADVGNAIAEAIQRGLVKREELFITSKASNHGHVVEACKNSLKKLQLDYLDLYLVHYPLATKHSVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVNAFGSISPLEDPVLIGLAKKYQKSVAQIALRWNIERGTPVIPKSSKVERLKENLEVLNFKLEKEDIELINTIDKKSRTTL

SEQ ID NO: 13712 - protein, 252 aa, Prunus mexicana
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNLERGTPVIPKSSKVERLKENLEILNFKLEKEDIELINTIDKKSRTTL

SEQ ID NO: 13713 - protein, 251 aa, Prunus fasciculata
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCQKHGVVPMAHTPLGGATANVKAFGSISPLEDPVLIGLAKKYQKSVAQIALRWNIERGTPVIPKSSKVERLKENLEVLNFKLEKEDIELINTTDKKSRPL

SEQ ID NO: 13714 - protein, 252 aa, Prunus fasciculata
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCQKHGVVPMAHTPLGGATANVKAFGSISPLEDPVLIGLAKKYQKSVAQIALRWNIERGTPVIPKSSKVERLKENLEVLNFKLEKEDIELINTIDKKSRTTL

SEQ ID NO: 13715 - protein, 252 aa, Prunus subcordata
AHYKSEADVGNAIAEAIHSGLVKREELFITSKASNHGHVVEACKSSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNIERGTPVIPKSSKVERLKENLEILNFKLEKEDIELINTIDKKSRTTL

SEQ ID NO: 13716 - protein, 252 aa, Prunus besseyi
AHYKSEADVGNAIAEAIQSGLVKREELFITSKASNHGHVVEACKNSLKKLQLDYLDLYLVHYPLATKHSGVGTTASLLGENKVLDIDVTVSLETTWHDMEKTVDLGLVRSIGLSNYELFLTRDCLSYAKIKPQVSQFETHPYFQRESLVRFCKKHGVVPMAHTPLGGATANVNAFGSISPLEDPVLIGLAKKYQKSVAQIALRWNIERGTPVIPKSSKVERLKGNLEILNFKLEKEDIELINSIDKKSRTTL

SEQ ID NO: 13717 - protein, 252 aa, Prunus salicina
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVIPMAHTPLGGATANVKAFGSISPLEDPVLIGLAKKYQKSVAQIALRWNLERGTPVIPKSSKVERLKENLEILNFKLEKEDIELINTIDKKSRTTL

SEQ ID NO: 13718 - protein, 252 aa, Prunus armeniaca
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYKRSVAQIALRWNLERGTPVIPKSSKVERLKENLEILNFKLEKEDIELINTIDKKSRTTL

SEQ ID NO: 13719 - protein, 220 aa, Prunus emarginata
  unsure (1)..(220): unsure at all Xaa locations
NAIAEAIQSGLVKREELFITSKASNHGHVVEACKSSLKKLQLDYLDLYLVHYPLATKHSGVGTTASLLDENKVLDIDVTVSLETTWHDMEKTVSLGLVRSIGLXNYELFLTRDCLSYAKIKPQVSQFETHPYFQRESLVRFCKKHGVIPMAHTPLGGATANVKAFGSISPLEDPVLLGLAKKYQKSVAQIALRWNIERDTPVIPKSSKIERLKENLEILN

SEQ ID NO: 13720 - protein, 252 aa, Prunus fremontii
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVNAFGSISPLEDPVLIGLAKKYQKSVAQIALRWNIERGTPVIPKSSKVERLKENLEVLNFKLEKEDIELINTIDKKSRTTL

SEQ ID NO: 13721 - protein, 252 aa, Prunus dulcis
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCKKHGVVPMAHTPLGGATANVKAFGSISPLEDPVLIGLAKKHQKSVAQFALRWNLERGTPVIPKSSKVERLKENLEVLNFKLEKEDIELINTIDKKFRTTL

SEQ ID NO: 13722 - protein, 233 aa, Prunus persica
NAIAEAIQSGLVKREELFITSKASNHGHVVEACKNSLKKLQLDYLDLYLVHYPLATKHSGVGTTASLLDENKVLDIDVTVSLETTWHDMEKTVSLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNIERGTPVIPKSSKVERLKENLEVLNFKLEKEDIELINT

SEQ ID NO: 13723 - protein, 252 aa, Prunus maritima
AHYTSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSMAQIALRWNLERGTPVIPKSSKVERLKENLEILNFKLEKEDIELINTIDKKSRTTL

SEQ ID NO: 13724 - protein, 231 aa, Prunus maritima
  unsure (1)..(231): unsure at all Xaa locations
NAIAEXXQSGLVKREELFITSKASNHGHVVEACKNSLKKLQLDYLDLYLVHYPLATKHSGVGTTASLLDENKVLDIDVTVSLETTWHDMEKTVDLGLVCSIGFSNYELFLTRDCLSYAKIKPQVSQFETHPYFQRESLVRFCKKHGVVPMAHTPLGGATANVKAFGSISPLEDPVLIGLAKKYQKSVAQIALRWNLERGTPVIPKSSKVERLKENLEILNFKLEKEDIELI

SEQ ID NO: 13725 - protein, 252 aa, Prunus maritima
AHYKSEADVGNAIAEAIQSGLVKREELFITSKASNHGHVVEACKNSLKKLQLDYLDLYLVHYPLATKHSGVGTTASLLDENKVLDIGVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNLERGTPVIPKSSKVERLKENLEILNFKLEKEDIELINTIDKKSRTTL

SEQ ID NO: 13726 - protein, 252 aa, Prunus maritima
AHYKSEADVGNTIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNLERGIPVIPKSSKVERLKENLEILNFKLEKEDIELINTIDKKSRTTL

SEQ ID NO: 13727 - protein, 231 aa, Prunus maritima
AHYKSEADVGNAIAEAIQSGLVKREELFITSKASNHGHVVEACKNSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATASVKAFGSISPLEDPVLIGLAKKYQKSVAQIALRWNLERGTPVIPKSSKVERLKENLEILNF

SEQ ID NO: 13728 - protein, 252 aa, Prunus takesimensis
  unsure (1)..(252): unsure at all Xaa locations
AHYKSEADVGNAIAEAIXSGLVKREELFITSKASNHGHVVEACKNSLKKLQLDYLDLYLVHYPLATKHNGVGATASLLDENKVLDIDVTVSLETTWHDMEKTVSLGLVRSIGLSNYELFLTRDCLSYAKIKPQVSQFETHPYFQRESLVRFCKKHGVIPMAHTPLGGATANVKAFGSISPLEDPVLLALAKKYQKSVAQIALRWNLERDTPVIPKSSKVERLKENLEVLNFKLEKEDIELINTIDKKSRTTL

SEQ ID NO: 13729 - protein, 252 aa, Prunus fruticosa
VDYKSEADVGNAIAEAIQSGLVKREELFITSKASNHGHVVEACKNSLKKLQLDYLDLYLVHYPLATKHNGVGATASLLDENKVLDIDVTVSLETTWHDMEKTVSLGLVRSIGLSNYELFLTRDCLSYAKIKPQVSQFETHPYFQRESLVRFCKKHGVIPMAHTPLGGATANVKAFGSISPLEDPVLLALAKKYQKSVAQIALRWNLERDTPVIPKSSKVERLKENLEVLNFKLEKEDIELINTIDKKSRTTL

SEQ ID NO: 13730 - protein, 238 aa, Prunus tomentosa
AHYKSEADVGNAIAEAIQSGLVKREELFITSKASNHGHVVEACKSSLKKLQLDYLDLYLVHYPLATKHSGVGTTASLLDENKVLDIDVTVSLETTWHDMEKTVDLGLVRSIGLSNYELFLTRDCLSYAKIKPQVSQFETHPYFQRESLVRFCKKHGVVPMAHTPLGGATANVKAFGSISPLEDPVLIGLAKKYQKSVAQIALRWNIERGTPVIPKSSKVERLKENLEILNFKLEKEDI

SEQ ID NO: 13731 - protein, 252 aa, Prunus padus
AHYKSEADVGNAIAEAIQSGLVKREELFITSKASNHGHVVEACKNSLKKLQLDYLDLYLVHYPLATKHNGVGTTASLLDENKVLDIDVTVSLETTWHDMEKTVSLGLVRSIGLSNYELFLTRDCLSYAKIKPQVSQFETHPYFQRESLVRFCKKHGVIPMAHTPLGGATANVKAFGSISPLEDPVLLGLAKKYQKSVAQIALRWNIERGTPVIPKSSKVERLKENLEVLNFKLEKEDIELIDTIDKKSRTTL

SEQ ID NO: 13732 - protein, 252 aa, Prunus caroliniana
AHYKSEADVGNALAEAFETGLVKREELFIISKASNHGHVVEACKDSLKKLQLDYLDLYLVHYPLATKHSGVGTTASLLDKNKVLDIDVTVSLESTWHDMEKTVSLGLVRSIGLSNYELFLTRDCLSYAKIKPQVSQFETHPYFQRETLVRFCRKHGVCPMAHTPLGGATANVKAFGSMSPLEDPVLHGLAKKYKKSVAQIALRWNIERDTPVIPKSSKVERLKENLEVLNFKLEKEDIELINTIDKKSRTTL

SEQ ID NO: 13733 - protein, 223 aa, Prunus caroliniana
  unsure (1)..(223): unsure at all Xaa locations
GLVKREELFITSKASNHGHVVEACKNSLKKLQLDYLDLYLVHYPLATKHSGVGTTASLLDXNKVLDIDVTVSLETTWHDMEKTVSLGLVRSIGLSNYELFLTRDCLSYAKIKPQVSQFETHPYFQRESLVKFCKKHGVTPMAHTPLGGATANVKSFGSISPLEDPVLLGLAKKYKKSVAQIALRWNIXRDTPVIPKSSKVERLKENLEVLNFKLGKEDIELIN

SEQ ID NO: 13734 - protein, 251 aa, Prunus laurocerasus
AHYKSEADVGNAIAEAIQRGLVKREELFITSKASNHGHVVEACKNSLKKLRLDYLDLYLVHYPLATKHSGVGTTASLLDENKVLDIDVTVSLESTWHDMEKTVSLGLVRSIGLSNYELFLTRDCLSYAKIKPQVSQFETHPYFQRETLVRFCRKHGVCPMAHTPLGGATANVKAFGSISPLEDPVLRALAKKYKKSVAQIALRWNLDRNTPVIPKSSKIERLKENLEVLNFKLEKEDIELINSIDKNPGPL

SEQ ID NO: 13735 - protein, 254 aa, Oemleria cerasiformis
SEADVGQAFAEAFKTGLVKREELFITSKANHGHVVEACKNSLKKLQLDYLDLYLVHYPLATKHSGVGTTASLLDENKVLDIDVTVSLEETWRGMEKAVSLGLTRSIGLSNYELFLTRDCLSYAKIKPAVSQFETHPYFQRESLVRFCQKHGVVATAHTPLGGATANTKYFGSISPLGDPVLHDVAKKYQKSVAQICLRWNIERNTPVIPKSSKVERLKENLQVLEFKLEKEDIELINGIDKKSRSTLPSLSWGL

SEQ ID NO: 13736 - protein, 264 aa, Sorbus aucuparia
AHYKSEADVGEALTEAFKTGLVKREELFITTKIWNSDHGHVVEACKNSLEKLQLDYLDLYLVHYPMPTRHNAIGKTASLLGEDKVLDIDVTVSLQQTWEGMEKAVSLGLVRSIGLSNYDLFLTRDCLAYSKIKPAVSQFETHPYFQRDSLIKFCIKHGVLPTAHTPLGGAAANKDMFGSVSPLDDPVLNDVAKKYGKSVAQICLRWGIQRKTAVIPKSSKIQRLKENLEVLEFQLSDEDMQLIYSIDRKYRTSLPSKTWGLDVS

SEQ ID NO: 13737 - protein, 265 aa, Kageneckia oblonga
AHYKSEADVGEALAEAFKSGLVKREELFITTKIWNSDHRYVAEACKNSLEKLQLQYLDLYLVHYPLPTRHNAIGKTASLLGEDKVLDIDVTIPLQQTWEGMEKTVALGLVRSIGLSNYDLFLTRDCLAYSKIKPAVSQFETHPYFQRDSLVKFCMKHGVLPTAHTPLGGAAANKDMFGSVSPLDDPVLNDVAKKYGKSVAQICLRWGIQRKTAVIPKSSKIQRLKENLEVLEFQLSDEDMQLIYSIDKKYRTSLPSKTWGLDVYA

SEQ ID NO: 13738 - protein, 265 aa, Vauquelinia californica
AHYKSEADVGEALAEAFKTGLVKREELFITTKIWNSDHGHVVEACKNSLEKLQLDYLDLYLVHYPMPTRHNAIGKTASLLGEDKVLDIDVTISLHTTWEGMKKAVSLGLVRSIGLSNYDLFLTRDCLAYSKIKPAVSQFETHPYFQRDSLVKFCMKHGVLPTAHTPLGGAAANKDMFGSVSPLDDPVLNDVAKKYGKSVAQICLRWGIQRKTAVIPKSSKIQRLKENLEVLKFQLSDEDMQLIHGIDRKYRTSLPSKTWGLDVYA

SEQ ID NO: 13739 - protein, 265 aa, Amelanchier alnifolia
AHYKSEADVGEALAEAFNTGLVKREELFITTKIWNSDHGHVVEACKNSLEKLQLDYLDLYLVHYPMPTRHNAIGKTASLLGEDKVLDIDVTISLQQTWEGMEKAVTLGLVRNMGLSNYDLFLTRDCLAYSKIKPAVSQFETHPYFQRDSLVKFCIKHGVLPTAHTPLGGAAANKDMFGSVSPLDDPVLNDVAKKYGKSVAQICLRWGIQRKTAVIPKSSKIQRLKENLEVLEFQLSNEDMQLINGIDRKYRTSLPSKTWGLDVYA

SEQ ID NO: 13740 - protein, 265 aa, Amelanchier alnifolia
AHYKSEADVGEALAEAFNTGLVKREELFITTKIWNSDHGHVVEACKNSLEKLQLDYLDLYLVHYPMPTRHNAIGKTASLLGEDKVLDIDVTNFLQQTWEGMEKAATLGLIRNIGLSNYDLFLIRDCLAYSKIKPAVSQFETHPYFQRDSLVKFCIKHGVLPTAHTPLGGAAANKDMFGSVSPLDDPVLNDVAKKYGKSVAQICLRWGIQRKTAVIPKSSKIQRLKENLEVLEFQLSNEDMQLINGIDRKYRTSLPSKTWGLDVYA

SEQ ID NO: 13741 - protein, 265 aa, Gillenia stipulata
AHYKSEADVGEVLAEAFKTGLVKREELFITTKIWNSDHGHVVEACKNSLEKLQLDYLDLYLVHYPMPTKHNGVGKTASLLGEDKVLDIDVTISLQQTWEGMEKTVSLGLVRSIGLSNYELFLTRDCLAYSKIKPAVSQFETHPYFQRDSLVKFCLKHGVLPTAHTPLGGAAANKDMFGSVSPLDDPVLNDVANKYGKSVAQICLRWGIQRKTAVIPKSSKIQRLKENLEVLEFQLSEEDMQLIYSIDRKYRISLPSKTWGLDVYA

SEQ ID NO: 13742 - protein, 227 aa, Spiraea cantoniensis
HGHEVEACKNSLQKLQLDYLDLYLVHYPLATRHRVGTTASLLDENKVLDIDVTVSLESTWRGMEKAVELGLVRSIGLSNYELFLTRDCLSYAKIKPAVSQFETHPYYQRESLVRFCQKHGICATAHTPLGGGTANTKYFGSTSPLGDPVLNEVAKKYKKSVAQICLRWNIDRCTAVIPKSSKVERLKENLQVLDFKLEKEDIELIBTIVRKRRTTLPSLSWGLDVYA

SEQ ID NO: 13743 - protein, 219 aa, Holodiscus microphyllus
WNSDHGHVVEACKNSLKKLQLDYLDLYLVHYPLATKHSVGNTASLLDENKVLDIDVTVSLESTWHAMEKAVKLGLVRSIGLSNYELFLTRDCLSYAKIKPAVSQFETHPYYQRDSLVKFCQKHGVCATAHTPLGGATANTKYFGSVSPLGDPVLNEVAKKYQKSVAQICLRWGIERKTAVIPKSSKPERLKENLQVLEFKLEREDIELINSIDRKYRTS

SEQ ID NO: 13744 - protein, 154 aa, Sorbaria sorbifolia
SIGLSNYELFLTRDCLSYAKIKPAVSQFETHPYYQRETIVRFCQKHGVVPVAHTPLGGATANTKYFGSVSPLGDPVLNELAKKYQKSVAQICLRWNIERNTPVVPKSTKVERLKENFQALDFKLEKEDIDLINTIDRKSRTTLPSLSWGLDVYA

SEQ ID NO: 13745 - protein, 149 aa, Chamaebatiaria millefolium
NYELFLTRDCLSYAKIKPAVSQFETHPYYQRETIVRFCQKHGVCPVAHTPLGGATANTKYFGSVSPLGDPVLNEVAKKYQKSVAQICLRWNIERNTAVVPKSTKVERLKENFQVLDFKLEKEDIDLINTIDRKSRTTLPSLSWGLDVYA

SEQ ID NO: 13746 - protein, 149 aa, Exochorda racemosa
NYELFLTRDCLSYAKIKPAVSQFETHPYYQRESLVRFCQKHGVVAAAHTPLGGATANTKYFGSTSPLGDPVLHDVAKKYQKSVAQICLRWNIERNTPVIPKSSKVERMKENLQVLDFNLEKEDIELINGIDRKSRTTLPSLSWGLDVYA

SEQ ID NO: 13747 - protein, 254 aa, Aedes aegypti
MDFTGKVVLITGASSGIGAATAKHLTHLGATVVMTGRNAESLKKCGAECVGKQKPLILVADVTKQEDNVRVIEETVKKFGKLDVLVNNAGRGVFGSIETTSLDQLDDMLNTNLRGAYHLTILAVPHLIKSKGNIVNVSSITGLKPFPNSLAYCISKAALDQFTRVIALELAPKQVRVNSVDPAVIATDFQNREGMSPAQYAAFVKHSEKTHALGRIGQPREVAEAIAFLATDSASFITGTCLSVDGGRTIMGPI

SEQ ID NO: 13748 - protein, 254 aa, Aedes aegypti
MDFTGKVVLITGASSGIGAATAKHLTHLGATVVMTGRNAESLKKCGAECVGKQKPLILVADVTKQEDNVRVIEETIKKFGKLDVLVNNAGRGVFGSIETTSLDQLDDMLNTNLRGAYHLTILAVPHLIKSKGNIVNVSSITGLKPFPNSLAYCISKAALDQFTRVIALELAPKQVRVNSVNPAVIATDFQNREGMSPAQYAAFVKHSEKTHVLGRIGQPREVAEAIAFLATDSASFITGTCLSVDGGRTIMGPI

SEQ ID NO: 13749 - protein, 497 aa, Mus musculus
MSQDGASQFQEVILQELELSVKKELEKILTTAASHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPIAKDVSYSGENTEAWYPPGHGDIYASFYNSGLLDTFIEEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLGAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 13750 - protein, 487 aa, Skeletonema costatum
MSEVQSGQAEIKKYQTYALNVDPLQDDKATEIKLCNFSRPHMRAFHCSWFCFFTAFFIWFAIAPLMPEIKTTLGLTKQQIWTSNICSVAGTIFMRFVNGPICDKYGARIPMGFILVGASIPCAMTGLVTNAANLSVLRFFIGLGGSTFVMCQYWTSRMFTKEVVGTANALVGGWGNLGGGVTQLIMGSVLFPLFKLGMSAEMAWRTVCIVPAVVGIAVGFIILKISDDAPKGNYNEMKKNGTMAEVSAAASFRAGAMNFNTWLLFVQYACCFGVELTMNNAAALYFREKFLLTTETAAAIASLFGWMNLFARGVGGFVSDKANARMGMRGRIWWQTICLVCEGIMVLIFAHSNSLGAAIVLMVIFSSFVQAAEGSSYGIVPYINPPATGSIAGIVGAGGNTGAVAFGLGFRQLPYYDAFILMGSCIIASGVLSLFICIKGHAGLVTGQDSEEAIAAWKKLGSAPAATTLQVPEPDEDAAAEIEEDKA

SEQ ID NO: 13751 - protein, 445 aa, Thalassiosira weissflogii
KPHMRTFHCSWICFFTAFFIWFAIAPLLPEVKETLGLSKQQVWTSNICSVAGTIFMRFVNGPLCDKYGARILMGAMLFLASIPCALTGLVQNSAQLCVLRFFIGLGGSTFVMCQYWSSRMFTKEVAGTANAIVGGWGNLGGGVTQLIMGSVLFPLFKTGMSAEQAWRTVCIVPAVVGMTLGILVTKISDDAPKGNYSEMKKNGTMPEVSAAASFRTGTLNVNTWLLFIQYACCFGVELTMNNAAASYFKSTFELTTESAAAIASIFGWMNLFARGLGGFFSDKLNSKMGMRGRLIVQTICLVAEGVLVFVFANTPQLWAAILVMVFFSMFVQAAEGSTYGIVPYVNPPATGSIAGIVGAGGNTGAVCFGLGFRQLEAKPAFYLMGGCIVASGVLSLFICIKGHAGLVTGQDNPEVIAAYKKTAGAASATIQVPEPDAEAAEEMEK

SEQ ID NO: 13752 - protein, 342 aa, Oryzias latipes
MAAEKAEMDALKKECDALRTQIEAARKAANDGSMSAAAGGVASVGRVQLKLRKNLKGHLAKIYAMHWSADSRSMVSASQDGKLLVWDTFTGNKLVAVPLKSAWVMSVDFAPSGNLVASGGLDNICTVYNIKAASPKTLRELDAHTGYLSCCRFLSDSEILTASGDTTCCLWDLETGKQKIIFTNHIGDCMSLALSPDMNYFISGACDSLAKLWDVREGACKQTFSGHTSDINAIAFFPSGNAVITGSDDCSCKMYDLRADQEVLDYTDSSLNAGVTSLALSNSGRLIFAGYDDFNCHIWDSLKGEKVGVLSGHDNRVSCTGVPEDGMGVCTGSWDSFLKLWN

SEQ ID NO: 13753 - protein, 467 aa, Zea mays
AEPSTSAPESGEKFSWRDHWYPVSLVEDLDPSRPTPFQLLNRDLVIWKEPKSGEWVALDDRCPHRLAPLSEGRIDETGCLQCSYHGWSFDGSGACTKIPQAMPEGPEARAVRSPKACAIKFPTLVSQGLLFVWPDENGWEKAAATKPPMLPKEFEDPAFSTVTIQRDLFYGYDTLMENVSDPSHIEFAHHKVTGRRDRARPLTFRMESSGAWGYSGANSGNPRITATFEAPCYALNKIEIDTKLPIFGDQKWVIWICSFNIPMAPGKTRSIVCSARNFFQFTMPGKAWWQLVPRWYEHWTSNLVYDGDMIVLQGQEKIFLAATKESSTDINQQYTKITFTPTQADRFVLAFRTWLRKFGNSQPEWFGNPTQEALPSTVLSKREMLDRYEQHTLKCSSCKGAYNAFQNLQKVFMGATVVCCAAAGIPPDVQLRLLIGAAALVSAAVAYAFHELQKNFVFVDYVHADID

SEQ ID NO: 13754 - protein, 505 aa, Zea mays
MRATIPALSLLVTPRLPSLAVPLAGGRLREGGRSRTRLRVAAPTSVPGEAAEQAEPSTSAPESGEKFSWRDHWYPVSLVEDLDPSRPTPFQLLNRDLVIWKEPKSGEWVALDDRCPHRLAPLSEGRIDETGCLQCSYHGWSFDGSGACTKIPQAMPEGPEARAVRSPKACAIKFPTLVSQGLLFVWPDENGWEKAAATKPPMLPKEFEDPAFSTVTIQRDLFYGYDTLMENVSDPSHIEFAHHKVTGRRDRARPLTFRMESSGAWGYSGANSGNPRITATFEAPCYALNKIEIDTKLPIFGDQKWVIWICSFNIPMAPGKTRSIVCSARNFFQFTMPGKAWWQLVPRWYEHWTSNLVYDGDMIVLQGQEKIFLAATKESSTDINQQYTKITFTPTQADRFVLACRTWLRKFGNSQPEWFGNPTQEALPSTVLSKREMLDRYEQLSLKCSSCKGAYNAFQNLQKVFMGATVVCCAAAGIPPDVQLRLLIGAAALVSAAIAYAFHEL

SEQ ID NO: 13755 - protein, 539 aa, Arabidopsis thaliana
KNVSSFTLFYFCNNHQIPIQKDSLFISHHKIPIKGLNFSIKIETFPQPFTRGGAAVLYPLRIRRRRSGSKKNTGGDKEEEGSEFKWRDHWYPVSLVEDLVPNVPTPFQLLGRDLVLWFDRNDQKWAAFDDLCPHRLAPLSEGRLDENGHLQCSYHGWSFGGCGSCTRIPQAATSGPEARAVKSPRACAIKFPTMVSQGLLFVWPDENGWDRANSIEPPRLPDDFDKPEFSTVTIQRDLFYGYDTLMENVSDPSHIDFAHHKVTGRRDRAKPLPFKVESSGPWGFQGANDDSPRITAKFVAPCYSMNKIELDAKLPIVGNQKWVIWICSFNIPMAPGKTRSIVCSARNFFQFSVPGPAWWQVVPRWYEHWTSNLVYDGDMIVLQGQEKVFLAKSMESPDYDVNKQYTKLTFTPTQADRFVLAFRNWLRRHGKSQPEWFGSTPSNQPLPSTVLTKRQMLDRFDQHTQVCSSCKGAYNSFQILKKFLVGATVFWAATAGVPSDVQIRLVLAGLSLISAASAYALHEQEKNFVFRDYVHSEIE

SEQ ID NO: 13756 - protein, 439 aa, Brassica rapa
MLLESDGEMSLETTNSPISSGTESCSSFSRLSFDAPPSTTAIIPEEESCLSLKPHRSSDFAYAEILRRRKHSLTFRDFRLMRRIGAGDIGTVYLCRLAGDQEESRSSYFAMKVVDNEALAMKKKMHRAEMEKKILKMLDHPFLPSLYAEFEASHFSCIVMEYCSGGDLHSLRHRQPQHRFSLSSARFYAAEVLVALEYLHMLGIIYRDLKPENILVRSDGHIMLSDFDLSLCSDSIAAVESSSSTPENYPHSSPRRLTRLAKLFNRVLRSKKVQTLEPNRLFVAEPVTARSGSFVGTHEYVAPEVASGGSHGNAVDWWAFGVFLYEIIYGRTPFAAPTNDVILRNIVKRPLSFPTDSPATMFELHARSLISGLLNKDPSTRLGSRRGAAEVKVHPFFKGLNFALIRTMTPPEVPSDVRRPKKSATFGGRSSKPAAFDFF

SEQ ID NO: 13757 - protein, 1100 aa, Oryza sativa (japonica cultivar-group)
MAGNEWINGYLEAILDSGGAAGGGGGGGGGGGGGGGGGGGGGGGGVDPRSPAAGAASPRGPHMNFNPTHYFVEEVVKGVDESDLHRTWIKVVATRNARERSTRLENMCWRIWHLARKKKQACIDLSLSFSFFLVFMLELEGILRISARRKEQEQVRRETSEDLAEDLFEGEKADTVGELAQQDTPMKKKFQRNFSELTVSWSDENKEKKLYIVLISLHGLVRGDNMELGRDSDTGGQVKYVVELARALAMMPGVYRVDLFTRQVSSPEVDWSYGEPTEMLTSGSTDGEGSGESAGAYIVRIPCGPRDKYLRKEALWPYLQEFVDGALAHILNMSKALGEQVSNGKLVLPYVIHGHYADAGDVAALLSGALNVPMVLTGHSLGRNKLEQIMKQGRMSKEEIDSTYKIMRRIEGEELALDAAELVITSTRQEIDEQWGLYDGFDVKLEKVLRARARRGVSCHGRFMPRMVVIPPGMDFSSVVVPEDTSDGDDGKDFEIASPRSLPPIWAEVMRFLTNPHKPMILALSRPDPKKNITTLVKAFGECRPLRELANLILIMGNRDDIDEMSAGNASVLTTVLKLIDKYDLYGSVAFPKHHKQSDVPEIYRLTGKMKGVFINPALVEPFGLTLIEAAAHGLPIVATKNGGPVDIKNALNNGLLVDPHDQHAIADALLKLVADKNLWQECRKNGLRNIQLYSWPEHCRTYLTRIAGCRIRNPRWLMDTPADAAAEEEEALEDSLMDVQDLSLRLSIDGERGSSMNDAPSSDPQDSVQRIMNKIKRSSPADTDGAKIPAEAAATATSGAMNKYPLLRRRRRLFVIAVDCYGDDGSASKRMLQVIQEVFRAVRSDSQMSRISGFALSTAMPLPETLKLLQLGKIPPTDFDALICGSGSEVYYPSTAQCVDAGGRLRPDQDYLLHINHRWSHDGAKQTIAKLAHDGSGTNVEPDVESCNPHCVSFFIKDPNKVRTIDEMRERVRMRGLRCHLMYCRNATRLQVVPLLASRSQALRYLFVRWGLSVGNMYLIVGEHGDTDHEEMLSGLHKTVIIRGVTEKGSEQLVRSSGSYQREDVVPSESPLIAFTKGDLKADEIMRALKEVTKAASGM

SEQ ID NO: 13758 - protein, 482 aa, Oryza sativa (japonica cultivar-group); identical to SEQ ID NO: 4036

SEQ ID NO: 13759 - protein, 420 aa, Oryza sativa (japonica cultivar-group)
MDDAGRASAPAVVTLPATAAATDEPSHDPAALYGEGMWQQMTMSGSGAMQPGPYPERSGEPDCTYYLRTGLCRMKGEYPERMGQPECQYYLKTGTCKFGPTCKFHHPREKAGIAGRVQLNTLGYPLRPSEKECAYYLKTGQCKYGNTCKFHHPELFNAMASSRGSPIYPSVHSSATAGPPYTGTMASWAFPRGSFIPSPRWQNPSNYAPMIVPQGLVQVPSWNSYTGQMMPVSSSESRLQSPGAQQTYGTSQQVDASAGNQGMLSPYRSSSYPVPQYALQRENVFPERPDQPECQYYMKTGDCKFGAVCKFHHPRVRSMPTPDCVLSPVGLPLRPGEELCKFYSRYGICKFGANCKFDHPTMAPPMGVYAYGSASTNVPMIVGIGFSGSWQQGAKDPTDSSGAPPNTHVLGEDPIPYRKI

SEQ ID NO: 13760 - protein, 1294 aa, Oryza sativa (japonica cultivar-group); identical to SEQ ID NO: 1170

SEQ ID NO: 13761 - protein, 222 aa, Lycopersicon esculentum
GKIEIKKIENSTNRQVTYSKRRNGIFKKRKELTVLCDAKISLIMLSSTRKYHEYTSPNTTTKKMIDQYQSALGVDIWSIHYEKMQENLKRLKEINNKLRREIRQRTGEDMSGLNLQELCHLQENITESVAEIRERKYHVIKNQTDTCKKKARNLEEQNGTLVLDLEAKCEDPKYGVVENEGHYHSAVAFANGVHNLYAFRLQPLHPNLQNEGGFGSRDLRLS

SEQ ID NO: 13762 - protein, 114 aa, Oryza sativa (japonica cultivar-group)
MDKGDVAVAVPPSIAGASSSGAKKGKRFEIKKWNAVSLWAWDIVVDNCAICRNHIMDLCIECQANQASATSEECTVAWGVCNHAFHFHCISRWLKTRQVCPLDNSEWEFQKYGH

SEQ ID NO: 13763 - protein, 435 aa, Capsicum annuum
MAGQTVIVSGLNPAAILQSTIGGAPPSTAAAAAENGDTTRKVVPLSKDALQDFMVSIITQKLQGEKKPFYVLDLGEVVSLMDQWNVALPNVRPFYAVKCNPEPSFLSMLAAMGSNFVCASRAEIEYVLSLGISPERIVFANPCKPESDIIFAEKVGVNLTTYDSEDEVYKIKKHHPKCELLLRIKPMNDGNARCPMGPKYGALPEEIEPLLRIAQASRLTVSGVSFHIGSGDADSNAYLGAIAAAKQVFETAAKFGMSKMNVLDIGGGFTSGHQFTTAATAVKSALQQHFSNEPELTIIAEPGRFFAETAFTLATTIIGKRVRGDLREYWINDGLYGSMNCVLYDHATVTATPLACMSNRVNLNCSGSKMFPSTIFGPTCDALDTVLRDYHVPELQVNDWVIFPNMGAYTKAAGSNFNGFNTSAIVTHLAYAYPS

SEQ ID NO: 13764 - protein, 201 aa, Acanthamoeba castellanii
ARDYASAGQIVDDDLHKILVKHLPPGVRLTVVFDSCHSGTAMDLPYVYNENGCIDSPSMASGKKAKKLQKKMMKKQKKMKDGKGKGKGKGKGKHQYAATGGAGGPTLSGQAAKQTMADVIMFSGCRDSQTAADTSFAGMGQTGAMSYALLTVLGKTPKLSYHDLLQQMRYLLNSGQGGRTFTQVPQLSTGRPMDMNAQFIM

SEQ ID NO: 13765 - protein, 794 aa, Homo sapiens
MVAGLTLGKGPESPDGDVSVPERKDEVAGGGGEEEEAEERGRHAQYVGPYRLEKTLGKGQTGLVKLGVHCITGQKVAIKIVNREKLSESVLMKVEREIAILKLIEHPHVLKLHDVYENKKYLYLVLEHVSGGELFDYLVKKGRLTPKEARKFFRQIVSALDFCHSYSICHRDLKPENLLLDEKNNIRIADFGMASLQVGDSLLETSCGSPHYACPEVIKGEKYDGRRADMWSCGVILFALLVGALPFDDDNLRQLLEKVKRGVFHMPHFIPPDCQSLLRGMIEVEPEKRLSLEQIQKHPWYLGGKHEPDPCLEPAPGRRVAMRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGASTGLSSSPLSSPRSPVFSFSPEPGAGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSGGGGIYSVTFTLISGPSRRFKRVVETIQAQLLSTHDQPSVQALADEKNGAQTRPAGAPPRSLQPPPGRPDPELSSSPRRGPPKDKKLLATNGTPLP

SEQ ID NO: 13766 - protein, 373 aa, Homo sapiens
GTAGKVIKCKAAVLWEQKQPFSIEEIEVAPPKTKEVRIKILATGICRTDDHVIKGTMVSKFPVIVGHEATGIVESIGEGVTTVKPGDKVIPLFLPQCRECNACRNPDGNLCIRSDITGRGVLADGTTRFTCKGKPVHHFMNTSTFTEYTVVDESSVAKIDDAAPPEKVCLIGCGFSTGYGAAVKTGKVKPGSTCVVFGLGGVGLSVIMGCKSAGASRIIGIDLNKDKFEKAMAVGATECISPKDSTKPISEVLSEMTGNNVGYTFEVIGHLETMIDALASCHMNYGTSVVVGVPPSAKMLTYDPMLLFTGRTWKGCVFGGLKSRDDVPKLVTEFLAKKFDLDQLITHVLPFKKISEGFELLNSGQSIRTVLTF

SEQ ID NO: 13767 - protein, 350 aa, synthetic construct
  unsure (1)..(350): unsure at all Xaa locations
MGAGASAEEKHSRELEKKLKEDAEKDARTVKLLLLGAGESGKSTIVKQXKIIHQDGYSLEECLEFIAIIYGNTLQSILAIVRAXTTLNIQYGDSARQDDARKLXHXADTIEEGTXPKEXSDIIQRLWKDSGIQACFDRASEYQLNDSAGYYLSDLERLVTPGYVPTEQDVLRSRVKTTGIIETQFSFKDLNFRXFDVGGQRSERKKWIHCFEGVTAIIFCVALSDYDLVLAEDEEXNRXHESXKLFDSICNNKWFTDTSIILFLNKKDLFEEKIKKSPLTICYPEYAGSNTYEEAGNYIKVQFLELNXRRDVKEIYSHXTCATDTQNVKFVFDAVTDIIIKENLKDCGLF

SEQ ID NO: 13768 - protein, 387 aa, Aplysia californica
MRGSHHHHHHGSKVRGKYDGPKINDYDKFYEDIWKKYVPQPVEVKQGSVYDYYDILEELGSGAFGVVHRCVEKATGRVFVAKFINTPYPLDKYTVKNEISIMNQLHHPKLINLHDAFEDKYEMVLILEFLSGGELFDRIAAEDYKMSEAEVINYMRQACEGLKHMHEHSIVHLDIKPENIMCETKKASSVKIIDFGLATKLNPDEIVKVTTATAEFAAPEIVDREPVGFYTDMWAIGVLGYVLLSGLSPFAGEDDLETLQNVKRCDWEFDEDAFSSVSPEAKDFIKNLLQKEPRKRLTVHDALEHPWLKGDHSNLTSRIPSSRYNKIRQKIKEKYADWPAPQPAIGRIANFSSLRKHRPQEYQIYDSYFDRKEAVPRFKLRPSLISS

SEQ ID NO: 13769 - protein, 622 aa, Rattus norvegicus
MDQRQKLQHWIHSCLRKADKNKDNKMNFKELKDFLKELNIQVDDGYARKIFRECDHSQTDSLEDEEIETFYKMLTQRAEIDRAFEEAAGSAETLSVERLVTFLQHQQREEEAGPALALSLIERYEPSETAKAQRQMTKDGFLMYLLSADGNAFSLAHRRVYQDMDQPLSHYLVSSSHNTYLLEDQLTGPSSTEAYIRALCKGCRCLELDCWDGPNQEPIIYHGYTFTSKILFCDVLRAIRDYAFKASPYPVILSLENHCSLEQQRVMARHLRAILGPILLDQPLDGVTTSLPSPEQLKGKILLKGKKLGGLLPAGGENGSEATDVSDEVEAAEMEDEAVRSQVQHKPKEDKLKLVPELSDMIIYCKSVHFGGFSSPGTSGQAFYEMASFSESRALRLLQESGNGFVRHNVSCLSRIYPAGWRTDSSNYSPVEMWNGGCQIVALNFQTPGPEMDVYLGCFQDNGGCGYVLKPAFLRDPNTTFNSRALTQGPWWRPERLRVRIISGQQLPKVNKNKNSIVDPKVIVEIHGVGRDTGSRQTAVITNNGFNPRWDMEFEFEVTVPDLALVRFMVEDYDSSSKNDFIGQSTIPWNSLKQGYRHVHLLSKNGDQHPSATLFVKISIQD

SEQ ID NO: 13770 - protein, 353 aa, Rattus norvegicus
GCTLSAEDKAAVERSKMIDRNLREDGEKAAREVKLLLLGAGESGKSTIVKQMKIIHEAGYSEEECKQYKAVVYSNTIQSIIAIIRAMGRLKIDFGDAARADDARQLFVLAGAAEEGFMTAELAGVIKRLWKDSGVQACFNRSREYQLNDSAAYYLNDLDRIAQPNYIPTQQDVLRTRVKTTGIVETHFTFKDLHFKMFDVGAQRSERKKWIHCFEGVTAIIFCVALSDYDLVLAEDEEMNRMHESMKLFDSICNNKWFTDTSIILFLNKKDLFEEKIKKSPLTICYPEYAGSNTYEEAAAYIQCQFEDLNKRKDTKEIYTHFTCATDTKNVQFVFDAVTDVIIKNNLKDCGLF

SEQ ID NO: 13771 - protein, 260 aa, Homo sapiens
NEVPDYHEDIHTYLREMEVKCKPKVGYMKKQPDITNSMRAILVDWLVEVGEEYKLQNETLHLAVNYIDRFLSSMSVLRGKLQLVGTAAMLLASKFEEIYPPEVAEFVYITDDTYTKKQVLRMEHLVLKVLTFDLAAPTVNQFLTQYFLHQQPANCKVESLAMFLGELSLIDADPYLKYLPSVIAGAAFHLALYTVTGQSWPESLIRKTGYTLESLKPCLMDLHQTYLKAPQHAQQSIREKYKNSKYHGVSLLNPPETLNL

SEQ ID NO: 13772 - protein, 527 aa, Rattus norvegicus
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSVGRQSSAPASPAASAAGLAGQAAKSLLNKKSDGGVKKRKSSSSVHLMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 13773 - protein, 618 aa, Rattus norvegicus
MGERRRRQPEPGAPGGERSLLAAESAASLQGAELERAARRQFQRDETPAFVYAAAAFSALGGFLFGYDTGVVSGAMLLLRRQMRLGAMWQELLVSGAVGAAAVAALAGGALNGALGRRSAILLASALCTVGSAVLAAAANKETLLAGRLVVGLGIGIASMTVPVYIAEVSPPNLRGRLVTINTLFITGGQFFASVVDGAFSYLQKDGWRYMLGLAAIPAVIQFLGFLFLPESPRWLIQKGQTQKARRILSQMRGNQTIDEEYDSIRNSIEEEEKEASAAGPIICRMLSYPPTRRALAVGCGLQMFQQLSGINTIMYYSATILQMSGVEDDRLAIWLASITAFTNFIFTLVGVWLVEKVGRRKLTFGSLAGTTVALTILALGFLLSAQVSPRVTFRPTAPSGQNATCTEYSYCNECMLDPDCGFCYKINSSAVIDSSCVPVNKASTNEAAWGRCENETKFKAEDVHWAYSFCPTPYSWTALVGLVLYLVFFAPGMGPMPWTVNSEIYPLWARSTGNACSAGINWIFNVLVSLTFLHTAEYLTYYGAFFLYAGFAAVGLLFVYGCLPETKGKKLEEIESLFDHRLCTCGTADSDEGRYIEYIRVKGSNYHLSDNDASDVE

SEQ ID NO: 13774 - protein, 135 aa, Trypanosoma cruzi
MATPKQAAKKASKKRSGGRSAKAGLIFPVGRVGSLLRRGQYARRIGASGAVYMAAVLEYLTAELLELSVKAASQQAKKPKRLTPRTVTLAVRHDDDLGMLLKDVTLSRGGVMPSLNKALVKKHKSSKKARATPSA

SEQ ID NO: 13775 - protein, 337 aa, Sus scrofa
TDQAAFDTNIVTLTRFVMEQGRKARGTGEMTQLLNSLCTAVKAISTAVRKAGIAHLYGIAGSTNVTGDQVKKLDVLSNDLVINVLKSSFATCVLVTEEDKNAIIVEPEKRGKYVVCFDPLDGSSNIDCLVSIGTIFGIYRKNSTDEPSEKDALQPGRNLVAAGYALYGSATMLVLAMVNGVNCFMLDPAIGEFILVDRNVKIKKKGSIYSINEGYAKEFDPAITEYIQRKKFPPDNSAPYGAAYVGSMVADVHRTLVYGGIFMYPANKKSPKGKLRLLYECNPMAYVMEKAGGLATTGKEAVLDIVPTDIHQRAPIILGSPEDVTELLEIYQKHAAK

SEQ ID NO: 13776 - protein, 298 aa, Homo sapiens
  unsure (1)..(298): unsure at all Xaa locations
MENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYXHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 13777 - protein, 258 aa, Homo sapiens
VPDYHEDIHTYLREMEVKCKPKVGYMKKQPDITNSMRAILVDWLVEVGEEYKLQNETLHLAVNYIDRFLSSMSVLRGKLQLVGTAAMLLASKFEEIYPPEVAEFVYITDDTYTKKQVLRMEHLVLKVLTFDLAAPTVNQFLTQYFLHQQPANCKVESLAMFLGELSLIDADPYLKYLPSVIAGAAFHLALYTVTGQSWPESLIRKTGYTLESLKPCLMDLHQTYLKAPQHAQQSIREKYKNSKYHGVSLLNPPETLNL

SEQ ID NO: 13778 - protein, 373 aa, Homo sapiens
ANEVIKCKAAVAWEAGKPLSIEEIEVAPPKAHEVRIKIIATAVCHTDAYTLSGADPEGCFPVILGHEGAGIVESVGEGVTKLKAGDTVIPLYIPQCGECKFCLNPKTNLCQKIRVTQGKGLMPDGTSRFTCKGKTILHYMGTSTFSEYTVVADISVAKIDPLAPLDKVCLLGCGISTGYGAAVNTAKLEPGSVCAVFGLGGVGLAVIMGCKVAGASRIIGVDINKDKFARAKEFGATECINPQDFSKPIQEVLIEMTDGGVDYSFECIGNVKVMRAALEACHKGWGVSVVVGVAASGEEIATRPFQLVTGRTWKGTAFGGWKSVESVPKLVSEYMSKKIKVDEFVTHNLSFDEINKAFELMHSGKSIRTVVKI

SEQ ID NO: 13779 - protein, 368 aa, Staphylococcus aureus
MSDNTVKIKKQTIDPTLTLGDVKKQLIEKGKKEGHLSHEEIAEKLQNFDIDSDQMDDFFDQLNDNDISLVNEKDSSDTDEKLNPSDLSAPPGVKINDPVRMYLKEIGRVNLLSAQEEIELAKRIEQGDEVAKSRLAEANLRLVVSIAKRYVGRGMLFLDLIQEGNMGLIKAVEKFDFNKGFKFSTYATWWIRQAITRAIAHQARTIRIPVHMVETINKLIRVQRQLLQDLGRDPAPEEIGEEMDLPAEKVREILKIAQEPVSLETPIGEEDDSHLGDFIEDQEAQSPSDHAAYELLKEQLEDVLDTLTDREENVLRLRFGLDDGRTRTLEEVGKVFGVTRERIRQIEAKALRKLRHPSRSKRLKDFMD

SEQ ID NO: 13780 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGDCRHCKSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 13781 - protein, 379 aa, Arabidopsis thaliana
MSTTGQIIRCKAAVAWEAGKPLVIEEVEVAPPQKHEVRIKILFTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLATGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 13782 - protein, 379 aa, Arabidopsis thaliana
MSTTGQIIRCKAAVAWEAGKPLVIEEVEVAPPQKHEVRIKILFTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 13783 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGECRHCHSEESNMCDLLRINPERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 13784 - protein, 238 aa, Ceratopteris richardii
MVRRKIKIKRIENATTRQVTFSKRRGGLLKKAHDLSVLCDAEVAVIIFSSKGKLFQFANPSMETVLGRYVKASRDPEAGDNGSSTDNVEADRLTVFTEKLKMLQSNVIGDDLERLSLRDLIHLEQQVHESLGHIRAKKDELILEQIDEFKQKMADTRRTTNANTSMLDRLVDFCSSGITGSQNIVESEPGYVVGVPRTDTLRAGWIATSDQSNDGPEYVPCAKRFRITEDLNESPASE

SEQ ID NO: 13785 - protein, 154 aa, Lupinus luteus
MGVLTDVQVALVKSSFEEFNANIPKNTHRFFTLVLEIAPGAKDLFSFLKGSSEVPQNNPDLQAHAGKVFKLTYEAAIQLQVNGAVASDATLKSLGSVHVSKGVVDAHFPVVKEAILKTIKGVVGDKWSEELNTAWTIAYDELAIIIKKEMKDAA

SEQ ID NO: 13786 - protein, 354 aa, Forsythia x intermedia
MAKVVNPRVEILASNGIQSIPKEYVRPQEELESIRDVFEEEMSDEGPQLPTIDLEGLDSDDKQVREKCHQELIKASKEWGVMHLVKHGISDELIDRVKMAGKAFFNQSVEKEKYANDQASGNVQGYGSKLANNASGQLEWQDYFFHCIFPEEKRDLSICPKTPTDYIPAISEYAKQLRDLTSKMLSVLSLGLGLEQGRLEKEVGGMEELLLQLKINYYPKCPQPELALGVEAHTDISALTFILHNMVPGLQLFYKGKWVTAKCVPNSIIMHIGDTIEILSNGKYKSILHRGLVNKEKVRISWAVFCEPPREKILLKPLPETVSEAEPSRFPPRTFAQHVMNKLFRKSEDSGETK

SEQ ID NO: 13787 - protein, 360 aa, Mus musculus
MSQERPTFYRQELNKTIWEVPERYQNLSPVGSGAYGSVCAAFDTKTGHRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHINQLQQIMRMTGTPPAYLINRMPSHEARNYIQSLAQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 13788 - protein, 481 aa, Pseudomonas sp.
MFHVPLLIGGKPCSASDERTFERRSPLTGEVVSRVAAASLEDADAAVAAAQAAFPEWAALAPSERRARLLRAADLLEDRSSEFTAAASETGAAGNWYGFNVYLAAGMLREAAAMTTQIQGDVIPSNVPGSFAMAVRQPCGVVLGIAPWNAPVILGVRAVAMPLACGNTVVLKSSELSPFTHRLIGQVLHDAGLGDGVVNVISNAPQDAPAVVERLIANPAVRRVNFTGSTHVGRIIGELSARHLKPAVLELGGKAPFLVLDDADLDAAVEAAAFGAYFNQGQICMSTERLIVTAVADAFVEKLARKVATLRAGDPNDPQSVLGSLIDANAGQRIQVLVDDALAKGARQVVGGGLDGSIMQPMLLDQVTEEMRLYREESFGPVAVVLRGDGDEELLRLANDSEFGLSAAIFSRDVSRAMELAQRVDSGICHINGPTVHDEAQMPFGGVKSSGYGSFGSRASIEHFTQLRWLTIQNGPRHYPI

SEQ ID NO: 13789 - protein, 574 aa, Mus musculus
MEGERAPLLGSRRPAVSAASAVFAGRRAACGAVLLAELLERAAFYGVTANLVLFLNGAPFDWEGAQASQALLLFMGLTYLGSPFGGWLADARLGRARAILLSLALYLLGLLAFPLLAAPRSRSFLCGDPRPELVRNCSAPFPNGSASCPENAARRCAPATFAGLVLVGLGVATVKANITPFGADQVKDRGPEATRRFFNWFYWSINLGAILSLGGIAYIQQNVSFFTGYLIPTVCVAIAFLVFLCGQSVFITKPPDGSAFTDMFRILTYSCCSQRGGQRRSGEGLGVFQQSSKHSLFDSCKMSRGGPFTEDKVEDVKALVKIVPVFLALIPYWTVYFQMQTTYALQSLHLKIPEISSITTTHHTLPAAWLTMFDAVLILLLIPLKDKLVDPVLRRHGLLPSSLKRIAVGMFFVMCSAFAAGILESKRLDLVKEKTINQTIGGVVYHAADLPIWWQIPQYVLIGISEIFASIAGLEFAYSAAPKSMQSAIMGLFFFFSGIGSFVGSGLLALVSLKAIGWMSSHTDFGNINSCHLHYYFFLLAAIQGATLLLFLIVSVKYDRQRARTDGGPASTRT

SEQ ID NO: 13790 - protein, 374 aa, Mus musculus
MPGAVEGPRWKQAEDIRDIYDFRDVLGTGAFSEVILAEDKRTQKLVAIKCIAKKALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTGSHGELLTPTAGGPAAGCCCRDCCVEPGSELPPAPPPSSRAMD

SEQ ID NO: 13791 - protein, 339 aa, Mus musculus
MVDLHEQVHQGPVPLSYTVTTVTTQGFPLPTSQHIPGCSAQQLPACSVMFSGQHYPLCCLPPPLIQACTMQQLPGPYHTYPHLISSDHYILHPPPPAPPPQPTHMAPLGQFVSLQTQHPRMPLQRLDNEMDLRGDQHPLGSFTYSTSATGPALSPSVPLHYLPHDPLHQELSFGVPYSHMMPRRLSTQRYRLQQPLPPPPPPPPPSYYPSFLPYFLSMLPMSPTTVGPTISLDLDVDDVEMENYEALLNLAERLGDAKPRGLTKADIEQLPSYRFNPDSHQSEQTLCVVCFSDFEVRQLLRVLPCNHEFHAKCVDKWLKANRTCPICRADASEVPREAE

SEQ ID NO: 13792 - protein, 348 aa, Mus musculus
MPHIDNDVKLDFKDVLLRPKRSTLKSRSEVELTRSFSFRNSKQMYSGIPVIAANMDTVGTFEMARVLCKFSLFTAIHKHYSIHQWQEFASQNPDCLECLAASSGTGSADFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYSGGVAEYRASEGKIVEVPFKGDVEHTIRDILGGIRSTCTYVGAAKLKELSRRTTFIRVTQQVNPIFSNSQ

SEQ ID NO: 13793 - protein, 361 aa, Mus musculus
MAAADEPKPKKLKVEAPQALSENVLFGMGNPLLDISAVVDKDFLDKYSLKPNDQILAEDKHKELFDELVKKFKVEYHAGGSTQNSMKVAQWLIQEPHKAATFFGCIGIDKFGEILKRKAADAHVDAHYYEQNEQPTGTCAACITGGNRSLVANLAAANCYKKEKHLDLERNWVLVEKARVYYIAGFFLTVSPESVLKVARYAAENNRVFTLNLSAPFISQFFKEALMDVMPYVDILFGNETEAATFAREQGFETKDIKEIAKKAQALPKVNSKRQRTVIFTQGRDDTIVAAENDVTAFPVLDQNQEEIIDTNGAGDAFVGGFLSQLVSDKPLTECIRAGHYAASVIIRRTGCTFPEKPDFH

SEQ ID NO: 13794 - protein, 465 aa, Mus musculus
MAMTGSTPCSSMSNHTKERVTMTKVTLENFYSNLIAQHEEREMRQKKLEKVMEEEGLKDEEKRLRRSAHARKETEFLRLKRTRLGLEDFESLKVIGRGAFGEVRLVQKKDTGHVYAMKILRKADMLEKEQVGHIRAERDILVEADSLWVVKMFYSFQDKLNLYLIMEFLPGGDMMTLLMKKDTLTEEETQFYIAETVLAIDSIHQLGFIHRDIKPDNLLLDSKGHVKLSDFGLCTGLKKAHRTEFYRNLNHSLPSDFTFQNMNSKRKAETWKRNRRQLAFSTVGTPDYIAPEVFMQTGYNKLCDWWSLGVIMYEMLIGYPPFCSETPQETYKKVMNWKETLTFPPEVPVSEKAKGLILRFCCEWEHRIGAPGVEEIKNNLFFEGVDWEHIRERPAAISIEIKSIDDTSNFDEFPESDILKPTVTTSSHPETDYKNKDWVFINYTYKRFEGLTARGAIPSYMKAAK

SEQ ID NO: 13795 - protein, 504 aa, Mus musculus
MSLICSISNEVPEHPCVSPVSNHVYERRLIEKYIAENGTDPINNQPLSEEQLIDIKVAHPIRPKPPSATSIPAILKALQDEWDAVMLHSFTLRQQLQTTRQELSHALYQHDAACRVIARLTKEVTAAREALATLKPQAGLIVPQAVPSSQPSVVGAGEPMDLGELVGMTPEIIQKLQDKATVLTTERKKRGKTVPEELVKPEELSKYRQVASHVGLHSASIPGILALDLCPSDTNKILTGGADKNVVVFDKSTEQILATLKGHTKKVTSVVFHPSQELVFSASPDATIRIWSVPNTSCVQVVRAHESAVTGLSLHATGDYLLSSSDDQYWAFSDIQTGRVLTKVTDETSGCSLTCAQFHPDGLIFGTGTMDSQIKIWDLKERTNVANFPGHSGPITSIAFSENGYYLATAADDSSVKLWDLRKLKNFKTLQLDNNFEVKSLIFDQSGTYLALGGTDVQIYICKQWTEILHFTEHSGLTTGVAFGHHAKFIASTGMDRSLKFYSL

SEQ ID NO: 13796 - protein, 396 aa, Drosophila melanogaster
MFSRHFAAFFRFNRYVAQKYSSFIAAGFSNRFSLKVATLLPLVVLRSADCRQKEDQEVKYETSLEGRAQLYLNAMKVRWDQLHKVPGLFSYQLEKSPQSRKIPGYWGFYAELNSDRNRKRRRPQTIESLNPTFKHMMFNFNKVDAQEVIMTIDDAHGSPEVQMIINKSPITKYHTLICPEVGKNHTQRITRDALQFCITFMRNIDDKDMRMGYNSPGALASVNHLHFHLLHMPQDLYIDHVPLDELAGGYVYRLSRRAPTEGICIVFNENDSDEQVAEKVDQLYMLAMWMCKNNMPHNLFLTQDRRPGKSGNVKVFVFARSEYCVNKDLAEFNVGFCELAGYIPLPDADKMENLTELQVLFRIRTITGNAPKAVYEQITSMVEGQEHYLWDQPLTI

SEQ ID NO: 13797 - protein, 322 aa, Drosophila melanogaster
MSTPNFLLSNGKNMPMLGLGTWRSPPEVVTQAVKDAIDIGYRHFDCAHIYGNEAQVGAALREKMDEGVVTRDELFITSKLWNTHHKPDLVRPACETSIRNLGVKYLNLYLMHWPMAYKSGSDNLYPTCPDTNKAAFEDIDYVDTWRAMENLVDEGLCQAIGVSNFNEQQMNRLLSVAKLKPVVLQIECHPYLSQKPLITLCYDNAIAVTAYSCLGSGHTPYEKPGAYPLLQHPTILAIAEKYERTAAQVLLRYQTQSGIIVIPRSVSKQHMLDNFKRIWDFELAVDDIQAINELDCNGRFMTMKAAYGHPHHPFEPKAKVDN

SEQ ID NO: 13798 - protein, 260 aa, Drosophila melanogaster
MSVEAGAVKVMALGNRESAEFVSKAFIGTEKEDIFEFIDGDIHEIVLPCGLKKVDIIVSEWVGHSVFVDSLFKEVIFAREKWLVKGGFIIPNVAQLFVCGIADHPRKTVEVNILPQSDYPGRSYMVREPVSLIEDYVAKEQLITEKYLLKTIDLCTAHINDESFRVPFKLRGLRDSQLGAVVLYSDIGLCRPRGKFRLMFSTGPKRPRTYVRQTILFMDNPVEVAKCELVIGELGMYYKPDEHREVEYSFSLGSSTIANP

SEQ ID NO: 13799 - protein, 604 aa, Drosophila melanogaster
MTAANTNKTTDKENDPGPNTSISTTATPPSAAAQNVGGCVGSSGGRSSPKFQSYVNGNGYGVYKIIKTLGKGNFAKVKLAIHLPTGREVAIKLIDKTALNTIARQKLYREVNIMKKLNHPNIVRLLQVIESERTLYLVMEYVSGGELFNYLVKNGRMRERDARVLFRQLVSAIEYCHSKSIVHRDLKAENLLLDQQMKLKIADFGFSTTFEPKAPLETFCGSPPYAAPELFRGKKYSGPEVDSWSLGVVLYTLVSGSLPFDGTNLKELRDRVLRGKYRVPYYVSIECESLIRKFLVLNPTQRTSLSAVMADRWINMGYEQGNGLRPFQEKPMDLHDVNRLSLLSNMGHKPRDVEQSLKNQKFDDIYCTYMLLDVAKPRSTACSEKSGSSFRETPTAMPGSSRIPVPIASPNVTISQVTFALDKSTPNRPGATSIRPMAPRLANALTPLPLTPPPKKYICCSANKAANPRRSEPSSIPQSAMPKKGVGSPVDVKTTLLSAQRKLAVNQKLTSASHQIRSPITQSSSQASECTRTPPTHFEMLDSTSTPLKVLKLVASNSQTPPSTENTNRPTRVGFFSKLSARFVRRSLHKGEKDISEQGRNLTK

SEQ ID NO: 13800 - protein, 351 aa, Drosophila melanogaster
MSVRNSRPQLSWPERVSPQRTIDTPTASGEMLTRRQSAPALVVPPEETTHVVVVKRQSPDAAAAGELVPSRRKDSVAVQSGIVATGPLDTTRSGARDDFLMALLECPVCFGYIMPPIMQCPRGHLICSTCRSKLTICPVCRVFMTNIRSLAMEKVASKLIFPCKHSHFGCRARLSYAEKTKHEEDCECRPYFCPYPDDKCSWQGPLRDVYQHLMSSHENVITMEGNDIIFLATNVNLEGALDWTMVQSCHGRHFLLSLEKINLGEDCQQYFTACRMIGSMKDAAEFVYNISLEAYNRTLRWQSKPRSIRENFSSFTNADFLVLNKHTVELFSEDGNLALNVVIRKVEERTY

SEQ ID NO: 13801 - protein, 180 aa, Drosophila melanogaster
MSRRVFGLSIKSFRLFRRTPIHPPAFQHFSGGVFRTSFRSFCDCQEHRRMDLPEGILMGFGNPLLDITCTVEDNVILEKYGLEANAAIIADEKHDALFDELMNMENVIYSAGGACQNSMRIFQWIVQTPFRAVFIGSVGKDKLGDRIEKRAKSDGLLTLYQLKEELPTGMIKFSKRKIPS

SEQ ID NO: 13802 - protein, 598 aa, Lycopersicon esculentum
MGQCCSKGVSGENGGSVVAIGDGNSAVSTNNRPKPPPSPVRQSVGNGMSYTNNSTPAHSFTASPFQSPYPAGIAPSPSPVGTPRRKFKWPFPPPSPAKPILSAIFKRQGGTSVKPKEGPIPEDEGGEGERQLDKSFGYPKNLTSKYELGKEVGRGHFGHTCWAKGKKGELKNQPVAVKIISKAKMTTAISIEDVRREVKILKALSGHQNLVKFYDAFEDANNVYIVMELCEGGELLDRILSRGGRYTEEDAKSIVVQILNVVAFCHLQGVVHRDLKPENFLFAKKDEDSPMKVIDFGLSDFIKPDQRLNDIVGSAYYVAPEVLHRSYSIEADMWSIGVITYILLCGSRPFWARTESGIFRSVLRADPNFEDSPWPAVSAEARDFVKRLLNKDHRKRMTASQALTHPWLRTENPFVPLDILIFKLVKSYIRTSPLKRAALKALSKALTEEELIYLKAQFNLLEPKAGFVSLDNFRMALMKQTTDAMREARVLDIINLLEPLSYKQMDFEEFCAAAISTYQLEALENWEHIASAAFNYFEQEGNRVISVEELAQEMNLGPTAYAFLKDWIRPSDRKLSFLGYTKFLHGVTMRSSSTRHHR

SEQ ID NO: 13803 - protein, 423 aa, Mus musculus
ASARFSIYMLQKTVLLLALVAQVLMLENGLLRTPPMGWLAWERFRCNIDCVEDPKNCISERLFMEMADRLAQDGWRDLGYVYLNIDDCWIGGRDASGRLIPDPKRFPHGIAFLADYAHSLGLKLGIYEDMGKMTCMGYPGTTLDKVELDAETFAEWKVDMLKLDGCFSSSRERAEGYPKMAAALNATGRPIAFSCSWPAYEGGLPPKVNYTEVSRVCNLWRNYKDIQDSWKSVLSILDWFVRHQDVLQPVAGPGHWNDPDMLLIGNFGLSFDESRAQMALWTVLAAPLLMSTDLRTISPQNMDILQNPLMIKINQDPLGIQGRRILKSKSHIEVFKRYLSNQASALVFFSRRTDMPFRFHCSLLELNYPKGRVYEGQNVFTGDIFSGLQTEVNFTVIINPSGVVMWYLYPIKDLGISTMMSHW

SEQ ID NO: 13804 - protein, 523 aa, Triticum aestivum
MARGGGNGEVELSVGVGGGGGGAAGGGEQPAVDISLGRLILAGMVAGGVQYGWALQLSLLTPYVQTLGLSHALTSFMWLCGPIAGLVVQPCVGLYSDKCTSRWGRRRPFILTGCILICIAVVVVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDLHGYIQHAITASKEIKIVSLALFAFLGIPLAILYSVPFAVTAQLAAKRGGGQGLCTGVLNIAIVIPQVIIAVGAGPWDELFGKGNIPAFGMASAFALIGGIVGIFLLPKISRRQFRAVSGGGH

SEQ ID NO: 13805 - protein, 188 aa, Sorghum bicolor
MGRSPCCEKAHTNKGAWTKEEDQRLVAYIKAHGEGCWRSLPKAAGLLRCGKSCRLRWINYLRPDLKRGNFTQEEDELIIKLHQILGNKWSLIAGRLPGRTDNEIKNYWNTPIQSASSSPAASTHGRTSRRVQAPLLPPPAPPLSPPRQASHSPAWRRQGGGGWCGPTGCSLRDKQAVTMTARSGSFRA

SEQ ID NO: 13806 - protein, 139 aa, Populus tremula x Populus tremuloides
MATRIRLPSILATAVTLTVLAASLTWAAGSPEATFVKKTISSHQIVIFSKSYCPYCKKAKGVFKELNQTPHVVELDQREDGHDIQDAMSEIVGRRTVPQVFIDGKHIGGSDDTVEAYESGELAKLLGVASEQKDDFKLE

SEQ ID NO: 13807 - protein, 359 aa, Sporothrix schenckii
MDSQRQSDVSPEAMQARIQQARREAETLKDRIKRKKDELADTTLRAVAQQAHEPISRNQMMKPKRTLKGHLAKIYAMHWSTDRRHLVSASQDGKLIIWDAYTTNKVHAIPLRSSWVMTCAYAPSGNYVACGGLDNICSIYNLNQNRDGPTRVARELSGHAGYLSCCRFINDRSILTSSGDMTCMKWDIETGTRVVEFADHLGDVMSISLNPTNQNTFISGACDAFAKLWDIRAGKAVQTFAGHESDINAIQFFPDGHSFVTGSDDATCRLFDIRADRELNVYGSESILCGITSVATSVSGRLLFAGYDDFECKVWDVTRGEKVGSLVGHENRVSCLGVSNDGISLCTGSWDSSLKIWAY

SEQ ID NO: 13808 - protein, 255 aa, Rattus norvegicus
QHHELTSLFECPVCFDYVLPPILQCQAGHLVCNQCRQKLSCCPTCRGALTPSIRNLAMEKVASAVLFPCKYATTGCSLTLHHTEKPEHEDICEYRPYSCPCPGASCKWQGSLEAVMSHLMHAHKSITTLQGEDIVFLATDINLPGAVDWVMMQSCFGHHFMLVLEKQEKYEGHQQFFAIVLLIGTRKQAENFAYRLELNGNRRRLTWEATPRSIHDGVAAAIMNSDCLVFDTAIAHLFADNGNLGINVTISTCCQ

SEQ ID NO: 13809 - protein, 490 aa, Corynebacterium glutamicum ATCC 13032
MTINVSELLAKVPTGLLIGDSWVEASDGGTFDVENPATGETIATLASATSEDALAALDAACAVQAEWARMPARERSNILRRGFELVAERAEEFATLMTLEMGKPLAEARGEVTYGNEFLRWFSEEAVRLYGRYGTTPEGNLRMLTALKPVGPCLLITPWNFPLAMATRKVAPAIAAGCVMVLKPARLTPLTSQYFAQTMLDAGLPAGVLNVVSGASASAISNPIMEDDRLRKVSFTGSTPVGQQLLKKAADKVLRTSMELGGNAPFIVFEDADLDLAIEGAMGAKMRNIGEACTAANRFLVHESVADEFGRRFAARLEEQVLGNGLDEGVTVGPLVEEKARDSVASLVDAAVAEGATVLTGGKAGTGAGYFYEPTVLTGVSTDAAILNEEIFGPVAPIVTFQTEEEALRLANSTEYGLASYVFTQDTSRIFRVSDGLEFGLVGVNSGVISNAAAPFGGVKQSGMGREGGLEGIEEYTSVQYIGIRDPYAG

SEQ ID NO: 13810 - protein, 491 aa, Corynebacterium glutamicum ATCC 13032
MASTFIQADSPEKSKKLPPLTEGPYRKRLFYVALVATFGGLLFGYDTGVINGALNPMTRELGLTAFTEGVVTSSLLFGAAAGAMFFGRISDNWGRRKTIISLAVAFFVGTMICVFAPSFAVMVVGRVLLGLAVGGASTVVPVYLAELAPFEIRGSLAGRNELMIVVGQLAAFVINAIIGNVFGHHDGVWRYMLAIAAIPAIALFFGMLRVPESPRWLVERGRIDEARAVLETIRPLERAHAEVADVEHLAREEHAVSEKSMGLREILSSKWLVRILLVGIGLGVAQQLTGINSIMYYGQVVLIEAGFSENAALIANVAPGVIAVVGAFIALWMMDRINRRTTLITGYSLTTISHVLIGIASVAFPVGDPLRPYVILTLVVVFVGSMQTFLNVATWVMLSELFPLAMRGFAIGISVFFLWIANAFLGLFFPTIMEAVGLTGTFFMFAGIGVVALIFIYTQVPETRGRTLEEIDEDVTSGVIFNKDIRKGKVH

SEQ ID NO: 13811 - protein, 488 aa, Corynebacterium glutamicum ATCC 13032
MNSSHGTSSSGASAGAHGALPLEAQKLNGWGRTAPTTAEVLTTPDLDIIVDAVRQVAEQNDSKPDYLKRGVIARGMGRSYGDPAQNAGGLVIDMQPLNKIHSIDPDSAIVDVDGGVTLDQLMKAALPYGLWVPVLPGTRQVTIGGAIGPDIHGKNHHSAGSFGDHVVSMELLVADGRILHLEPEGTAEDPQGDLFWATVGGMGLTGIIVRARIRMTKTETAYFIADTDRTNNLEETVAFHSDGSEHNYTYSSAWFDVISPEPKLGRSTISRGSLATLAQLEELAPKLAKDPLKFNAPQLMKVPDIFPSWTLNKLTLSAVGVAYYAMGAPAKNQVKNLTQFYQPLDLIGEWNRGYGSKGFLQYQFVVPTEAVEPFKDIIRDMQKSGHYSALNVFKLFGPGNRAPLSYPMPGWNVCVDFPIRPGLGAFLDDLDKRVMEFGGRLYLAKESRTSAENFHAMYPGMEGWLKTRNEIDPTGVFASDMSRRLELS

SEQ ID NO: 13812 - protein, 159 aa, Corynebacterium glutamicum ATCC 13032
MGVLPVQARIKDDERRMRHALDIARQTPEGDVPVGAVIYAPTGEILATATNRREADRDPTAHAEIIALRRAARRFSDGWRLSDCTAVVTLEPCSMCAGALVGARIGRIVFGAFEPRTGACGSVFDVVRDPAVLHKVEVSGGILEPECAALMTEFFELHR

SEQ ID NO: 13813 - protein, 368 aa, Corynebacterium glutamicum ATCC 13032
MSTVVPGIVALSKGAPVEKVNVVVPDPGANDVIVKIQACGVCHTDLAYRDGDISDEFPYLLGHEAAGIVEEVGESVTHVEVGDFVILNWRAVCGECRACKKGEPKYCFNTHNASKKMTLEDGTELSPALGIGAFLEKTLVHEGQCTKVNPEEDPAAAGLLGCGIMAGLGAAVNTGDIKRGESVAVFGLGGVGMAAIAGAKIAGASKIIAVDIDEKKLEWAKEFGATHTINSSGLGGEGDASEVVAKVRELTDGFGTDVSIDAVGIMPTWQQAFYSRDHAGRMVMVGVPNLTSRVDVPAIDFYGRGGSVRPAWYGDCLPERDFPTYVDLHLQGRFPLDKFVSERIGLDDVEEAFNTMKAGDVLRSVVEI

SEQ ID NO: 13814 - protein, 418 aa, Corynebacterium glutamicum ATCC 13032
MRVAMISMHTSPLQQPGTGDSGGMNVYILSTATELAKQGIEVDIYTRATRPSQGEIVRVAENLRVINIAAGPYEGLSKEELPTQLAAFTGGMLSFTRREKVTYDLIHSHYWLSGQVGWLLRDLWRIPLIHTAHTLAAVKNSYRDDSDTPESEARRICEQQLVDNADVLAVNTQEEMQDLMHHYDADPDRISVVSPGADVELYSPGNDRATERSRRELGIPLHTKVVAFVGRLQPFKGPQVLIKAVAALFDRDPDRNLRVIICGGPSGPNATPDTYRHMAEELGVEKRIRFLDPRPPSELVAVYRAADIVAVPSFNESFGLVAMEAQASGTPVIAARVGGLPIAVAEGETGLLVDGHSPHAWADALATLLDDDETRIRMGEDAVEHARTFSWAATAAQLSSLYNDAIANENVDGETHHG

SEQ ID NO: 13815 - protein, 453 aa, Corynebacterium glutamicum ATCC 13032
MSLTFPVINPSDGSTITELENHDSTQWMSALSDAVAAGPSWAAKTPRERSVVLTAIFEALTERAQELAEIIHLEAGKSVAEALGEVAYGAEYFRWFAEEAVRLPGRYGQSPSGIGHIAVTRAPVGPVLAITPWNFPIAMATRKIAPALAAGCPVLVKPASETPLTMVKVGEIIASVFDTFNIPQGLVSIITTTRDAELSAELMADPRLAKVTFTGSTNVGRILVRQSADRLLRTSMELGGNAAFVIDEAADLDEAVSGAIAAKLRNAGQVCIAANRFLVHESRAAEFTSKLATAMQNTPIGPVISARQRDRIAALVDEAITDGARLIIGGEVPDGSGFFYPATILADVPAQSRIVHEEIFGPVATIATFTDLAEGVAQANSTEFGLAAYGFSNNVKATQYMAEHLEAGMVGINRGAISDPAAPFGGIGQSGFGREGGTEGIEEYLSVRYLALP

SEQ ID NO: 13816 - protein, 269 aa, Corynebacterium glutamicum ATCC 13032
MTLSLPPIGFGTVHLDGAPGVEAIATAIDAGYRLIDTAYNYENEGTVGKAVRESGVPREELIVTSKLPGRFHARDLGRVRIEESLYRLNLDYIDLLLIHWPNPSKDLYVEAWETLIEVRDAGLVKHIGVSNFLPNHIDRLRRETGELPAVNQIELHPYFPQVEQVDFHDELGIITEAWSPLSNGRGLVEEPLLKEIGERYGVGSGEIALAWHHARGIVPIPRSTNPARQRSNLEAVKISLIDEDVQAITALARKNGRIKDQDPAVYEEF

SEQ ID NO: 13817 - protein, 497 aa, Corynebacterium glutamicum ATCC 13032
MNAATRRASLQLPYTHVDDFYINGSWVKAEGTQRNPVVDPAVGQEWGSVPEATASELDSAVGAARTALKSWSALTGAERTGYLLKIATEIESRSEALALTNTRENGSPISETRGAASNAAGIFRYFATLAPWLDGEDIRPFPAGSAESIVDKDPIGVCALIAPWNFPINLVVIKLAPALLAGCTVIIKPASPTPLSIRFIIEAIEAAGVPAGVVNLLTGSGRFGDALVRHPGVDKVAFTGSTPVGKKIAAACGELLRPVTLELGGKSSAIILPDADMSVLSTRLIRSCMRNTGQTCYISTRIIAPSSRYAEVVQTVASTIAAGRQGDPYDEETVFGPVASASQYSTVMSYIDSAREEGARVVAGGTRSISLSEGLESGEFIQPTVFADVTPDMRISREEIFGPVISILKYDDTNGVSEAIALANNTKFGLGGLVFGADEEQALEVARQVDSGSVGINFFGSNHSAPFGGRHESGMGVEYGIEGLSAYLTYKSIHRTI

SEQ ID NO: 13818 - protein, 248 aa, Corynebacterium glutamicum ATCC 13032
MPSPRTVLITGAAGGLGRAFAEGFAAQGDRIAVADINLDGAQETVDKLKALGADAAAFEVDVTSLESTEALAAGAAEFGGGRIDVLINNAAIYATVTRSPFEDIDPAEWDLVMGVNLKGPWLVTRSVSPFLSDNARVVNLSSATVFSGSAHWAHYVASKGGVIALTRVLAKELGGRGITVNAVAPGFTLTEASLGLMDSAETYGVDRGSIKRASQPKDIVGTTMFLASPEAEYITGQTLIVDGGRQFI

SEQ ID NO: 13819 - protein, 515 aa, Corynebacterium glutamicum ATCC 13032
MSGLVDPDSTFLKTIGKLSNSLSIGRGVDQKEVIPKGWNAHWEAITKLKRSFDAIPAGERVRLAKKTSNLFRGRSDAGHGLDVAALGGVIAIDPVNATADVQGMCTYEDLVDATLSYGLMPLVVPQLKTITLGGAVTGMGVESTSFRNGLPHESVLEMDIFTGTGEIVTCSPTENVDLYRGFPNSYGSLGYAVRLKIELEPVQDYVQLRHVRFNDLESLTKAIEEVASSLEFDNQPVDYLDGVVFSPTEAYLVLGTQTSQPGPTSDYTRDLSYYRSLQHPEGITYDRLTIRDYIWRWDTDWFWCSRAFGTQNPVVRKLWPRDLLRSSFYWKIIGWDRKYSIADRLEERKGRPARERVVQDVEVTIDKLPEFLKWFFESSDIEPLWLCPIKLREVPGSSVGAGEILSSAEAIDSGAAEHPWPLYPLKKDVLWVNIGFWSSVPVDLMGSDAPEGAFNREIERVMAELGGHKSLYSEAFYTREDFEKLYGGTIPALLKKQWDPHSRFPGLYEKTVKGA

SEQ ID NO: 13820 - protein, 506 aa, Corynebacterium glutamicum ATCC 13032
MTTQSRVSTGGDNPNKVALVGLTFDDVLLLPDASDVVPSEVDTSTQLTRNIRLNTPILSAAMDTVTEARMAIGMARHGGIGVLHRNLSIQEQAENVELVKRSESGMVTDPVTCTPDMSIQEVDDLCARFRISGLPVVDEAGKLVGICTNRDMRFESDMNRRVAEVMTPMPLVVAEEGVTKEQALALLSANKVEKLPIIAKDGKLVGLITVKDFVKTEQHPNASKDASGRLLVAAGIGTGEESFQRAGALADAGVDILVVDSAHAHSRGVLDMVSRVKKSFPKVDIVGGNLATREAAQAMIEAGADAIKVGIGPGSICTTRVVAGVGAPQITAIMEAAVPAHKAGVPIIADGGMQFSGDIAKALAAGANSVMLGSMLAGTAEAPGETITINGKQYKRYRGMGSMGAMQGRGLSGEKRSYSKDRYFQSDVKSEDKLVPEGIEGRVPFRGPIGDIIHQQVGGLRAAMGYTGSSTIEELHNARFVQITSAGLKESHPHHIQQTVEAPNYH

SEQ ID NO: 13821 - protein, 374 aa, Corynebacterium glutamicum ATCC 13032
MRDHVEIGIGREARRTYSLDDISVVSSRRTRSSKDVDTTWHIDAYKFDLPFMNHPSDALASPEFVIEMGKQGGLGVINAEGLWGRHADLDEAIAKVIAAYEEGDQAAATRTLQELHAAPLDTELLSERIAQVRDSGEIVAVRVSPQNVREIAPIVIKAGADLLVIQGTLISAEHVNTGGEALNLKEFIGSLDVPVIAGGVNDYTTALHMMRTGAVGIIVGGGENTNSLALGMEVSMATAIADVAAARRDYLDETGGRYVHIIADGSIENSGDVVKAIACGADAVVLGSPLARAEEAAGKGYFWPAVAAHPRFPRGVVTESVDLDEAAPSLEQILHGPSTMPWGVENFEGGLKRALAKCGYTDLKSFQKVSLHVN

SEQ ID NO: 13822 - protein, 478 aa, Corynebacterium glutamicum ATCC 13032
MAQVMDFKVADLSLAEAGRHQIRLAEYEMPGLMQLRKEFADEQPLKGARIAGSIHMTVQTAVLIETLTALGAEVRWASCNIFSTQDEAAAAIVVGSGTVEEPAGVPVFAWKGESLEEYWWCINQIFSWGDELPNMILDDGGDATMAVIRGREYEQAGLVPPAEANDSDEYIAFLGMLREVLAAEPGKWGKIAEAVKGVTEETTTGVHRLYHFAEEGVLPFPAMNVNDAVTKSKFDNKYGTRHSLIDGINRATDMLMGGKNVLVCGYGDVGKGCAEAFDGQGARVKVTEADPINALQALMDGYSVVTVDEAIEDADIVITATGNKDIISFEQMLKMKDHALLGNIGHFDNEIDMHSLLHRDDVTRTTIKPQVDEFTFSTGRSIIVLSEGRLLNLGNATGHPSFVMSNSFADQTIAQIELFQNEGQYENEVYRLPKVLDEKVARIHVEALGGQLTELTKEQAEYIGVDVAGPFKPEHYRY

SEQ ID NO: 13823 - protein, 584 aa, Corynebacterium glutamicum ATCC 13032
MEDAQPEQITATEELAGLLENPTNLEGKLADAEEEIILEGEDTQASLNWSVIVPALVIVLATVVWGIGFKDSFTNFASSALSAVVDNLGWAFILFGTVFVFFIVVIAASKFGTIRLGRIDEAPEFRTVSWISMMFAAGMGIGLMFYGTTEPLTFYRNGVPGHDEHNVGVAMSTTMFHWTLHPWAIYAIVGLAIAYSTFRVGRKQLLSSAFVPLIGEKGAEGWLGKLIDILAIIATVFGTACSLGLGALQIGAGLSAANIIEDPSDWTIVGIVSVLTLAFIFSAISGVGKGIQYLSNANMVLAALLAIFVFVVGPTVSILNLLPGSIGNYLSNFFQMAGRTAMSADGTAGEWLGSWTIFYWAWWISWSPFVGMFLARISRGRSIREFILGVLLVPAGVSTVWFSIFGGTAIVFEQNGESIWGDGAAEEQLFGLLHALPGGQIMGIIAMILLGTFFITSADSASTVMGTMSQHGQLEANKWVTAAWGVATAAIGLTLLLSGGDNALSNLQNVTIVAATPFLFVVIGLMFALVKDLSNDVIYLEYREQQRFNARLARERRVHNEHRKRELAAKRRRERKASGAGKRR

SEQ ID NO: 13824 - protein, 513 aa, Corynebacterium glutamicum ATCC 13032
MLLPELNRRTFFKGAGVLAATVVGAQVLVACSSDDVRGYGGEPRTLPIPPADLGTREGSSVHFALEAQTGESQILPDVTTKTWGFNGTHLGPTLVVKKGDDVHVDVINNLDEMTTVHWHGMKLPAIADGGPHSPIGPGQTWSPTWTVANDAATLWYHPHTHGLTGLHAYRGLAGMIIVEDEATDKLDLPREYGVDDIPLVLMDHRFLEDGSLDEEDLPDLGLLGDTPTANGITNAHFDATTRRVRFRVLNGSNMRFYNLAFSDTRTFQVIASDSGLLDEPQDRTTLAIGPGERWEIVVELEPGEDVTLESVGFEDNYGVPDDEFVPDFGMSDSFQLLTITGPSDDAAQAPALPGVLVKSTEPDVIDATERTFIMNTFSINDLQMDMQRVDVVIDHDQPEVWIVTNDNSDWPHNFHVHDARFKVLKFEGTDVELFNDGWKDTVGLPPGATATLAVEFGHYPDPQWPYMYHCHMLYHEDQGMMGQFVIVEPGDEPAAVLGSGTGSSIDSAGGHAH

SEQ ID NO: 13825 - protein, 425 aa, Corynebacterium glutamicum ATCC 13032
MAEIMHVFAREILDSRGNPTVEAEVFLDDGSHGVAGVPSGASTGVHEAHELRDGGDRYLGKGVLKAVENVNEEIGDELAGLEADDQRLIDEAMIKLDGTANKSRLGANAILGVSMAVAKAAADSAGLPLFRYIGGPNAHVLPVPMMNIINGGAHADSGVDVQEFMIAPIGAETFSEALRNGAEVYHALKSVIKEKGLSTGLGDEGGFAPSVGSTREALDLIVEAIEKAGFTPGKDIALALDVASSEFFKDGTYHFEGGQHSAAEMANVYAELVDAYPIVSIEDPLQEDDWEGYTNLTATIGDKVQIVGDDFFVTNPERLKEGIAKKAANSILVKVNQIGTLTETFDAVDMAHRAGYTSMMSHRSGETEDTTIADLAVALNCGQIKTGAPARSDRVAKYNQLLRIEQLLGDAGVYAGRSAFPRFQG

SEQ ID NO: 13826 - protein, 335 aa, Corynebacterium glutamicum ATCC 13032
MNLKNPETPDRNLAMELVRVTEAAALASGRWVGRGMKNEGDGAAVDAMRQLINSVTMKGVVVIGEGEKDEAPMLYNGEEVGTGFGPEVDIAVDPVDGTTLMAEGRPNAISILAAAERGTMYDPSSVFYMKKIAVGPEAAGKIDIEAPVAHNINAVAKSKGINPSDVTVVVLDRPRHIELIADIRRAGAKVRLISDGDVAGAVAAAQDSNSVDIMMGTGGTPEGIITACAMKCMGGEIQGILAPMNDFERQKAHDAGLVLDQVLHTNDLVSSDNCYFVATGVTNGDMLRGVSYRANGATTRSLVMRAKSGTIRHIESVHQLSKLQEYSVVDYTTAT

SEQ ID NO: 13827 - protein, 267 aa, Corynebacterium glutamicum ATCC 13032
MVATSQFIDDSEAAQAVRAAIVAGYRNIDTALAYGNERGVGEGIRTAGVPREELFISTKLAAEIKDYDGAVAAIDESLAKIGLDYVDLMLIHSPQPWSDFRGGDYSEGNREAWRALEDAYKAGKIRSIGVSNFLEADLENILDSATVAPHVNQLLVHVGNTPSELISFCDSKGILVEAYSPIAHGEMLKNQQVKAIADKYNVSIPQLCIRYTIQLGTVSLPKTANPDHMSSNAQIDFEISEEDMAALQEVTARDYGEHSGFPVYSGK

SEQ ID NO: 13828 - protein, 374 aa, Corynebacterium glutamicum ATCC 13032
MTQVTESAVRSALSRVEDPEIGKPITELGMVKSVSIDGSDVQVEVYLTIAACPMKTTIVTNTEAALKDIDGVGQVHVTTDVMSDEQRRALRVSLRGETSEPVIPFAQPGSTTRVYAVASGKGGVGKSSMTVNLAAALAKRGLSVGILDADIYGHSVPGMLGSDQRPHQVDDMIMPPQAHGVKMISIAHFTEGNAPVVWRGPMLHRAIQQFLTDVFWGDLDILLLDLPPGTGDIAITVAQLIPNAELLIVTTPQAAAAEVAERAGTISVQTNQKVAGVIENMSAMVLPDGTTMDVFGTGGGQKIADRLTAVTGEEVKVIGSVPLDPNLRIGGDVGNPIAISEPHSPTAAAINEIAEHLAHRKVSLVGKTLGLGVK

SEQ ID NO: 13829 - protein, 445 aa, Corynebacterium glutamicum ATCC 13032
MATVENFNELPAHVWPRNAVRQEDGVVTVAGVPLPDLAEEYGTPLFVVDEDDFRSRCRDMATAFGGPGNVHYASKAFLTKTIARWVDEEGLALDIASINELGIALAAGFPASRITAHGNNKGVEFLRALVQNGVGHVVLDSAQELELLDYVAAGEGKIQDVLIRVKPGIEAHTHEFIATSHEDQKFGFSLASGSAFEAAKAANNAENLNLVGLHCHVGSQVFDAEGFKLAAERVLGLYSQIHSELGVALPELDLGGGYGIAYTAAEEPLNVAEVASDLLTAVGKMAAELGIDAPTVLVEPGRAIAGPSTVTIYEVGTTKDVHVDDDKTRRYIAVDGGMSDNIRPALYGSEYDARVVSRFAEGDPVSTRIVGSHCESGDILINDEIYPSDITSGDFLALAATGAYCYAMSSRYNAFTRPAVVSVRAGSSRLMLRRETLDDILSLEA

SEQ ID NO: 13830 - protein, 291 aa, Corynebacterium glutamicum ATCC 13032
MTFTLNNGLAIPDIGFGVFQTPPDETRNSVNAALEAGYRHIDTAAAYGNEREVGEAIAASGIGRDEITIETKIWVTDYGFEETLHAFDKATGKLGVDTLDILILHQAVPSSFDRTIAAYKALEKLLFDGAVRAIGVSNFMPEHLDKLLLETSIVPALNQIECHPYFQQRDVLARNEQLGILTQAWSPIGGITFYRDGQLPSTLENEVIAGIAAEVGKTPAQVMLRWHLQRRRHAIPKSVTPSRIVENFEIFDFELSDEQLQQIDALNTDLRGGPEPENITMENYYREIPEA

SEQ ID NO: 13831 - protein, 307 aa, Corynebacterium glutamicum ATCC 13032
MSNSTGTDIVVVGSINADLTAKVQRHPEPGETLLGSGGTVSAGGKGANQAVAAAQLGAKVTMIGAVGTDQMAGEALTHLRQSGADMSAIATVDGPTGLAIITVSDDGENTIIVIPGANASVTAEFVDKHSQLIENAGIVLLQGEIPADGFERAVDLSQGRVVINLAPVVPVGHDQLRRADPLLVNEHEGALVLDMLGTPATTSDPQSLVTELLEQGFTSVVMTLGAEGALVGTPGQLTAIPTPKIQAVDTTGSGDAFAGALVAKLSEGAGLIEAATFAARVGAYAATRPGAQASYPTLTTDLPSTTH

SEQ ID NO: 13832 - protein, 231 aa, Corynebacterium glutamicum ATCC 13032
MIKAIFWDMDGTMVDSEPQWGIATYELSEAMGRRLTPELRELTVGSSLPRTMRLCAEHAGITLSDADYERYRAGMFARVHELFDESLVPNPGVTELLTELKALEIPMLVTTNTERDLATRSVAAVGNEFFIGSIAGDEVPTAKPAPDMYLEAARRVGFDPSECLVFEDSYNGMLGAVTAGCRVIGLHPEEVQAPEGVVPLRSLHGKNSFEGVTAEMVTAWYHQIEPAGVAK

SEQ ID NO: 13833 - protein, 420 aa, Corynebacterium glutamicum ATCC 13032
MTHVSSPSAPRNVVVGVAGGIAAYKACHIVRAFKEAGDNVRVVPTESALKFVGKATFEALSGNPVSTTVFDAVDSVQHVKVGQEADLIVIAPATADLMARVVAGRGDDLLAATLLVATCPVVIAPAMHTEMWFNPATVANVATLRQRGITVIEPAHGRLTGKDTGPGRLPDPEQIVDLANAVHAGARLPQDLAGKKVLITAGGTHEHIDPVRFIGNSSSGRQGFALGEIAAQRGAHVSIVAGNAAELPTPAGAEIVPVVSTQDMFDAVQERAGQSDFIVMAAAVADFTPASQATSKLKKGSDSDEDALSTISLVENPDILATTVKRREAGELDSNPVIVGFAAETGDEHTTALEYARKKLQKKGCDLLMCNEVGMGKVFGQKHNEGWILDAHGGVVDVEHGSKIEVAAQIWDAALAYREV

SEQ ID NO: 13834 - protein, 636 aa, Corynebacterium glutamicum ATCC 13032
MGILNSISTPADLKALNDEDLDALAKEIRTFLVDKVAATGGHLGPNLGVVELTIGLHRVFDSPQDPIIFDTSHQSYVHKILTGRAKDFDSLRQKDGLSGYTCRAESEHDWTESSHASAALSYADGLSKAKQLDGDTTHSVVAVVGDGALTGGMCWEALNNIAAGKDRKVVVVVNDNGRSYSPTIGGFAENLAGLRMQPFYDRFMEKGKTSLKSMGWVGERTFEALHAFKEGVKSTVIPTEMFPELGMKYVGPVDGHNQKAVDNALKYAHDYDGPIIVHMVTEKGRGYAPAEQDLDELMHSTGVIDPLTGAPKSASKPGWTSVFSDELVKIGAQNENVVAITAAMAGPTGLSKFEANFPNRFFDVGIAEQHAVTSAAGLALGGKHPVVAIYSTFLNRAFDQLLMDVGMLNQPVTLVLDRSGVTGSDGASHNGVWDMALTSIVPGVQVAAPRDEDSLRELLNEAISIDDGPTVVRFPKGDLPTPIVAIDTLEDGVDVLAYEDATDVESTDDAPSVLIIAVGERATVALDVASRIKQHGVNVTVVDPRWIVPIPQSLVALSDDHDLVITIEDGVIHGGVGSLLSDALNASEVDTPRRQIAVPQKYLDHASRNEVLADYGLDADGIETTVVGWLDSLFGE

SEQ ID NO: 13835 - protein, 331 aa, Corynebacterium glutamicum ATCC 13032
MTAPSTQDLATTEREVDPGSRRGQTNDNPSQDLVRVYLNGIGKTALLTAEDEVELAQTIEVGLYAEHLLKNSEEPLTRAMKRDLKVLAKDGKKARSHLLEANLRLVVSLAKRYTGRGMPLLDLIQEGNLGLIRAMEKFDYSKGFKFSTYATWWIRQAITRGMADQSRTIRLPVHLVEQVNKLSRIKRELYQHLGREATNEELAEESGIEESKIEMLLRQSRDPVSLDMPVGADEEAPLGDFIEDSEATDAESAVVASMRHSDIRAVLNTLEPREQDVIRLRYGLDDGVPRTLDQIGRRFGLSRERVRQIEREVMSKLRDGERASRLREYAQ

SEQ ID NO: 13836 - protein, 568 aa, Corynebacterium glutamicum ATCC 13032
MATVADVNQDTVLKGTGVVGGVRYASAVWITPRPELPQAGEVVAEENREAEQERFDAAAATVSSRLLERSEAAEGPAAEVLKATAGMVNDRGWRKAVIKGVKGGHPAEYAVVAATTKFISMFEAAGGLIAERTTDLRDIRDRVIAELRGDEEPGLPAVSGQVILFADDLSPADTAALDTDLFVGLVTELGGPTSHTAIIARQLNVPCIVASGAGIKDIKSGEKVLIDGSLGTIDRNADEAEATKLVSESLERAARIAEWKGPAQTKDGYRVQLLANVQDGNSAQQAAQTEAEGIGLFRTELCFLSATEEPSVDEQAAVYSKVLEAFPESKVVVRSLDAGSDKPVPFASMADEMNPALGVRGLRIARGQVDLLTRQLDAIAKASEELGRGDDAPTWVMAPMVATAYEAKWFADMCRERGLIAGAMIEVPAASLMADKIMPHLDFVSIGTNDLTQYTMAADRMSPELAYLTDPWQPAVLRLIKHTCDEGARFNTPVGVCGEAAADPLLATVLTGLGVNSLSAASTALAAVGAKLSEVTLETCKKAAEAALDAEGATEARDAVRAVIDAAV

SEQ ID NO: 13837 - protein, 392 aa, Corynebacterium glutamicum ATCC 13032
MGVVTKKILILGSTGSIGTQALDVIADNSDKFEVVGIAAGGSQPDLVISQAQQLGLAADKVAVADAQAAAVISKALGGEIISGTDAAKILVETTKADTVLNALVGSLGLAATLATLESGAHLALANKESLVAGGEFVTSKAKLGQIIPVDSEHSAMAQCLRSGTRDEVARIVLTASGGPFRGWTREKMWEVTPEQAAAHPTWAMGQMNTLNSATLINKGLELIEATLLFETDADLIDVTVHPQSIIHSMITFTDGATIAQASPPSMKLPIALALDWPHRVPKAQPALDFTAAHTWAFEPVDDAAFPAVQLARHVAKQKGTYPAVYNAANEEAAEAFLRGRIKFPQIVDVVDEVLQGASQFAGVASHVDDILATESEARARANALINRLATNL

SEQ ID NO: 13838 - protein, 112 aa, Corynebacterium glutamicum ATCC 13032
MKLITAIVKPFTLTDIKDALEQAGVQGMTVTETQGFGQQKGHTEVYRGAEYAVDFVPKVKIEVIISDAQAEEVINIIVETARTGKVGDGKVWMTNIEELVRVRTGERGEAAL

SEQ ID NO: 13839 - protein, 295 aa, Corynebacterium glutamicum ATCC 13032
MISLLNDPRTLFPKVDPPKQSQPEPGLDIKLSPQADIGLSSYQGSGRLKGRKALITGGDSGIGAAVAIAYAREGADVAIAYLPEEQADADRVLQAIEETGQKAFSFPGDLRDPEYCRSLVQETVNALGGLDILVNNASRQVWAPGLTEITDENFDQTLQVNLYGSFRVTKAAIPHLKPGSSIIFTSSIQAYQPSETLLDYAMTKAALNNLSKGLASSLIGDGIRVNSVAPGPFWTPLQPSHGQPQEKIEGFGQHAPIGRAGHPVELAGAYVFLASDEASYVVGETLGVTGGTPTP

SEQ ID NO: 13840 - protein, 615 aa, Corynebacterium glutamicum ATCC 13032
MSSNIAITTEPEGKNKKGLKSDPFIFSISVGFIVVFVIATIALGEKARTTFSAIAGWLLENLGWMYIGGVSLVFIFLMGIFASRYGRVKLGDDDDDPEHTLIVWFCMLFAGGVGAVLMFWGVAEPINHAFNVPMANEESMSEAAIVQAFAYTFYHFGIHMWVIMALPGLSLGYFIYKRKLPPRLSSVFSPILGKHIYSTPGKLIDVLAIVGTTFGIAVSVGLGVLQINAGMNKLWSTPQVSWVQLLIILIITAVACISVASGLDKGIKLLSNINIAMAVALMFFILFTGPTLTLLRFLVESFGIYASWMPNLMFWTDSFQDNPGWQGKWTVFYWAWTICWSPYVGMFVARISRGRTVREFIGGVLALPAIFGVVWFSIFGRAGIEVELSNPGFLTQPTVVEGDVPAALFNVLQEYPLTGIVSAFALVIIVIFFITSIDSAALVNDMFATGAENQTPTSYRVMWACTIGAVAGSLLIISPSSGIATLQEVVIIVAFPFFLVQFVMMFSLLKGMSEDAAAVRRVQTRQWEKTDTPEKLEEHSSQPAPGYDDEGNPLPMPALEHDEDGNIVIPGNVVIEGDLGVVGDVVDDPEEAQEMGSRFKIVEQTRPQSRDEYDI

SEQ ID NO: 13841 - protein, 301 aa, Corynebacterium glutamicum ATCC 13032
MNNRIVVVGSINADLNVLVDRHPAPGETLLGSGGHITAGGKGANQAVAAALQGADVAFVGAVGKDPYAAPALEFLRSSGVDLTAVSEVDDTTGLAVITVAKDGENNIVVIPGANSLVNCDYVSSQSALLAEAGILLLQGEIPADGFKEAIHHTMGRVVVNLAPVIEVEKSALLEADPIIANEHEAGLILDQFGAGIDSMDPHELAQALLDAGFASVVLTLGSAGALVADATGITDIATPTVQAVDTTGAGDAFAGAFCARLIKGDSLIDAATHAARVGAYSVQTAGAQASYPDASVSLPSV

SEQ ID NO: 13842 - protein, 630 aa, Corynebacterium glutamicum ATCC 13032
MSTNSGNNLPESQESPEEPHYPHDTHPGLVPGISVDAQRNKFGLDKTVFGVTAALILAFIAWGISSPDSVSSVSSTMFSWAMTNTGWLLNFVMLIGIGTMLYIAFSRYGRIKLGTDEDEPEFSRFSWIAMMFGAGIGVGIFFFGPSEPLWHYLSPPPHTVEGSTPESLHQALAQSHFHWGLSAWGLYALVGGALAYSSYRRGRVTLISSTFRSLFGEKTEGIAGRLIDMMAIIATLFGTAATLGLSAIQVGQGVQIISGASEITNNILIAIIAILTIGFIISSVSGVSKGIRYLSNLNISLTLGLVLFVFITGPTLFLLNLIPSSVLEYGSEFLSMAGKSLSWGEETIEFQAGWTAFYWAWWIAWTPFVGMFIARISRGRTLREFALITMAIPSFILILAFTIFGGTAITMNRENVDGFDGSSSKEQVLFDMFSNLPLYSITPFILIFVLAVFFVTSADSASVVMGTMSSQGNPAPNKLIVVFWGLCMMGIAVVMLLTGGESALTGLQNLTILIAIPFALVLIVMAIAFIKDLSTDPAAIRQRYAKAAISNAVVRGLEEHGDDFELSIEPAEEGRGAGATFDSTADHITDWYQRTDEEGNDVDYDFTTGKWADGWTPESTEEGEVDAKKD

SEQ ID NO: 13843 - protein, 203 aa, Corynebacterium glutamicum ATCC 13032
MSNAEINPVEYEINNHAPGTALNPQCEDGANVEIITSREVPLGGPRAMTVHRTLPQRQRSLIGAWCFVDHYGPDDVSLTGGMDMASHPHTGLQTVTWLFEGEVTHHDSGGNHAVVLPGEVNLMTAGAGICHTEVSATSTTILHGLQLWTVLPDKDREGPRRFDHYAPEEITLEGGSARVFLGSLFGQTSPVHTFTGSSCFRVH

SEQ ID NO: 13844 - protein, 376 aa, Corynebacterium glutamicum ATCC 13032
MTLSERKLTTTAKILPHPLNAWYVAAWDYEVTSKKPMARTIANKPLALYRTKDGRAVALADACWHRLAPLSKGKLVGTDGIQCPYHGLEYNSAGRCMKMPAQETLNPSAAVNSYPVVEAHRFVWVWLGDPTLADPTQVPDMHQMSHPEWAGDGRTISADCNYQLVLDNLMDLTHEEFVHSSSIGQDELSESEFVVTHTEDSVTVTRWMHDIDAPPFWQKNMNDKFPGFEGKVDRWQIIHYYYPSTICIDVGVAKAGTGAQEGDRSQGVNGYVMNTITPDSDRSSHYFWAFMRNYRLESQTITTQLRDGVSGVFKEDEDMLTAQQDAIDANTDYEFYSLNIDAGGMWVRRILEEALSKEGRLDIPTTFPRATPKPEA

SEQ ID NO: 13845 - protein, 182 aa, Corynebacterium glutamicum ATCC 13032
MIREDLANAREHDPAARGDLENAVVYSGLHAIWAHRVANSWWKSGFRGPARVLAQFTRFLTGIEIHPGATIGRRFFIDHGMGIVIGETAEIGEGVMLYHGVTLGGQVLTQTKRHPTLCDNVTVGAGAKILGPITIGEGSAIGANAVVTKDVPAEHIAVGIPAVARPRGKTEKIKLVDPDYYI

SEQ ID NO: 13846 - protein, 484 aa, Corynebacterium glutamicum ATCC 13032
MTATFAGIDATKHLIGGQWVEGNSDRISTNINPYDDSVIAESKQASIADVDAAYEAAKKAQAEWAATPAAERSAIIYRAAELLEEHREEIVEWLIKESGSTRSKANLEITLAGNITKESASFPGRVHGRISPSNTPGKENRVYRVAKGVVGVISPWNFPLNLSIRSVAPALAVGNAVVIKPASDTPVTGGVIPARIFEEAGVPAGVISTVAGAGSEIGDHFVTHAVPKLISFTGSTPVGRRVGELAINGGPMKTVALELGGNAPFVVLADADIDAAAQAAAVGAFLHQGQICMSINRVIVDAAVHDEFLEKFVEAVKNIPTGDPSAEGTLVGPVINDSQLSGLKEKIELAKKEGATVQVEGPIEGRLVHPHVFSDVTSDMEIAREEIFGPLISVLKADDEAHAAELANASDFGLSAAVWSKDIDRAAQFALQIDSGMVHINDLTVNDEPHVMFGGSKNSGLGRFNGDWAIEEFTTDRWIGIKRS

SEQ ID NO: 13847 - protein, 258 aa, Corynebacterium glutamicum ATCC 13032
MSKVAMVTGGAQGIGRGISEKLAADGFDIAVADLPQQEEQAAETIKLIEAAGQKAVFVGLDVTDKANFDSAIDEAAEKLGGFDVLVNNAGIAQIKPLLEVTEEDLKQIYSVNVFSVFFGIQAASRKFDELGVKGKIINAASIAAIQGFPILSAYSTTKFAVRGLTQAAAQELAPKGHTVNAYAPGIVGTGMWEQIDAELSKINGKPIGENFKEYSSSIALGRPSVPEDVAGLVSFLASENSNYITGQVMLVDGGMLYN

SEQ ID NO: 13848 - protein, 477 aa, Corynebacterium glutamicum ATCC 13032
MRFLNNSNPPYELTYSDVFMVPSRSDVGSRMSVDLRTNDGTGTTIPLVVANMTAVAGRRMAETIARRGGMAILPQDVPADIAAETIANVKKADLVFDTPITVKPHHTVGYARNLIHKRAHGAAIVLEGDQPVGIVTDKDLEGADNFTQVGTLMSTSLLTLPEDISPEDAFGILHEHSRKLAPVVAADGSLRGILTRTGALRATMYKPAIDANGRLRVGAAIGINGDIEGRTKTLLDAGADVLVVDTAHGHQSTMISALKRIRALDVNVPIVAGNVVTADGVRDLVEAGANIIKVGVGPGAMCTTRMQTGVGRPQFSAVLECAAEARKLGAHVWADGGVRDPRDVALALAAGASNVMVGSWFSGTYESPGDLRFESDGRMYKESFGMASRRAVESRNQKVEAFEKARRAMFEEGISTARIYIDKRHGGVEDLVDQIISGVRSSFTYAGADSIETFFERATVGVQSTEGYAEGKPRASR

SEQ ID NO: 13849 - protein, 521 aa, Corynebacterium glutamicum ATCC 13032
MIKRLPLGPLPKELHQTLLDLTANAQDAAKVEVIAPFTGETLGFVFDGDEQDVEHAFALSRAAQKKWVHTTAVERKKIFLKFHDLVLKNRELLMDIVQLETGKNRASAADEVLDVAITTRFYANNAGKFLNDKKRPGALPIITKNTQQYVPKGVVGQITPWNYPLTLGVSDAVPALLAGNAVVAKPDLATPFSCLIMVHLLIEAGLPRDLMQVVTGPGDIVGGAIAAQCDFLMFTGSTATGRILGRTMGERLVGFSAELGGKNPLIVAKDADLDKVEAELPQACFSNSGQLCVSTERIYVEEDVYEEVIARFSKAAKAMSIGAGFEWKYEMGSLINQAQLDRVSTFVDQAKAAGATVLCGGKSRPDIGPFFYEPTVLADVPEGTPLLTEEVFGPVVFIEKVATLEEAVDKANGTPYGLNASVFGSSETGNLVAGQLEAGGIGINDGYAATWASVSTPLGGMKQSGLGHRHGAEGITKYAEIRNIAEQRWMSMRGPAKMPRKVYSDTVATALKLGKIFKVLP

SEQ ID NO: 13850 - protein, 386 aa, Corynebacterium glutamicum ATCC 13032
MIVSTQPITDRSALSAEHAEVIKATLPLVGGKINEITPVFYNKMFAAHPELIANTFNRGNQKQGDQQKALAASIATFATMLVTPDAPDPVQLLSRIGHKHVSLGITADQYDIVHEHLFAAIVEVLGAETVTAPVAEAWDAVYWIMANVLIGFENNLYASNDLEPGDVFREVTVTAKKQLSATVWEYTLAGELVAPEPGQYTSIGVVLDDGARQLRQYSLLGGSDTEYRIAVEDNGEVSGFLRDRVSVGDKIEATIAAGDLVLNKDTNPVVLISQGIGSTPMVGMLAGMNPERDVVVLHADQAESTYAQVEEVQGLVEKLPKAAFEIFYRDNDQWLEVAGRIPSGASVYLCGGVEFLKNVREQIEALDEQPRDVNFELFAPNDWLIS

SEQ ID NO: 13851 - protein, 493 aa, Corynebacterium glutamicum ATCC 13032
MTSSFSRRQFLLGGLVLAGTGAVAACTSDPGPAASAPGPSLRPTPTPTALGEPTVRRTLTARPLSLDIGGIEAKTWGYVSDTGDAAIEATAGDVLQVDITNELPESTSIHWHGIALHNAADGVPGMTQDPIEPGESFSYVFEVPHGGTYFYHSHTGLQLDRGLHAPLIIRDPQDAEDQDVEWTIVLDDWVDGIQGTPDDELDKLTGMGSGDHNGRMGMGGHGQMMHGTPDRVLGGDVGDVMYPHYLINGRIPRAHRTFEARPGDKARLRFINSGGDTIFKVALGGHRMTVTHTDGFPVQPWETESIYLSMGERVDVEVILGDGIFPLTALAVGKDDRAFAVIRTAGGQAPRPDVDFPELSSTGLLLSSLKPADRALLPEGTPDREVSIDLGGQMMPYEWSILTDGQSSSATVQEGQRLRMVMRNRTMMPHPMHIHGHTWALPGSGGLRKDTVLLRHGETMIADLIADNPGEWAFHCHNAYHMETGMVSSLRYE

SEQ ID NO: 13852 - protein, 508 aa, Corynebacterium glutamicum ATCC 13032
MNTDTTQDGVSPEPSDPHLGSEVAETHREKKFFGQPWGLANLFGVEMWERFSFYGMQSILAFYLYYSVTDGGLGMNQTAALSIVGAYGGFVYMTSLVASFIADRVLGSERTLFYSAIIVMLGHIALALIPGYTGLSIGLVLIGLGSGGVKTAAQVVLGQLYSRTDTRRDAGFSIFYMGVNLGGLFGPLITNALWGWGGFHWGFGIAAVGMALGLIQYVAMRKTTIGAAGHTVPNPLPKNEYARWIIGAVVVVAAVVALIATGIIKLEWLSNITAAIALIAAIALLAQMYVSPLTTAAEKSRLLGFIPMFIGGVLFFAIFQTQFTVLAVYSDTRLDRNFFGIDLPPGLINSFNPIFIIIFSGIFATLWTKLGAKQWSTAVKFGVANIVIGCALFFFLPFAGGAENSTPMALIIWVYFLFTIAELLLSPVGNSLATKVAPEAFQSRMFAVWLMAVSMGTSLSGTLGGYYDPTDAGSEKVFFITVGVAAIVLGAIVIAAKGWVLKKFIDVR

SEQ ID NO: 13853 - protein, 508 aa, Corynebacterium glutamicum ATCC 13032
MTDIKATSSTSATTAPTAGRPARRLGQISLVACLGGLLFGYDTGVANGAEGHMAQELGLNVLQLGVVISSLVFAAAFGALFAGRISDEIGRRKAIITLSVLFFLGSILVVFSPAGELGQFYGPGFATLVTGRIMLGLAVGGASTVVPVYLAELAPLEIRGSLTGRNELAIVTGQLLAFVINALIAVTLHGVIDGIWRIMFAVCALPAVALFLGMLRMPESPRWLVNQGRYDDARRVMETVRTPERAKAEMDEIIAVHSENNAALPGVKQSSGQASGQVSSKHTHMSIGEVLSNKWLVRLLIAGIGVAVAQQLTGINAIMYYGTRVLEESGMSAEMAVVANIAFGAVAVIGGLIALRNMDRLDRRTTFIIGLSLTTTFHLLIAAAGTLLPEGNSIRPFAIMILVVGFVLSMQTFLNVAVWVWLAEIFPVRMKGIGTGISVFCGWGINGVLALFFPALVSGVGITFSFLIFAVVGVIALAFVTKFVPETRGRSLEELDHAAFTGQIFKKA

SEQ ID NO: 13854 - protein, 215 aa, Marsilea vestita
SQRKKRQVSQDLATPESVEKYTQLSSHPLHKTNKPGILSVDVYQSEDLILTGGVDSTAVVFNRSSGEIVSTLNGHSKRVNSVKFVPENGYVLTGSADKTVKIWQQKDGMYECKHTLREHTEEVRAVTVHATQNFFVTASTDKSWCFYDLAYGECLVQVTEPSLQEGYTSASFHPDGLILGMGTAESLVRIWDVKSQANVAQFEGHSGPVTGLSFS

SEQ ID NO: 13855 - protein, 108 aa, Dictyostelium discoideum
MSSAQSRGGKTGGKVGGKVGAKRHKKTQKEHINGITKPAIRRLARRGGVKRISFPIYEETRNVLRTFLTNVIRDSVAYTEHAGRRTVTAMDVVYALKRQGRTLYGFNS

SEQ ID NO: 13856 - protein, 315 aa, Dictyostelium discoideum
MSDQLVAPPPENCPGTQSEMSGKSAACAGCPNQQICATAPKGPDPDIIEIEERMKTVKNKILVLSGKGGVGKSTFSSQLSFALSMDEKVEVGLLDIDICGPSIPKIMGLEGENIHISGQGWDPVYVQDNLAVMSVGFLLEKEEDAVIWRGPKKNGIIKQFLKDVYWNDLDYLVIDTPPGTSDEHLSIVQYLKTSNLSGAVIVTSPQDVALIDVRKEINFCKKVGVPIIGVVENMSGFVCPKCNKESQIFIPTTGGAEKMSQDMNVPFLGRIPIDPLIARSCDEGKSYLITHPNSEATKQYNLIFNKIKEIVNNSK

SEQ ID NO: 13857 - protein, 1465 aa, Adiantum capillus-veneris
MATPGGPKTKHSVSVAQTRADARLHAAFEGSGDAGAGGSRAPFDYSKSGMDASSVTSVAPEAITAYLQRMQRGGLTQAFGCMLVVAGQKIVAFSENAPEMLEVAAGLGTDLRMLFTQGSTAALDQAVKEEDLSSVNPLVLQSCGGSAKQFYAMLHRIEDVAGVVIDLEPIENGVVEKKSSAEMAVKPIARVQSLPGGEIGRLCQVVVEEVQEMTGYDRVMAYKFHEDGHGEVVAEVRRPDLEPYLGLHYPSTDVPQASRMMFMKNGVRMIGDCTLPPVRVVQAKELAQPISLAGSTLRAPHGCHAQYMSNMGSAASLTMAVAIDDYDDDSSLSCGSRKLWGLVVCHHPSPRTVSYPLRCACEKLMVAFGVQLNIELDLAAQLRENHILTTQALLCDMLRRIRGAPIGIVSRSPSIMDLVKCDGAALYYGGRFWPLGTTPSEFQIRDLAEWLLGASEEIASTGVTCTDSLAEMGYPGAALLGDAVCGMAAAMITPNSDFLFWFRSHTAKEVYWGGAEHDPQSRDDDSWMQLPRSSFKAFLEIVKRRSLPWEEVEVDAIRSLQLILREDLEQFCAAVGAVKASDGDDEDSLVPSAKKLSLKETEENGGADNSKKLERMHSAAAGGGGGGGRWEKMRLPSSLAQEWMEAIRGTGDGGASGGGGGGPFDWDLISAFQHNSFIVVDALKPDFPIIYASTGFFNLTGYTSREVIGGNCRFLQGPDTNPADVASIREALAQGTGTFCGRLLNYRKDGSSFWNLLTIAPIKDDLGSIVKLIGVQLEVSKYTEGIRANNRRPNGMPQSLIRYDVRHQDKVSAFIAQLVAALTKPDKVETPRLSSAMRFSLTGQTIESLPQPTAIPREGGGRTRRPRSSSFLSLLGMEKEKDIPEEDELQELEVIMLEDASVGRPGSLDDPERTRRGIDLATTLERIGKSFVITDPRLPDNPIIFASDRFLELTEYTREEVLGNNCRFLQGRGTDRKAVQLIRDAVKEQRDVTVQVLNYTKGGRAFWNLFHLQVMRDENGDVQYFIGVQQEMVAPRPVHQPPELPDILPDRVEQEKAEVVRATAQRVDAAARELPDANLVPDHLFAPHSKVVTPLPHSKTNSSSWFAIRRVQRRLRRGERLGLKHFRPIKPLGSGDTGSVHLVELRGTGQVFALKAMDKSMMLQRNKVHRARAEREILAIMDHPFLPTLYASFQTKTHVCLITDYCPGGDLFLLQDKQPTQTLSERTASFYAAEVVVALEYLHCMGVIYRDLKPENVLLQKNGHILLTDFDLSFLTSCRPQLILQGGKGRSRRSKRRRRVTFCAEPRVSSNSFVGTEEYIAPEIISGEPHSSAVDWWALGILLYEMLYGRTPFVGRNRQKTFYNVLNKELIFPTSIPVSLAGRQLIAGLLQRDPTIRLGTLRGASELKKHPFFREINWPLIRWRKFSANQAHNANNVSSLDEGESDSGNAWEANGGSTQSFQDTF

SEQ ID NO: 13858 - protein, 423 aa, Oryza sativa (japonica cultivar-group)
MAKCQFSPIPRAIAASSLVLPLPPHPGEHILRHRCLLRSPFIARASTASSLVLPLPPHPGEHILRHRRLLRSPSIARASEGRRRSSCCFRRIDKMPNRATHWCYACRRPIRVSGQDITCPNCNDGFIQEISEIGGSLNTYGIFDPSFDERRDRSFGMVEAMSDLMRQRMAEMGRNRVLDFHGTRGASSHQGRQPTVRPMLIFGSNAPDRVSSSSEEADILLRQGRRIGADRPNFSRFLVGPSLEALFEQLLLHNNRQGPPPAPQSAIDSMPVVKINLRHLRDDPHCPVCTDKFEVGTEAREMPCKHLYHAECIIPWLVQHNSCPVCRHPLPSSSHRSGSTRSSSTHSNEAISHGVARSDADPVPVARSDDSRNHEMHGSFSFLWPFDSPTPDSSSYTHEGGVGEPTVHDDAGQMTYSEWHYDY

SEQ ID NO: 13859 - protein, 361 aa, Oryza sativa (japonica cultivar-group)
MAVGKEGGGGAGGEGGMSDSVIRKVLVSYMYVAVWIFLSFTVIVYNKYILDPKMYNWPFPISLTMVHMAFCSSLAIALVRLLRVVELPSSPAMTPQLYTSSVLPIGALYSLSLWFSNSAYIYLSVSFIQMLKALMPVAVYSIGVLFKKENFKSSAMLNMLSISFGVAIAAYGEARFDARGVALQLAAVAFEATRLVLIQILLTSKGISLNPITSLYYVAPCCLAFLVIPWAFVELPRLRAVGTFQPDFFIFGTNSLCAFALNLAVFLLVGKTSALTMNVAGVVKDWLLIAFSWSVIRDTVTPINLFGYGIAFLGVGYYNHVKLQALKAKEAQKKAAQADEEAGSLLQERDSHGERKSDNQA

SEQ ID NO: 13860 - protein, 577 aa, Oryza sativa (japonica cultivar-group)
MAISSALPSPLLLAASLLLLIVQAQGITRHYEFNVQMANATRLCNTKSMVTVNGQCPGPELVAREGDRVVIRVTNNVAHNISLHWHGVRQVRTGWADGPAYITQCPIQTGQSYVYNFTVAGQRGTLWWHAHISWLRATVYGALVILPKLGVPYPFPAPHKEVPVIFGEWWNADTEEVVNQAVQTGGGPNVSDAFTINGLPGPLYNCSAQDTFKLKVKPGKTYMLRLINAALNEELFFAVANHTLTVVEVDAVYVKPFTVDTLVISPGQTTNVLLTAKPYYPGANFYMSAAPYSTARPGTFGNTTVAGILEYENPAMSPSAASFVKGLPLFKPTLPQLNDTDFVTNFTDKLRSLATPEYPAAVPQSVDKRFFFTVGLGTLPCPANMTCQGPNNTQMAASMNNVSFVLPARALLQSHFTGLSSGVYAPDFPVAPLSPFNYTGTPPNNTNVKTGTKLLVLRYNTSVELVMQDTSILGIESHPLHLHGFNFFVIGQGFGNYDAVNDPAKFNLVDPVERNTVGVPAGGWVAIRFLADNPGVWFMHCHLEAHTTWGLRMAWLVLDGSHPNQKLLPPPSDLPKC

SEQ ID NO: 13861 - protein, 577 aa, Oryza sativa (japonica cultivar-group)
MAISYLLRSSILAVAALLLFSVNLAKGDIREYQFDVKTTNVTRLCSSKSIVTVNGQFPGPTVFAREGDLVVIRVINHSPYNMSIHWHGIRQLRSGWADGPAYITQCPIQPGGSYVYKYTITGQRGTLWWHAHISWLRATVYGPIIILPKAGVPYPFPAPDKEVPVVFGEWWKADTEAVISQATQTGGGPNVSDAFTINGLPGPLYNCSAKDTFKLKVEAGKTYMLRLINAALNDELFFSIAGHTLTVVDVDAVYVKPFTVDTLLITPGQTTNVLLTTKPSYPGATFYMLAAPYSTAMSGTFDNTTVAGILEYEDPSSHSTAAFNKNLPVLRPTLPQINDTSFVSNYTAKLRSFATAEYPANVPQQVDTRFFFTVGLGTHPCAVNGTCQGPNGSRFAAAVNNVSFVLPSTALLQSHYTGRSNGVYASNFPAMPLSPFNYTGTPPNNTNVSNGTRLVVLPYGASVELVMQGTSVLGAESHPFHLHGFNFFVVGQGFGNFDPVNDPAKYNLVDPVERNTVGVPAAGWVAIRFLVDNPGVWFMHCHLEVHVSWGLKMAWVVQDGSLPNQKILPPPSDLPKC

SEQ ID NO: 13862 - protein, 563 aa, Oryza sativa (japonica cultivar-group)
MGTPRGLRNAGSSSSACRFLAAFAVLLALPTLTAGLTRHYTFNVQMTNVTRLCVTKSIPTVNGQFPGPKLVVREGDRLVVKVHNHMNYNVSFHWHGILQLRNGWADGPSYITQCPIQGGGSYVYDFTVTGQRGTLWWHAHFSWLRVHLYGPLVILPKRGEGFPFPRPYKELPPIMFGEWFNADTEAVINQALQTGAGPNISDAYTFNGLPGPTYNCSSKDTYKVKVQPGRTYLLRLINSALNDELFFGIANHTLTVVEADANYVKPFTAKTLVISPGQTMNLLLTTAPNPGSPVYAMAIAPYTNTQGTFDNTTAVAVLEYAPTRASATGNNNLPLPPLPRYNDTNAVANFSSKFRSLATARYPARVPRAVDRHVLFTVGLGTDPCPSNQTCQGPNGTKFAASINNNSFVRPRVALLEAHCQRRYAGVLMANFPTAPPHPVVPLAFNTSVELVLQGTSIQGAESHPLHMHGFNFFVVGQGFGNYDPVNDPANYNLVDPVERNTVSVPTGGWVAVRFLADNPGVWLMHCHFDVHLSWGLSMAWLVNDGPLPSQKMLPPPSDLPKC

SEQ ID NO: 13863 - protein, 404 aa, Oryza sativa (japonica cultivar-group)
MKLHFVLRFLFGPVPVYFSALAILILLTNAQYFGLVGVTVPRATKLASSAPVVSVMKYCDIFRGEWVPDSDAPYYNHKTCYMIQEHQNCLKYGRPDLEFLKWRWRPSGCELPRFDPVQFLQFNRHKSLAFVGDSLARNHMQSLLCLLSQVAYPKDMSANPTTQNKVYHYRGYNFTVSMFWSPFLVKAREPDHDGPAHTGHWSLYLDEPDQSWVSEISRFDYVLVSAANWFSRPSLFYEKRRLVGCSFCSRQYGVPDLTLYYSQRRAWRVALKAINDLESLRGRVIVRMLSPMSHFENGTWDQGGNCKRTQPLRSNETVMEGRDLHFYTAQMEEYRAAEKVAEAKGRRMMLMDATAAMLMRPDGHPSRYGHLPNQKVQLYNDCIHWCLPGPIDIWNDMLFQMLLV

SEQ ID NO: 13864 - protein, 393 aa, Oryza sativa (japonica cultivar-group)
MVLFFKVLFGPAAVFLSALVVLSCFKSVPYLSRMSSSELPSYMSYFESPISKCDIFQGEWVPDESSPQYTNLTCSYIQEHQNCMMYGRPDLEFLKWRWKPAGCDLPRFDPDKFLRLVGNKTLAFVGDSLARNHMQSLLCLLSKVATPKDVSVTGKTDPDKILYYEGYNFTIHIFWSPFLVRTEESAESPGVFKLYLDEPDCKWFARVARFDYVIFSGANWFTRPSLFYENGRLVGGSYVALNITSDLTLRHSHRMAFRTALRAINDIRFRGKAIVRTLSPMSHFEGGAWDKGGDCRRTRPYRGNETAMGGMDLEFYTSQVEEFREAQREAAANGVDMVLMDPTAAMLLRPDGHPSRYGHWPDEKRVLYNDCIHWCLPGPVDAWNDMLLHMLSD

SEQ ID NO: 13865 - protein, 206 aa, Paramecium tetraurelia
AGGIAEMSEIWGEEVRTSTDALDAAGNTTAAIGKGFAIGSAALVSLSLYGGYLTRIQTYNKNGVYPYAEGAKIDDPIIFAMLLIGAMLPYAFSAFTMKSVGKAALQMVEEVRRQLHEHPGIYAGTEEPDFRACIAISTKASLKEMIPPGLLVSIFVQQLQVIVTPTAVGLLFGPQAVAGLLPGALISGVQMAISASNNTGGAWDNA

SEQ ID NO: 13866 - protein, 213 aa, Porphyra yezoensis
AGGIAEMAGLPSEVRDTTDALDALGNTTAATGKGFSNGSAVLTAYALLTALVQDSGLAPNPLQLVGPAAAAAGVAGAHVTDGGQVVSLVDIYVVVSVFIGIMLPFFFGALTMLAVSRAAQAMIVEVRRQFRDIPGLREGARGVQPQHVRCVNISTRSAIIEMVIPGALAILTPLIVGFGFGQRALIGLLLAAIGSGYMLGIMMSNAGGAWDNA

SEQ ID NO: 13867 - protein, 440 aa, Erwinia chrysanthemi
MADPTPPVAAEAGSLFANGYVEEIPVANIADRIGTPFYVYSARQLRRQLQQLRQQLPTGTAIYYSLKANPNLSVVRALAEQGAGCEVCSPAELKTALAAGVSPQHILYVGPGKSLPALKLAIDCGIRAIVVESVTELDNLNRLAARANTVQTVALRINPDFSSAHARLVMSGKPTQFGMMRDTLHTVLASLHRWPSISLRGFHVYLGTRILNAQAIADNTRNILQLALDLRDTHRLTLDFVDVGGGFGVPYFPKETPLDLPALGAAIASIVADFRRRAADTQIIIELGRYLVAEAGLFVTRVNTLKTAGGKTFAVCDGGANCHSAAAGLNSMLRKNFPLLRLGDNQGRPLQPYQVSGPLCTPTDLLGDNVLLPTLEVDDLIGITHSGAYGLTASPGSFLSFGYPVEVMVDGRRLTLIRQPETTEQLLARQQPVDLCGDTP

SEQ ID NO: 13868 - protein, 507 aa, Aspergillus fumigatus
MNSLKLLVVSPEINPSNRKARSIPVLNPFDRYGRVFFFSWLGFMVAFLSWYAFPPLLTVTIRKDLHMTQQQVANSNIVALLATFLVRFIAGPLCDRFGPRLVFIGLLLCGSIPTAMAGLVTTPNGLIALRFFVGILGGTFVPCQVWCTGFFDKNIVGTANSLAAGWGNAGGGITYFVMPAIYDSLVHSQGLAPHKAWRVAYIVPFIIIVVLALCMLLICEDTPTGKWSERHIWMKENNESQANIVNLMSGSPSTRPSGPPSINISTPQSEKKGAQTPQMVDPEAQAVGQVDILRADTVVAPSRKEVMNVLLSLSTAAVAIPYACSFGSELAINSILGEFYSKNFPDMSQTESGRWAAMFGLLNVVFRPAGGFIADMLYKYTGAVWSKKVLLSFLGVVMGAFQLAIGLADPRSEATMFGLTAGLAFFLEACNGTNFAVVPHVHPFANGVVSGAVGGMGNLGGIIFAIIFRYNETHYSRSLWIIGVISIAANLAVSWIRPVPKSQMMRQ

SEQ ID NO: 13869 - protein, 300 aa, Aspergillus fumigatus
MPFHKLVKNSAYYSRYQTKYRRRREGKTDYYARKRLITQAKNKYNAPKYRLVVRFTNRDIITQIVYSEITGDKVFASAYSHELKRYGITQGLTNWAAAYATGLLLARRTLKKLGLDEQFTGVEEPDGEYKLTEAVETDDGTRRPFKAFLDVGLVRTSTGARVFGAMKGASDGGIFIPHSENRFPGYDIESEELDAETLRNYIFGGHVSEYMETLADDDEERYRSQFAKYIENEIDAGDLEEIYAEAHKAIREDPFKKDEDEKPKKSKEEWKAESKKYKKAKLSREEKKARVEQKIRELAA

SEQ ID NO: 13870 - protein, 356 aa, Aspergillus fumigatus
MGSCFSTESPGDAEQKKRSQAIDRRLEEDSRRLRRECKILLLGSGESGKSTIVKQMKIIHQNGYTVEELALYRLTIYKNLLDCAKALIGAYHQFNLQPTSPKVREFIEFLSEYNIDPDPNTPLDPRIGDAVTYLWNDPCTSTALEHQNEFYLMDSAPYFFEEAKRIAAPDYIPNVADVLRARTKTTGIYETRFTMGQLSIHMFDVGGQRSERKKWIHCFENVTSIIFCVALSEYDQVLLEESNQNRMMESLVLFDSVVNSRWFMRTSIILFLNKVDLFRQKLPRSPLSNYFPDYSGGNDVNRAAKYLLWRFNQVNRAHLNLYPHLTQATDTTNIRLVFAAVKETILQNALKDSGIL

SEQ ID NO: 13871 - protein, 365 aa, Aspergillus fumigatus
MAEFVRAQIFGTTFEITSRYNLQPVGMGAFGLVCSARDQLTGQPVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIQTICSENTLRFVKSLPKRERQPLANKFKNADPEAVDLLERMLVFDPKKRIRAGEALAHEYLSPYHDPTDEPEAEEKFDWSFNDADLPVDTWKIMMYSEILDFHNIDQGNDAGQVLMEGGVAQAQQNYA

SEQ ID NO: 13872 - protein, 747 aa, Aspergillus fumigatus
MTLTKREFAYTDLASSTALRIHFIWLAVHNFCTSQKAVSNGQGLQAHRGGSSFRPLCEWYVGLCWPCSDDFSSVAHLLGEELYKLLGEYLSRHLEAVYRESLSHTEEALLGFYIREWVRYTTAAKYVNHLFRYLNRHWVKREIDEGKKNVYDVYTLHLVKWKDDFFMKVHEKVMEAVLNLIEKQRNGETIEQSQIKNIVDSFVSLGLDENDNTKSTLEVYRVYFEKPFIAATRVYYENESRQFVAENSVVEYMKKAEARLDEEKARVGLYLHPDIMKRLTDTCLDVLVTAHSELLRDEFQVLLDNERQDDLARMYRLLSRIKDGLDPLRAKFETHVRKAGLAAVEKVAAEGEAFEPKMYQNLVNEAFNGESEFVRSLDNACREFVNRNKVCKSSSTKSPELLARYTDSLLKKGSKAAEESELEEMLVQIMTVFKYIEDKDVFQKFYSKMLAKRLVHVSSVSDDAETSMISKLKEACGFEYTNKLQRMFQDIQISKDLNSNYKDWQEKVLDEDDRKKQVDAHFQILGTGFWPLNPPTTGFSAPPEIVKTYERFQSFYYDKHNGRKLTWLWQLCKGEVKANYIKNTKVPYTFQVSTFQMGILLLFNENDTLTYSDIQKATSLAPEILDPNLAILLKAKVLLPSPEGAKPEPGTSFSLNYNFKNKKIKKVESDDTHKTIEEDRKLLLQSAIVRIMKSRKKMKHVQLVQEVIQQVKSRFPPKVQDIKKNIEALMEKDYIERLDGDEIAYIA

SEQ ID NO: 13873 - protein, 70 aa, Medicago sativa
RSTGEVVLGDATLGAIHIQKGVVDPHFVVVKEALLKTIKEAATDKWSEELSTAWEVAYDGLAASIKKSMS

SEQ ID NO: 13874 - protein, 265 aa, Dictyostelium discoideum
MDKIKHKILVLSGKGGVGKSTVSSQLALYLSHIGYKVGLLDVDLCGPSIPKMMGLESKDVHKSTKGWVPVYTDESQKLGVISIQFLLGDKDTPVIWRGPKKNSMIKQFIDDVNWGEIDFLIIDTPPGTSDEHISVTEELLKHNPDGAILVTTPQAVSISDVKKEISFCNAMKLPIIGIIENMSGYVCPHCSECTNIFSSEGGKLLAEQCNIKFLGKLPIDPNLSICSERGINYFTEYPNSSTLASLKSFVDNFNFKSSTTTTATN

SEQ ID NO: 13875 - protein, 833 aa, Dictyostelium discoideum
MEIHSVGPFIIGKTLGQGTTGKVKLGFHKDTGFKVGIKIINKELLINKPSMRRKIEREIVLMKLIDHPNAMKMYEVYETSKYLFLILEYVEGGELFDYLVEKGGLESGEALFFFQQIIIGLEYCHSRNICHRDLKPENLLLSGDKRIKIADFGMGSIVRKDMLLHTSCGSPHYASPEVVSGIDYDGQKADVWSCGVILYALLTGKLPFDDENIRRLLNKVKNGAFSMPPYIHKDAQDLLTKMLTVDPSKRISIKEIKEHPWFVSNFNQFQKATPVEEINAEPLVDYSQIDEDIFRSLMALGVGTIDEVKQQLVSNQKSATLIYYRLLEERKKFDSDVNKYGYKPKETRRNSLSDMSLKKIFSGSNNNNNNNNNNNNNNNNNNNNNNNNNNNNNNNNNININNNNNNNNNNNNNNNNNNNNNNNNNNNNNNNNSAVGKSNDSSSQQPPHIQQPHSQQIPSNSTSQESMQISPSNSANNMAIQQPIINNNNNNNNNNNNINNNINNNINNNINNNSNNVNRPTSEGLLKQALQQHHQQQQQQFNGNNNNNTMNVQPLTMSASSSSSSSSTTPSLSPNSSTTSSTSTSPQLSAIKPDHYQRRGSMTASTNPATSPTMSHRGKTSSPIEITSKVRKLKISESQSNTPNSPIIGSSPKKSWFSYFFSKNSSSNNLNAANGSAPSSPSLQSNGVGQLQTTQANYVIESKIDVNLIYVNLEKIIKKYGFELKYQQQQQQQNIKHCIVRSHHINSDGTPQFECEIEIKPSTFINPVSPSKQHHHHHHQQQQPQQQQMPPLNLNGGQNINHDQGFRVSIIHKSGSQHKFNNFTSSLEQILTI

SEQ ID NO: 13876 - protein, 518 aa, Trametes hirsuta
MSRFQSLLTFITISLVAVAHAAVGPVADLTITDAAVSPDGFSRQAVVVNGVTPGPLVAGNIGDRFQLNVIDNLTNHTMLKSTSIHWHGFFQHGTNWADGPAFINQCPISPGHSFLYDFQVPDQAGTFWYHSHLSTQYCDGLRGPFVVYDPNDPHASRYDVDNDDTVITLADWYHTAAKVRSPVPVVADAVYINGKGRFPVTLPPSCRLIKVTKGKRYRFRLVSLSCVPNHTFSIDGHNLTIIEVDSVNSQPLEVDSIQIFAAPRNSFVLDANQAVDNYWIRANPNFGNVGFDGGINSAILRYDGRPAVEPTTNQTTSVKPLNEVDLHPLVSTPVRRKSFVRSVTRRSTWLSTLMAPTSSSTAPVVPPTVPVLLQILSGAQTAQDLLPSGSVYVLPSNASIEISFPATAAAPGAPHPFHLHGHTFAVVRSAGSTVYNYDNPIFRGVVSPGTPAARDVTIRFDTNQPGPWFLHCHIDFHLEGGFAVVMAEDTPDVQAVNPVPQAWSDLCPTYDALDPNDQ

SEQ ID NO: 13877 - protein, 785 aa, Xenopus laevis
MTTRTPLPTVNERDADQPALGHADQKTSSGGSSKPNMLRCRTSIATTADEQPHIGNYRLLKTIGKGNFAKVKLARHVLTGKEVAVKIIDKTQLNSSSLQKLFREVRIMKVLNHPNIVKLFEVIETEKTLYLIMEYASGGEVFDYLVAHGRMKEKEARAKFRQIVSAVQYCHQKLIVHRDLKAENLLLDSDMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMRDRWMNVGHEEDELKPYVEPIPDYKDPKRTELMITMGYSREEISDSLVNQKYNEVMATYLLLGYRTSEMDNDNLTLKPRPPPDISNSIVTSPAHKVQRSVSANPKQRRLSDQAGPAIPNSNSYSKKTQSNNAENRRPEDEKESGRKSSSTVRVPPSPLSGLDRKKTTPTPSTNSVLSTGTNRSRNSPMLDRASLVPGSVQNGKDSFSTPGSRASTASAPATSARIRQHQKSMSTSVHPSKPAPSLEGNCDVQRPSTAPQRVPVASPSAHNISSSATERTNFPRGVSSRSTFHAGQVRQARDQQNLGFGSVSPASPSGNSQGRRGATGSIFSKFTSKFVRRNLSFRFPRRNPNEPEVKDRVESTRPHLSVVDKEKDKEDHRDSKPRSLRFTWSMKTTSSMEPNEMMREIQKVLDANNCQHESQEKYMLLCIHGSPGHDNYVQWEMEVCKLPRLSLNGVRFKRISGTSMAFKNIASKIANDLKL

SEQ ID NO: 13878 - protein, 678 aa, Apis mellifera
MGTLRELQELLRVKDEKIVELEALLCRRDAEIQELRSHLDKFLQCASLKLAFEPRRNPGPGSKGPRDFPRSHRFKSLPRCQLSNKRDRSRELIKAAILANDFMKNLELTQIRRDRGLHVSCSFSAGSTIIREGDVGSIVYVMEEGKVEVSRDGKYLSTLAPGKVLGELAILYNCKRTATITAATDCQLWAIDRQCFQTIMMRTGLSRQAEYTDFLKSVPIFKNLPEETLIKISDVLEETFYNNGDYIIRQGARGDTFFIISRGQVRVTIKQPDTPEEKYIRTLSKGDFFGEKALQGDDLRTANIIADDPEGVSCLVIDRETFNQLISSLDEIRTRYKDSSSSVEGWENRATIPELNEEFRDLRLQDLRPLATLGVGGFGRVELVQIAGDSSRSFALKQMKKAQIVETRQQQHIMSEKRIMGEADCDFVVKLFKTFKDRKYLYMLMEACLGGELWTVLRDKGHFDDGTTRFYTACVVEAFDYLHSRNIIYRDLKPENLLLDSQGYVKLVDFGFAKRLDHGRKTWTFCGTPEYVAPEVILNKGHDISADYWSLGVLMFELLTGTPPFTGGDPMKTYNIILKGIDAIEFPRSITRNATALIKKLCRDNPAERLGYQKGGISEIQKHKWFDGFNWEGLRARTLEPPIMPRVQNATDTTNFDEYPPDSDPPPPDDISGWDNDF

SEQ ID NO: 13879 - protein, 135 aa, Onchocerca volvulus
MRAKMLDTLAFIDPDAPSRRNHTYREFKHWLVTNIPGQNISEGEVLAEYVGAGAPKGTGFHRYVFLVYKQPGVIVDPEEGHVTSRSRKKRRYFRIGKFATKHNLGNPIAGNFFMAQYDDHVPKVHQQLDGLIPLL

SEQ ID NO: 13880 - protein, 561 aa, Arabidopsis thaliana
MSDLQTPLVRPKRKKTWVDYFVKFRWIIVIFIVLPFSATFYFLIYLGDMWSESKSFEKRQKEHDENVKKVIKRLKGRDASKDGLVCTARKPWIAVGMRNVDYKRARHFEVDLGEFRNILEINKEKMTARVEPLVNMGQISRATVPMNLSLAVVAELDDLTVGGLINGYGIEGSSHIYGLFADTVEAYEIVLAGGELVRATRDNEYSDLYYAIPWSQGTLGLLVAAEIRLIKVKEYMRLTYIPVKGDLQALAQGYIDSFAPKDGDKSKIPDFVEGMVYNPTEGVMMVGTYASKEEAKKKGNKINNVGWWFKPWFYQHAQTALKKGQFVEYIPTREYYHRHTRCLYWEGKLILPFGDQFWFRYLLGWLMPPKVSLLKATQGEAIRNYYHDMHVIQDMLVPPYKVGDALEWVHREMEVYPIWLCPHKLFKQPIKGQIYPEPGFEYENRQGDTEDAQMYTDVGVYYAPGCVLRGEEFDGSEAVRRMEKWLIENHGFQPQYAVSELDEKSFWRMFNGELYEECRKKYRAIGKFMSVYYKSKKGRKTEKEVREAEQAHLETAYAEAD

SEQ ID NO: 13881 - protein, 340 aa, Arabidopsis thaliana
MRGSALLESPMASSSIHSIQINPIFENGKGVELWKENGHPSPVLLKLMRDIVAGLVHLHDIGIVHRDLKPQNVLIVKNSSLCAKLSDMGISKRLPADTSALTRNSTGLGSGSSGWQAPEQLRNERQTRAVDLFSLGCVLFFCMTGGKHPYGDNYERDVNVLNDQKDLFLIESLPEAVHLLTGLLNPDPNLRPRAQDVMHHPLFWNSDMRLSFLRDASDRVELENREEGSQLLAALESTAAVTLNGRWDEKLDSIFLDNIGRYRRYKFDSIRDLLRVIRNKLNHYRELPKELQELLGSVPEGFERYFSSRFPKLLIQVYTVLFDYCNNEEFFFKYSKTTVF

SEQ ID NO: 13882 - protein, 297 aa, Arabidopsis thaliana
MDQYEKVEKIGEGTYGVVYKARDKVTNETIALKKIRLEQEDEGVPSTAIREISLLKEMQHSNIVKLQDVVHSEKRLYLVFEYLDLDLKKHMDSTPDFSKDLHMIKTYLYQILRGIAYCHSHRVLHRDLKPQNLLIDRRTNSLKLADFGLARAFGIPVRTFTHEVVTLWYRAPEILLGSHHYSTPVDIWSVGCIFAEMISQKPLFPGDSEIDQLFKIFRIMGTPYEDTWRGVTSLPDYKSAFPKWKPTDLETFVPNLDPDGVDLLSKMLLMDPTKRINARAALEHDTSRILEACLRKA

SEQ ID NO: 13883 - protein, 353 aa, Mamestra brassicae
MECCMSEEAKEQKRINQEIERQLRKDKRDARRELKLLLLGTGESGKSTFIKQMRIIHGSGYSDDDKRGFIKLVYQNIFMAMQSMIRAMELLTIQYGNPSNSEKAELISSIDFESVTTFESPYVEAIKALWADAGIQECYDRRREYQLTDSAKYYLQEIDRVAAPNYLPTEQDILRVRVLTTGIIEYPFDLEEIRFRMVDVGGQRSERRKWIHCFENVTSIIFLVALSEYDQILFESENENRMEESKALFKTIITYPWFQHSSVILFLNKKDLLEEKIMYSHLVDYFPEYDGPQRDANTAREFILRTFVDLNPDAEKIIYSHFTCATDTENIKLVFCAVKDTIMQSALKEFNLA

SEQ ID NO: 13884 - protein, 394 aa, Cricetulus griseus
MGCLGNSKTEDQRNEEKAQREANKKIEKQLQKDKQVYRATHRLLLLGAGESGKSTIVKQMRILHVNGFNGEGGEEDPQAARSNSDGEKATKVQDIKNNLKEAIETIVAAMSNLVPPVELANPENQFRVDYILSVMNVPNFDFPPEFYEHAKALWEDEGVRACYERSNEYQLIDCAQYFLDKIDVVKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 13885 - protein, 309 aa, Fusobacterium nucleatum subsp. nucleatum ATCC 25586
MEERILVLDGAMGTVLQKYELTLEDFNGAKGCYEILNETRPDIIFEVHKKYIEAGADIIETNSFNCNAISLKDYHLEDKVYDLAKKSAEIARDAVKKSGKKVYVFGSVGPTNKGLSFSVGDVPFKRAVSFDEMKEVIKVQVAGLIDGGVDGILLETVFDGLTAKVALLAIEEVFEEKNIKLPVSISATVNKQGKLSTGQSIESLMVDLDRDFVISFGFNCSFGAKNLVPLVIKIKELTTKFVSLHANAGLPNQNGEYEETAQKMRDDLLPLIENQAINILGGCCGTDYEHIKLIAELVKGQKPRILPKR

SEQ ID NO: 13886 - protein, 309 aa, Fusobacterium nucleatum subsp. nucleatum ATCC 25586
MSKKSTRQAYGEALVELGRINNDIVVLDADLSKSTKTDLFKKEFPKRHLNIGIAEADLMGTAAGFATCGKIPFASTFAMFAAGRAFEQIRNTIAYPKLNVKIAPTHAGISVGEDGGSHQSIEDIALMRAIPEMVVLCPCDAVETKKMVFAAAEYNGPVYLRLGRLDVETVLDDNYDFQIGIANTLRDGSDVTIVSTGLLTQEALKAAEELAKENISVRVINCGTIKPLDGEIILKAAQETKFIITAEEHSVIGGLGSAVSEFLSETHPTLVKKLGVYDKFGQSGKGAEMLEKYELTAAKLISMVKENLK

SEQ ID NO: 13887 - protein, 224 aa, Fusobacterium nucleatum subsp. nucleatum ATCC 25586
MKNIPAFIFAGFSGYAGYIALFNIATLFSSPSTLSVINALAPAITAIVAYFIFNERIKLIGCLSMGISFCGILILTLWDGVLTVNKGILYMLAGCLLLSLYNISQRYLTKKYSSFDVSMYSMLIGGILLVIYSPSSITNMFSISFTSLILIIYMSIFPSIISYFFWTKAFELAKHTTEVTSFMFVTPVLATLMGIIILGDIPKLSTLIGGVVIILGMILFNKTK

SEQ ID NO: 13888 - protein, 491 aa, Fusobacterium nucleatum subsp. nucleatum ATCC 25586
MENILKKSYKMFINGEWIDSSNGVMVKSYAPYNNELLSEFPDASESDIDFAIKSAKEAFKTWRKTTVKERARILNKIADIIDENKDLLATVETMDNGKPIRETKLVDIPLAATHFRYFAGCILADEGQATVLDEKFLSLILREPIGVVGQIIPWNFPFLMAAWKLAPALAAGDTVVLKPSSTTTLSLLVLMELIQDVIPKGVVNLVTGKGSTAGEFLKNHPDLDKLAFTGSTAVGRDIALAAAEKLIPATLELGGKSANIILDDADIEKALEGAQLGILFNQGQVCCAGSRIFVQEGIYDEFISKLVKKFENIKIGNPLDPTTIMGSQIDARQVKTILDYVEIAKQEGGVILTGGVKYTENGCDKGNFVRPTLITNVNNGCRVSQEEIFGPVAVVIKFKTDDEVIAQANDSEYGLGGAVFTKNINRALKLAREIQTGRVWINTYNQIPEHAPFGGYKKSGIGRETHKVILEHYTQMKNILIDLEEGTSGLY

SEQ ID NO: 13889 - protein, 243 aa, Fusobacterium nucleatum subsp. nucleatum ATCC 25586
MEDLMNRLEGKVAVVTGSARGIGRAIVEKLAAHGAKMVISCDMGETSYEQGNVVHKILNVTDREAIKAFVDEVEKEYGKIDILVNNAGITKDGLLMRMTEDQWDAVINVNLKGVFNMTQAVSRSMLKARKGSIITLSSVVGLHGNAGQTNYAATKGGVVAMSKTWAKEFGGRNVRANCVAPGFIQTPMTDVLSEDTIKGMLDATPLGRLGQVEDIANTVLFLASDESSFITGEVISVSGGLML

SEQ ID NO: 13890 - protein, 282 aa, Fusobacterium nucleatum subsp. nucleatum ATCC 25586
MQENHKYNIYMFIATIFFGMTYVLTKICLKYSTEFHIISFRFLIAFVVSLIFLQKKIFPVKRTEFLYSLLLGALLFLVFIAMTIGVKYTTATNASFLISLSVIFIPFFSWFFNKEKPKKRIFVVLIIALIGIILLTLDKNLEFHIGDILCLICATLFTFYVIMTEKIVKNNNPTALGVLQFGWVFLFSFLVQYPIESFVIPKNKFFWLSMVLLGIFCTAFGYIAQTIAQKNLSSTVVGFILSLEPVFSGIFGYFFLNEYLSFQQYIGAFLLLISVIYVSVKN

SEQ ID NO: 13891 - protein, 404 aa, Fusobacterium nucleatum subsp. nucleatum ATCC 25586
MKNILLGVTGGIAAFKSASIVSLLKKKGYNVKVVMTKNATNIIGPLTLETLSRNRIYVDMWDTNPHYEVEHISLADWADMVLIAPATYNIIGKVANGIADDMLTTILSAISVRKPVFFALAMNVNMYENPILKENVDKLKSYGYRFIEAEEGLLACNYVAKGRMSEPKDIVEEIERYNIYSKIENCDTTLKGKKLLITSGRTKENIDPIRYLSNNSSGKMGYCLVQAAVDLGAEVTLISGPTNLDIPKGLKNFISVESAIQMYEKVDEYFKDTDIFIACAAVADYRPKEYKKEKIKKSDSDLTIELVRNPDILAEMGKKKDKQLLVGFAAETNDIKKNALKKLEKKNLDIIVANNASTMGTDSNTIEVIKRDKSSVEIKQKNKIELAYDILLEVILELKKDKNE

SEQ ID NO: 13892 - protein, 851 aa, Fusobacterium nucleatum subsp. nucleatum ATCC 25586
MKQVYEFKDGGKEMVALLGGKGANLAEMAKIDLPIPKGIIISTTACNEYFKNDKKLSTVLEEEILTNIRVLEYETGKKFQSTKPLLVSVRSGAPVSMPGMMDTILNLGFNDYVAEKMLEITKDEKFVYSSYLRFVQMFSEIAKGINRKKFMHLKATDYKAQIIESKNIYREECGEMFPENYKAQILIAVKSIFDSWNNDRAILYRKLHNIDNNMGTAVVIQEMVFGNFNDKSGTGVLFTRNPSTGEDKIFGEVLLNAQGEDIVAGIRTPDNIELLKTSMPNIYNELAETVKRLEKHNRDMQDVEFTIEDSKLYILQTRNGKRTAEASLKIAMDLVKEGIITKEEAILKVEPASINKLLNGDFEEKYLKGATLLTKGLAASSGVAVGRIMFDAKRVKIREKTILVREETSPEDLQGMALAQGIVTLKGGATSHGAVVARGMGKCCVTGCSEIKIDEINKTMTVGKYTLKEGDFISVSGHTGEIYLGKIPLKENSFSDELKEFVLWASEIKRMGVRMNADTPEDVEQGKAFGAKGIGLCRTEHMFFKKDKIWTIREFILSDRGEEKEKALRKLHNLQKEDFLNIFKILEGDEANIRLLDPPVHEFLPKTLEDKKKMAEILSISVENIEKRIYRLKDENPMLGHRGCRLGVSYPELYRIQARAIIEAAYECAKKGIKVHPEIMIPFIMEAKELAYIRAEIEEEVENFFKEVGVTVEYKLGTMIEIPRACLLADEIAEYADFFSFGTNDLTQMSMGLSRDDSVKFLDDYREKGIWEGEPFYSIDTKAVTKLVEIGVKNGKTTKPNLTIGICGEHGGDPKSIEFFEGQKFDYVSCSPFRVPTAILAAAQSYLKLKK

SEQ ID NO: 13893 - protein, 303 aa, Fusobacterium nucleatum subsp. nucleatum ATCC 25586
MMNKKRYFGDLMLFLAAFIWGTAFVAQVTGMDRIGPFTFNMARSIIAIICLGAYLIITKSKLPKDIGVLLQGGLVCGFFIFMGTSLQQIGLQYTTAGKTGFITSFYILIIPFLTMIFLKHKIDLLTWISIIIGFIGLYLLAIPNLSDFTINRGDFIVFLGSFCWGGHILIIDYYSKKVSPVQLSFLQFVMLTILSGICALLFENETATMNNIFLSWKSIAYAGFLSSGIAYTLQMVGQKYTNPIIASLILSLEAVFAALAGYIMLDEVMTSREFLGCSIVFLAIIFSQIPKDIFKKKYVSLKK

SEQ ID NO: 13894 - protein, 448 aa, Fusobacterium nucleatum subsp. nucleatum ATCC 25586
MNIKEFLFEDKKLIKRIFKIAIPSLFDLLAQTLISTSDMIMVSSIGASAISSVGVGSAAFNAIIPALIAVAIGTTAILSRTYGAKNREEGQKALMQSYFIAIPIGIILMLSFFFFAKPIIEIVGNAKDLNLEDAIIYQKTTAIGFVFLSIGITTFYAFRALGKNKIPMIGNTMVLIVNIIFNYLFIYILKWGVFGAALATSIARGSVVIMCIYLIFVNKRQWISLNIKKMKFDYFIAKRIIKVGIPAAIEQLALRFGMLIFEIMVISLGNLNYAAHKIALTAESFSFNLGFAVSLAATALVGQELGKNSPKNALKNGYICTIIGLIIMSTMGLLFFIAPNLLISLFTDDPQVVSLSTMALRLVSICQPFLAISMILSGALRGAGATRSVLFITFFGIFLVRIPITYVFLYIFNMGLAGAWIVMTIDLIFRSSLCFYTFKKGKWKYLKV

SEQ ID NO: 13895 - protein, 346 aa, Fusobacterium nucleatum subsp. nucleatum ATCC 25586
MKRELALEFARVTEAAALAAHKWVGRGKKESADQAGVDAMRTMLNRLAIDGEIVIGEGEIDEAPMLYIGEKVGQIYNEEEKDSVTYVDPVDIAVDPVEGTRMTAQGQPNAITVLAVGKKGSFLKAPDMYMEKLIVGPEAKGKIDLSKPLEDNIHAVAKALKKELKDLMIVILDKPRHKELIKDLQAMGVKVYALPDGDVAGSILTCMIDSDVDMLYGIGGAPEGVISAAVIRALGGDMQARLKLRSEVKGASLENDKISKFEKLRCEEQGLKVGEILKLEDLAKDDEIIFSATGITGGDLLEGVKRKGNIARTQTLVVRGLSKTVRYINSIHNLDFKDEKITHLVK

SEQ ID NO: 13896 - protein, 600 aa, Fusobacterium nucleatum subsp. nucleatum ATCC 25586
MNEELTQRCEEIRKNLIEVVSKNGGHLGSNLGVVELTVCLDEIFDFKEDIVLFDVGHQAYIYKILTDRAERFDSIRTRKGLSPFLDPNESSYDHFISGHAGTALPAAVGFAIANPDKKVIVVVGDASISNGHSLEALNYIGYKKLENILIIVNDNEMSIGENVGFISKFLKKVISSGKYQNFREDVKSFINRIKADRVKRTLERLERSIKGYVTPFYALESLGFRFFNVFEGNNIEKLLPMLKKIKDLKGPTILLVKTEKGKGYCFAEEDKEKFHGIAPFNIETGNTYKSLVSYSEVFGNKILELGKEDENIYTLSAAMIKGTGLHKFSEEFPERCIDTGIAEGFTVTLAAGLAKSGKKPYVCIYSTFIQRAISQLIHDVSIQNLPVRFIIDRSGIVGEDGKTHNGIYDLSFFLSIQNFTVLCPTTAKELGQALEISKNFNLGPLVIRIPRDSIFDIENEEPLEIGRWKVIKKGSKNLFIATGTMLKIILEIYDKLQNRGIYCTIISAASVKPLDENYLLNYIKEYDNIFVLEENYVKNSFGTAILEFFNDNGIQKPLHRIALKSAIIPHGKREELLKEERLKGESLIERIEELIYGRKK

SEQ ID NO: 13897 - protein, 487 aa, Fusobacterium nucleatum subsp. nucleatum ATCC 25586
MNGKIVKEGITFDDVLLIPAKSDVLPNEVSLKTRLTKKITLNLPILSAAMDTVTESDLAIALARQGGMGFIHKNMSIEEQAAEVDRVKRSESGMITNPITLNKDSRVYQAEELMSRYKISGLPVIEDDGKLIGIITNRDIKYRKDLDQPVGDIMTSKGLITAPVGTTLEQAKEILLANRIEKLPITDQNGYLKGLITIKDIDNIIQYPNACKDELGKLRCGAAVGVAPDTIERVSALVKAGVDIITVDSAHGHSQGVINMIKEIKKNFPDLDIVGGNIVTAEAAKELIEAGVAAVKVGIGPGSICTTRVVAGVGVPQLTAVNDVYEYCKDKNIGVIADGGIKLSGDIVKALAAGGDCVMLGGLLAGTKEAPGEEIILEGRRFKIYVGMGSIAAMKRGSKDRYFQAGEVDNSKLVPEGIEGRIAYKGSVKDVVFQLAGGIKAGMGYCGTKTIKDLQINGRFVKITGAGLIESHPHDITITKEAPNYSK

SEQ ID NO: 13898 - protein, 331 aa, Fusobacterium nucleatum subsp. nucleatum ATCC 25586
MEDDSEDKIDENEDENDETEEHFTEFDDEFNPEYIEDVSEDELSNEKLLNLGNSAKVDEPIKMYLREIGQVPLLTHEEEIDYAKKAYEGDEEASKKLIESNLRLVVSIAKKHTNRGLKLLDLIQEGNIGLMKAVEKFEYTKGYKFSTYATWWIRQAITRAIADQGRTIRIPVHMIETINKIKKESRIYLQETGKDASPEILAERLGMEVDKIKAIQEMNQEPISLETPVGSEEDSELGDFVEDQKTTSPYEATNRAILREELDAVLKTLSPREEKVLRYRYGLDDSSPKTLEEVGKIFNVTRERIRQIEVKALRKLRHPSRKKKLEDFKVD

SEQ ID NO: 13899 - protein, 390 aa, Fusobacterium nucleatum subsp. nucleatum ATCC 25586
MIKMKKILILGSTGSIGTNALELIRNNREQYQVVGISGNKNIDLLKKQIEEFKPISIYVGSEQDAIYLKKEYSFIKEVYFGENGLAELSKNSDYDIILTAVSGAIGIDATVEAIKRGKRIALANKETMVSAGVYINKLLKEYPKAEIVPVDSEHSALFQSLQGFKKENLKKLIITASGGTFRGKDLAYLENVTVEQALKHPNWSMGKKITIDSSTLVNKGLEVIEAHELFNVDYDDIEVVIHPQSVIHSMVEYVDGSIIAQMGVANMKTPILYAFTYPEKEYNSSINFLDLIKNNNLTFEEADRKVLKGIDLAYRAGRTGDTMPTVFNASNEIAVELFMKKQIKFLDIYRIIEEAMNSHQVLTLNTDNALNVIKEVDREIRKKVREQWEK

SEQ ID NO: 13900 - protein, 583 aa, Fusobacterium nucleatum subsp. nucleatum ATCC 25586
MYLEKINSPEDVKKLNIEEMKVLAQEIREAIIKRDAIHGGHFGPNLGIVEATIALHYVFESPKDKFVFDVSHQTYPHKILTGRREAFTDEAHYDDVTGYSNQNESEHDHFILGHTSTSISLALGLAKARDVKGETGNVGAIVGDGSLSGGEALEGLDFAGGELKSNFIIVVNDNEMSIAENHGGLYKNLKLLRETEGKAECNLFKAIGLEYIFIKDGNNLEELIETLKKVKDINHPIVVHIYTQKGKGYKLAEEDKESWHYTMPFNIENGKPLNEDIEDYCNITKEYLIKKMKEDKTVVTITAGTPGDFGFSKKERDELGSQFVDVGIAEQTAVAMSSGMASKGAKPVFTVVSSFIQRTYDQLSQDLCINNNPATIVVFYGGAIGMTDVTHLGWFDIAMMSNIPNLVYLAPTTKEEHLAMLEWSIGQQEHPVAIRIPGGKVVSNGKKVTKDFSKLNTYEVNQKGEKVAIIGLGTFYQLGEKAAKLYEEKIGVKVTVINPMYITGVDEKLLEELKKDHSIVITLEDGVLDGGFGEKIARFYGNSDMKVLNYGLKKEFLDRYNIGKVLTKNRLKADLIVEDLLKF

SEQ ID NO: 13901 - protein, 434 aa, Fusobacterium nucleatum subsp. nucleatum ATCC 25586 [sequence omitted]

SEQ ID NO: 13902 - protein, 579 aa, Fusobacterium nucleatum subsp. nucleatum ATCC 25586
MEWVMKQNNLIKGIPASPGIAIGKAFLYKENKLEIDEKSNLSKEEEIERLVKGREIAKKQLEEIKENTLKKLGKDKADIFEGHITLLEDEELFSEIDSKISQKKCTAEFALNEAIDEYATMLANLEDTYFKERAGDLRDIGKRWLYGVMNEQIVDLSKLEPETIIVAKELNPSDTAQINLDNVLAFVTEIGGKTAHSSIMARSLELPAVVGVGAVLDELEDNQILIVDALKGEVIVSPDVETLQIYKEKREKFLKEKEELKALKDKEAISKDGIKVDVWGNIGSPNDVKGIISNGGFGVGLYRTEFLFMEKDSFPTEDEQFEAYKIVAEELKGYPVTIRTMDIGGDKSLPYMELPKEENPFLGWRAIRVCLDREEILRTQFKALLRASKYGKIKIMLPMIMDIVEVRKAKAIFEECKKELQEKGIEFDKNIMLGIMVETPAVAFRAKYFAKECDFFSIGTNDLTQYTLAVDRGNEKIANLYDTYNPSVLQAIKMLIDGAHDGGIKISMCGEFAGDENAIAILFGMGLDAFSMSGISIPRVKRIIMKLEKKECQNLVERVLSLSTASEIKEEIKKFMEKI

SEQ ID NO: 13903 - protein, 671 aa, Fusobacterium nucleatum subsp. nucleatum ATCC 25586
MDLLTQVMYIGIAVGIISLLAAFYYAKKVEHYQINIPKVEEITAAIREGAMAFLAAEYKILIVFVIVVAVALGIFISVPTAGAFILGAITSAIAGNAGMRIATKANGRTAIAAKEGGLAKALNVAFSGGAVMGLTVVGLGMFMLSLILLVSRTVGISVNDVTGFGMGASSIALFARVGGGIYTKAADVGADLVGKVEAGIPEDDPRNPATIADNVGDNVGDVAGMGADLFESYVGSIIATITLAFLLPVDDATPYVAAPLLISAFGIISSIIATLTVKTDDGSKVHAKLEMGTRIAGILTIIASFGIIKYLGLDMGIFYAIVAGLVAGLVIAYFTGVYTDTGRRAVNRVSDAAGTGAATAIIEGLAIGMESTVAPLIVIAIAIIISFKTGGLYGISIAAVGMLATTGMVVAVDAYGPVADNAGGIAEMSELPPEVRETTDKLDAVGNSTAAVGKGFAIGSAALTALSLFAAYKEAVDKLTSEALVIDVTDPEVIAGLFIGGMLTFLFSALTMTAVGKAAIEMVEEVRRQFREFPGIMDRTQKPDYKRCVEISTHSSLKQMILPGVLAIIVPVIIGLWSVKALGGLLAGALVTGVLMAIMMANAGGAWDNGKKQIEGGYKGDKKGSDRHKAAVVGDTVGDPFKDTSGPSLNILIKLMSIVSLVLVPLFVKFM

SEQ ID NO: 13904 - protein, 257 aa, Fusobacterium nucleatum subsp. nucleatum ATCC 25586
MIQKEAPKVKDDKNIKNVIAVMSGKGGVGKSTVTTLLAKELRKKGYSVGVMDADITGPSIPRLMGVSEQKMTSDGKNMYPVVTEDGIEIVSINLMIDENEPVVWRGPVIAGAVMQFWNEVVWGNLDYLLIDMPPGTGDVPLTVMKSFNIKGLIMVSVPQDMVSMIVTKAIKMARKLNMNIIGLIENMSYITCDCCNNKIYLTDENDTQTFLKENDVELLGELPMTKQIAKLTKGESEYPEETFSKIADRVMEKVKEL

SEQ ID NO: 13905 - protein, 374 aa, Rattus norvegicus
MDTAGKVIKCKAAVLWGTNQPFSIEDIEVAPPKAKEVRVKILATGICGTDDHVIKGTMVSKFPVIVGHEAVGIVESVGEEVTTVRPGDKVIPLFLPQCRECNPCRNPEENLCIRSDLTGRGVLADGTTRFTCKGKPVQHFMNTSTFTEYTVLDESSVAKIDAEAPPEKACLIGCGFSTGYGAAVKTAKVSPGSTCAVFGLGGVGLSVVMGCKAAGASRIIGIDINKDKFQKALDVGATECINPRDFTKPISEVLSDMTGNTVQYTFEVIGRLETMVDALSSCHMNYGTSVVVGAPPSAKMLSYDPMLLFTGRTWKGCVFGGWKSRDDVPKLVTEFLEKKFDLGQLITHTLPFHNISEGFELLYSGQSIRTVLTF

SEQ ID NO: 13906 - protein, 438 aa, Rattus norvegicus
MMLRWSGIWGLYPPRIFPSLLVVVALVGLLPVLRSHGLQLNPTASTIRGSEPPRERSIGDVTTAPSEPVHHPDDRNLTNLYIEHGAKPVRKAFPVLDIDYLHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLLYAVCLVGGEQINNIGLLDTLLFGSIISAVDPVAVLAVFEEIHINELLHILVFGESLLNDAVTVVLYHLFEEFASYEYVGISDIFLGFLSFFVVSLGGVFVGVVYGVIAAFTSRFTSHIRVIEPLFVFLYSYMAYLSAELFHLSGIMALIASGVVMRPYVEANISRPLHAVPVLAGIVPQMIVQKNRIDLNRRAFTPFFKQLHKTVPDQLDTPNRATSNFHFLFISI

SEQ ID NO: 13907 - protein, 237 aa, Camelpox virus CMS
MAMPSLYACSSIEDDFNYGSSVASASVHIRMAFLRKVYGILCLQFLLTTATTAVFLYFDCMRKFIQGSPVLILASMFVSIGLIFALTLHRHKHPLNLYLLCGFTLSESLTLASVVTFYDVHVVMQAFMLTTAVFLALTAYTLQSKRDFSKLGAGLFVTLWILILSGLLRIFVQSETVELVLSAFGALVFCGFIIYDTHSLIHKLSPEDYVLASINFYLDIINLFLHLLQLLEVSNKK

SEQ ID NO: 13908 - protein, 101 aa, Amblystegium humile
VEKAKFLYSAGFSLTVSPESMLTVAKHAAETGKYYMINLAAPFICQFFKDPLLKLFPYVDFIFGNESEARTFAQVQGWETEDTKVIAVKMAALPKASGTHK

SEQ ID NO: 13909 - protein, 101 aa, Amblystegium humile
VEKAKFLYSAGFFLTVSPESMLTVAKHAAETGKYYMINLAAPFICQFFKDPLLKLFPYVDFIFGNESEARTFAQVQGWETEDTKVIAVKTAALPKASGTHK

SEQ ID NO: 13910 - protein, 69 aa, Amblystegium humile
VEKAKFLYSAGFFVTVSPESMLTVAKHAAETGKYYMINLAAPFICQFFKDPLLKLFPYVDFIFGNESEA

SEQ ID NO: 13911 - protein, 79 aa, Amblystegium humile
VEKAKFLYSAGFFLTVSPESMLTVAKHAAETGKYYMINLAAPFICQFFKDPLLKLFPYVDFIFGNECEARTFAQVQGWE

SEQ ID NO: 13912 - protein, 101 aa, Amblystegium humile
VEKAKFLYSAGFFLTVSPESMLTVAKHAAETGKYCMINLAAPFICQFFKDPLLKLFPYVDFIFGNECEARTFAQVQGWETEDTRVIAVKMAALPKASGTHK

SEQ ID NO: 13913 - protein, 79 aa, Amblystegium serpens
VEKAKFLYSAGFFLTVSPESMLTVAKHAAETGKYYMINLAAPFICQFFKDPLLKLFPYVDFIFGNESEARTFAQVQGWE

SEQ ID NO: 13914 - protein, 101 aa, Amblystegium humile
  unsure (1)..(101): unsure at all Xaa locations
VEKAKFLYSAGFFLTVSPESMLTVAKHAAETGKYYMINLAAPFICQFFKDPLLKLFPYVDFIFGNESEARTFAXVQGWETEDTKVIAVKMAALPKASGTHK

SEQ ID NO: 13915 - protein, 97 aa, Amblystegium tenax
VEKAKFLYSAGFFLTVSPESMLTVAKHAAETGKYYMINLAAPFICQFFKDPLLKLFPYVDFIFGNESEARTFAQVQGWETEDTKVIAVKMAALPKAI

SEQ ID NO: 13916 - protein, 101 aa, Amblystegium varium
VEKAKFLYSAGFFLTVSPESMLTVAKHAAETGKYYMINLAAPFICQFFKDPLLKLFPYVDFIFGNESEARTFAQVQGWETEDTKVIAVKMAALPKAIGTAQ

SEQ ID NO: 13917 - protein, 101 aa, Amblystegium tenax
VKKAKFLYSAGFFLTVSPESMLTVAKHAAETGKYYMINLAAPFICQFFKDPLLKLFPYVDFIFGNESEARVFAQVQGWETEDTKVIAVKMAALPKASGTHK

SEQ ID NO: 13918 - protein, 101 aa, Amblystegium tenax
VEKAKFLYSAGFFLTVSPESVLTVAKHAAETGKYYMINLAAPFICQFFKDPLLKLFPYVDFIFGNESEARVFAQVQGWETEDTKVIAVKMAALPKASGTHK

SEQ ID NO: 13919 - protein, 79 aa, Amblystegium varium
VEKAKSLYSAGFFLTVSPESMLTVAKHAAETGKYYMINLAAPFICQFFKDPLLKLFPYVDFIFGNESEARTFAQVQGWE

SEQ ID NO: 13920 - protein, 101 aa, Amblystegium humile
VEKAKFLYSAGFFVTVSPESMLTVAKHAAETGKYYMINLAAPFICQFFKDPLLKLFPYVDFIFGNESEARTFAQVQGWETEDTKVIAVKMAALPKASGTHK

SEQ ID NO: 13921 - protein, 101 aa, Amblystegium tenax
VEKAKFLYSAGFFVTVSPESMLTVAKHAAETGKYYMIDLAAPFICQFFKDPLLKLFPYVDFIFGNESEARTFAQVQGWETEDTKVIAVKMAALPKASGTHK

SEQ ID NO: 13922 - protein, 101 aa, Amblystegium humile
VEKAKFLYSAGFFLTVSPESMLTVAKHAAETGKYYMINLAAPFICQFFKDPLLKLFPYVDFIFGNESEARTFAQVQGWETEDTKVIAVKMAALPKASEHAQ

SEQ ID NO: 13923 - protein, 101 aa, Amblystegium noterophilum
VEKAKFLYSAGFFLTVSPESMLTVAKHAAETGKYYMINLAAPFICQFFKDPLMKLFPYVDFIFGNESEARVFAQVQGWETEDTRVIAVKMAALPKASGTHK

SEQ ID NO: 13924 - protein, 100 aa, Amblystegium serpens
VERAKFLYSAGFFLTVSPESMLTVAKHAAETGKYYMINLAAPFICQFFKDPLLKLFPYVDFIFGNESEARTFAQVQGWETEDTKVIAVKMAALPKASGTH

SEQ ID NO: 13925 - protein, 100 aa, Amblystegium tenax
VEKAKFLYSAGFFVTVSPESMLTVAKHAAETGKYYMINLAAPFICQFFKDPLLKLFPYVDFIFGNESEARTFAQVQGWETEDTKVIAVKMAALPKASGTH

SEQ ID NO: 13926 - protein, 96 aa, Amblystegium noterophilum
VEKAKFLYSAGFFLTVSPESMLTVAKHAAETGKYYMINLAAPFICQFFKDPLLKLFPYVDFIFGNESEARTFAQVQGWETEDTKVIAVKMAALPKA

SEQ ID NO: 13927 - protein, 101 aa, Amblystegium fluviatile
VEKAKFLYSAGFFLTVSPESMLTVAKHAAETGKYYMINLAAPFICQFFKDPLLKLFPYVDFIFGNESEARTFAQVQGWETEDTKVIAVKMAALPEASGTHK

SEQ ID NO: 13928 - protein, 78 aa, Amblystegium fluviatile
  unsure (1)..(78): unsure at all Xaa locations
VEKAKFLYSAGFFLTVSPESMLTVAKHAAETGKYYMINLAAPFICQFFKDPLLKLFPYVDFIFGNESEARTFAXVQGW

SEQ ID NO: 13929 - protein, 325 aa, Rattus norvegicus
MSRPSSTGPSANKPCSKQPPPPQTPHAPSPAAPPAAATISAAGPGSSAVPAAAAVISGPGAGGGAGPVSPQHHELTSLFECPVCFDYVLPPILQCQAGHLVCNQCRQKLSCCPTCRGALTPSIRNLAMEKVASAVLFPCKYATTGCSLTLHHTEKPEHEDICEYRPYSCPCPGASCKWQGSLEAVMSHLMHAHKSITTLQGEDIVFLATDINLPGAVDWVMMQSCFGHHFMLVLEKQEKYEGHQQFFAIVLLIGTRKQAENFAYRLELNGNRRRLTWEATPRSIHDGVAAAIMNSDCLVFDTAIAHLFADNGNLGINVTISTCCQ

SEQ ID NO: 13930 - protein, 432 aa, Rattus norvegicus
MRPWEMTSNRQPPSVRPNQHHFSGERCNTPARNRRSPPVRRQRGRRERLSRHNSISQDENYHHLPYAQQQAIEEPRAFHPPNVSPRLLHPAAHPPQQNAVMVDIHDQLHQGTVPVSYTVTTVAPHGIPLCTGQHIPACSTQQVPGCSVVFSGQHLPVCSVPPPMLQACSVQHLPVPYAAFPPLISSDPFLLHPPHLSPHHPPHLPPPGQFVPFQTQQSRSPLQRIENEVELLGEHLQVGSFTYPPSAHPPTLPPSAPLQFLTHDPLHQEVSFGVPYPPFMPRRLTGRSRYRSQQPVPPPTYHPSLLPYVLSMLPVPPTVGPTFSFELDVEDGEVENYEALLNLAERLGEAKPRGLTKADIEQLPFYRFNPSNHQSEQTLCVVCMCDFESRQLLRVLPCNHEFHAKCVDKWLKGNRTCPICRADASEVHRDSE

SEQ ID NO: 13931 - protein, 374 aa, Rattus norvegicus
MPGAVEGPRWKQAEDIRDIYDFRDVLGTGAFSEVILAEDKRTQKLVAIKCIAKKALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTASHGELLTPTAGGPAAGCCCRDCCVEPGSELPPAPPPSSRAMD

SEQ ID NO: 13932 - protein, 159 aa, Streptococcus pyogenes MGAS8232
MPYSLEEQTYFMQEALKEAEKSLQKAEIPIGCVIVKDGEIIGRGHNAREESNQAIMHAEMMAINEANAHEGNWRLLDTTLFVTIEPCVMCSGAIGLARIPHVIYGASNQKFGGADSLYQILTDERLNHRVQVERGLLAADCANIMQTFFRQGRERKKNS

SEQ ID NO: 13933 - protein, 264 aa, Streptococcus pyogenes MGAS8232
MENMFSLQGKITLITGASYGIGFEIAKAYAQAGATIVFNDIKQELVDKGLAAYRELGIEAHGYVCDVTDEAGIQQMVSQIEDEVGVIDILVNNAGIIRRTPMLEMAAEDFRQVIDIDLNAPFIVSKVVLPSMIAKGHGKIINICSMMSELGRETVSAYAAAKGGLKMLTKNIASEFGEANIQCNGIGPGYIATPQTAPLRERQADGSRHPFDQFIIAKTPAARWGTTEDLAGPAVFLASDASNFVNGHILYVDGGILAYIGKQP

SEQ ID NO: 13934 - protein, 216 aa, Streptococcus pyogenes MGAS8232
MIKGIIFDMDGVLFDTEPFYLRRREDFFKTKGIPIDHLNSKDFIGGNLQELWKELLGKNRDDAIVKAITTDYDAYKQAHKPPYQKLLITEVNSCLGQLKKQGIKLAVASNSKRQDVLLALETTQIKDYFEIILAREDVSRGKPYPDIYNKAVQKLGLQKKQLLVVEDSQKGIAAAKAANLTVFAITDYRYGIDQSQADHKIDHLGQLCVKIGCFGS

SEQ ID NO: 13935 - protein, 369 aa, Streptococcus pyogenes MGAS8232
MTKQKEITTFNVQVAEFIRYHKKEGTAIDDDVTEKLVIPFALDADQIDDLLERLTDGGISITDKEGNPSSKYIVEEPKPEELTDEELIGSNSAKVNDPVRMYLKEIGVVPLLTSEEEKELAVAVAKGDLMAKQRLAEANLRLVVSIAKRYVGRGMQFLDLIQEGNMGLMKAVDKFDYSKGFKFSTYATWWIRQAITRAIADQARTIRIPVHMVETINKLVREQRNLLQELGQDPTPEQIAERMEMTPDKVREILKIAQEPVSLETPIGEEDDSHLGDFIEDEVIENPVDYTTRVVLREQLDEVLDTLTDREENVLRLRFGLDDGKMRTLEDVGKVFNVTRERIRQIEAKALRKLRHPSRSKQLRDFIED

SEQ ID NO: 13936 - protein, 327 aa, Streptococcus pyogenes MGAS8232
MFNEIPVFDYEDIQLIPNKCIITSRSQADTSVTLGKYQFKLPVIPANMQTIIDETIAEQLAKEGYFYIMHRFDEDSRKPFIKRMHEQGLIASISVGVKAYEYEFVTSLKEDTPEFITIDIAHGHANSVIDMIKHIKTELPETFVIAGNVGTPEAVRELENAGADATKVGIGPGKVCITKVKTGFGTGGWQLAALRWCAKAARKPIIADGGIRTHGDIAKSIRFGASMVMIGSLFAGHIESPGKTVEVNGETFKEYYGSASAYQKGEHKNVEGKKILLPTKGHLSDTLTEMQQDLQSSISYAGGKDLDSLRHVDYVIVKNSIWNGDSI

SEQ ID NO: 13937 - protein, 181 aa, Streptococcus pyogenes MGAS8232
MTKHITLAVSGSISAYKAADLTSQLTKIGYDVHIIMTQAATQFITPLTLQVLSKNAIHLDVMDEHDPKVVNHIELAKRTDLFIVAPASANTIAHLAYGFADNIVTSVALALPATTPKLIAPAMNTKMYQNPITQENIKRLSTIGFTEIPPKSSLLACGDKGPGALADIDVILATIDTIWKL

SEQ ID NO: 13938 - protein, 259 aa, Streptococcus pyogenes MGAS8232
MTHTKEVAFITGAASGIGKQIGETLLKEGKTVVFSDINQEKLDQVVADYTKEGYDAFSVVCDVTKEEAINAAIDTVVEKYGRIDILVNNAGLQHVAMIEDFPTEKFEFMIKIMLTAPFIAIKRAFPTMKAQKHGRIINMASINGVIGFAGKSAYNSAKHGLIGLTKVTALEAADSGITVNAICPGYVDTSLVRGQFEDLSKTRGIPLENVLEEVLYPLVPQKRLIDVQEIADYVSFLASDKAKGVTGQACILDGGYTAQ

SEQ ID NO: 13939 - protein, 279 aa, Streptococcus pyogenes MGAS8232
MVTTVKMTSGYEIPVLGFGTYQAADGEEAYQSTLAAIKAGYRHIDTAAIYKNEESVGRAIKDSGVLREDLFITTKLWNDAHSYEGAKDALAASLDHLGLDYVDLYLIHWPNPKALRNTWKEANAQAWQYMEEAVEAGLIKSIGVSNFMVHHLEALQETAKITPAINQIRLAPGCYQKEVVDYCKANEILLEAWSPLGQGEIFDNETMQQLANKYDKTVAQVALAWSLAEGFIPLPKSVHDERIKENMAIFDVSLTQEDKKTIRYLSGMSAIPNPDTTSF

SEQ ID NO: 13940 - protein, 244 aa, Streptococcus pyogenes MGAS8232
MEIKGKNIFITGSTRGIGLAMAHQFASLGANIVLNGRSAISEELVASFTDYGVTVVTISGDVSEASEAKRMVNEAIESLGSIDVLVNNAGITNDKLMLKMTEEDFERVLKINLTGAFNMTQSVLKPMIKARQGAIINVSSVVGLTGNIGQANYAASKAGMIGFTKSVAREVAARNICVNAIAPGFIESDMTGVLPEKMQEQILSQIPMKRIGKAQEVAHLASFLVEQDYITGQVIAIDGGMTMQ

SEQ ID NO: 13941 - protein, 193 aa, Streptococcus pyogenes MGAS8232
MGWWKESIAIVKALDPAARNSLEVILTYPGIKALAAHRLSHFLWRHHFKLLARMHSQFWRFWTQIEIHPGAQIAPGVFIDHGAGLVIGETAIVEKGVMLYHGVTLGGTGKDCGKRHPTIRQGALISAHAQVIGPIDIGANAKVGAAAVVLSDVPEDVTVVGVPAKIVRVHGQKDNRQIQSLQKQREVSYQLSK

SEQ ID NO: 13942 - protein, 250 aa, Bacillus sp. COT1
MTVKKLYFVPAGRCMLDHSSVNSTIAPGNLLNLPVWCYLLETEEGPILVDTGMPESAVNNENLFEGTFAEGQILPKMTEEDRIIAILKRAGYEPDDLLYIISSHLHFDHAGGNGAFINTPIIIQRAEYEAAQYREEYLKECILPNLNYKIIEGDYEVVPGVQLLYTPGHSPGHQSLLIETEKSGVVLLTIDASYTKENFEDEVPFAGFDPELALSSIKRLKEVVMKEKPLVFFGHDIEQEKGCKVFPEYI

SEQ ID NO: 13943 - protein, 250 aa, Bacillus thuringiensis
MTVKKLYFIPAGRCMLDHSSVNSALTPGKLLNLPVWCYLLETEEGPILVDTGMPESAVNNEGLFNGTFVEGQILPKMTEEDRIVNILKRVGYEPDDLLYIISSHLHFDHAGGNGAFTNTPIIVQRTEYEAALHREEYMKECILPHLNYKIIEGDYEVVPGVQLLYTPGHSPGHQSLFIETEQSGSVLLMIDASYTKENFEDEVPFAGFDPELALSSIKRLKEVVKKEKPIIFFGHDTEQEKSCRVFPEYI

SEQ ID NO: 13944 - protein, 250 aa, Bacillus thuringiensis
MTVKKLYFIPAGRCMLDHSSVNSALTPGKLLNLPVWCYLLETEEGPILVDTGMPESAVNNEGLFNGTFVEGQILPKMTEEDRIVNILKRVGYEPDDLLYIISSHLHFDHAGGNGAFTNTPIIVQRTEYEAALHREEYMKECILPHLNYKIIEGDYEVVPGVQLLYTPGHSPGHQSLFIETEQSGSVLLTIDASYTKENFEDEVPFAGFDPELALSSIKRLKEVVKKEKPIIFFGHDIEQEKSCRVFPEYI

SEQ ID NO: 13945 - protein, 250 aa, Bacillus thuringiensis
MTVKKLYFVPAGRCMLDHSSVNSTLAPGNLLNLPVWCYLLETEEGPILVDTGMPESAVNNEGLFNGTFVEGQILPKMTEEDRIVNILKRVGYEPDDLLYIISSHLHFDHAGGNGAFTNTPIIVQRTEYEAALHREEYMKECILPHLNYKIIEGDYEVVPGVQLLYTPGHSPGHQSLLIETEKSGLVLLTIDASYTKENFEDEVPFAGFDSELALSSIKRLKEVVMKEKPIIFFGHDIEQEKGFKVFPEYI

SEQ ID NO: 13946 - protein, 250 aa, Bacillus thuringiensis
MTVKKLYFVPAGRCMLDHSSVNSALTPGKLLNLPVWCYLLETEEGPILVDTGMPESAVNNEGLFNGTFAKGQILPKMTEEDRIVTILKRAGYEPDDLLYIISSHLHFDHAGGNGAFLNTPIIIQRAEYEAAQHREEYLKECILPDLNYKIIEGDYEVVPGVRLLYTPGHSPGHQSLLIETEKSGPVLLTIDASYTKENFEDEVPFAGFDSELALSSIKRLKEVVMKEKPIVFFGHDIEQEKGCKVFPEYI

SEQ ID NO: 13947 - protein, 250 aa, Bacillus thuringiensis
MTVKKLYFIPAGRCMLDHSSVNSTLAPGNLLNLPVWCYLLETEEGPILVDTGMPESAVNNEGLFNGTFVEGQILPKMTEEDRIVNILKRVGYEPDDLLYIISSHLHFDHAGGNGAFTNTPIIVQRAEYEAALHREEYMKECILPHLNYKIIEGDYEVVPGVQLLYTPGHSPGHQSLFIETEQSGSVLLTIDASYTKENFEDEVPFAGFDPELALSSIKRLKGVVAEEKPIVFFGHDIEQEKGCRVFPEYI

SEQ ID NO: 13948 - protein, 250 aa, Bacillus thuringiensis
MTVKKLYFVPAGRCMLDHSSVNSTLAPGNLLNLPVWCYLLETEEGPILVDTGMPESAVNNEGLFNGTFVEGQILPKMTEEDRIVNILKRVGYEPDDLLYIISSHLHFDHAGGNGAFTNTPIIVQRAEYEAALHREEYMKECILPHLNYKIIEGDYEVVPGVQLLYTPGHSPGHQSLFIETDNSGSVLLTIDASYTKENFEDEVPFAGFDPELALSSIKRLKGVVAEEKPIVFFGHDIEQEKGCRVFPEYI

SEQ ID NO: 13949 - protein, 250 aa, Bacillus cereus
MTVKKLYFIPAGRCMLDHSSVNGTLAPGNLLNLPVWCYLLETEEGAILVDTGMPESAVNNEGLFNGTFVEGQILPKMTEEDRIVNILKRVGYEPDDLLYIISSHLHFDHAGGNGAFTNTPIIVQRTEYEAALHREEYMKECILPHLNYKIIEGDYEVVPGVQLLYTPGHSPGHQSLFIETEQSGSVLLTIDASYTKENFEDEVPFAGFDPELALSSIKRLKGVVAKEKPIVFFGHDIEQEKGCRVFPEYI

SEQ ID NO: 13950 - protein, 520 aa, Trametes versicolor
MSRFHSLLAFVVASLAAVAHAGIGPVADLTITNAAVSPDGFSRQAVVVNGGTPGPLITGNMGDRFQLNVIDNLTNHTMLKSTSIHWHGFFQKGTNWADGPAFINQCPISSGHSFLYDFQVPDQAGTFWYHSHLSTQYCDGLRGPFVVYDPNDPAADLYDVDNDDTVITLADWYHVAAKLGPAFPLGADATLINGKGRSPSTTTADLTVISVTPGKRYRFRLVSLSCDPNHTFSIDGHNMTIIETDSINTAPLVVDSIQIFAAQRYSFVLEANQAVDNYWIRANPSFGNVGFTGGINSAILRYDGAAAIEPTTTQTTSTEPLNEVNLHPLVATAVPGSPVAGGVDLAINMAFNFNGTNFFINGASFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDALDPSDQ

SEQ ID NO: 13951 - protein, 564 aa, Mus musculus
GTRDREGPRGPRSGASQENEQWKKETLEDEFSGVRLQKLEQQRQLFEKKQRRKRQEPLMVQANPDATLRHRRPRRGEERFQSDSSWGLGVGSPFLQENVPQAHLPSGAHSALVTMSYVADGSGERAPLLSPRGAVYTRGNGPAVRHHLCWLPDSSDSDVEEVTMEDIPVISRPPQTNLANLRRGWLASPGPGISQEEKEEEVGSTDARVEDKTPSPDPDPDPTVNSDGDHGDLAPCKVEENTAQKNTETASGIGDEDREKGEVTESTETNYAPVASKVLQGDDGDASNHNAWNMTCPQPRIPGPRLGEDMEAYVLLPAPRDHMVQWRIVRNKHGMDKGMFPSYYLYLEGEDGVAHFLLAGRKRKRSKTSNYLISLDPKDMSRNGSNFVGKVRSNVLGTKFTIFDNGVNPERSYWVPDSARIREELGVVCYETNVLGFRGPRKMTVILPGMDSRKQRMKVQPQNDQDSILSRVQKGAGHGLLLLQNKAPSWSDESGAYVLNFHGRVTRASVKNFQIVHPDEPDHLVLQFGRVAPNIFTMDFRYPLCPLQAFAICLSSFDGKLACE

SEQ ID NO: 13952 - protein, 210 aa, Drosophila melanogaster
MKLPALHLLFLGFICLARSQDNDENVRRIMKEMEVIPEILDEPPRELLRIKYDNTIDIEEGKTYTPTELKFQPRLDWNADPESFYTVLMICPDAPNRENPMYRSWLHWLVVNVPGLDIMKGQPISEYFGPLPPKDSGIQRYLILVYQQSDKLDFDEKKMELSNADGHSNFDVMKFTQKYEMGSPVAGNIFQSRWDEYVPELMKTLYGVSE

SEQ ID NO: 13953 - protein, 386 aa, Lactococcus lactis subsp. lactis
MDSPKTLARVEVKENGDTFNVKAYEKAVKSYITKRKPLGEALDEEIMDELSVKFGIVDDALEDLFKQIQDAGISIVDKDGNPSPLALVTDEIEKEEVSDTAMDEIVTNVRIDDPVRMYLKEIGRYPLISLDEETKLAEAIIAGGEGAEFAKQMLAEANLRLVVSIAKRYSGRGMQFLDLIQEGNMGLMKAVDKFDHTKGFKFSTYATWWIRQAITRAIADQARTIRIPVHMVETINKLIRVQRNLLQELGRDPSPEEIGKELHMAPDKVREVLKIAQEPVSLETPIGEEDDSHLGDFIEDDVIESPVDYTNRILLREQLDEVMDTLTDREENVLRMRFGLDDGRMHTLEDVGKQFKVTRERIRQIEAKAIKKLRHPRRSKPLRDFM

SEQ ID NO: 13954 - protein, 374 aa, Schizosaccharomyces pombe
METDPILKVEREPEFTPSPAPEAIVKDIEQGVAPVSQNEPDRPQHWITRVVIIVLIVLAWYFFSLLLSMMNKWIFSESKMDFQFPLFLSSCQMLVQMGFAKLTILAFPRYQPNKKDNFSWLEYFYRAGICALVTGLDIGLSNASLETITLSFYTMCRSSILIFVFFFSVIFRIEMFDWILLCITLVISAGVVLMVATETQFVLSGFLLVMASSVLSGLRWALTQKLLLDHPWTSNPFTSLFALTPLMFLFLLVAGLIFEGPVRFIESPAWKEFGPFMSVVILVPGTLAFFMVASEFGLIQKTSIVTLSVCGILKEIITIIASTLFYHDILLPINIVGLVITLCGIGVYNYYRITKGNKKEAEKEVEYIVLNENA

SEQ ID NO: 13955 - protein, 261 aa, Azospirillum brasilense
MTLTQKVAVVTGSTSGIGLGIARALAGAGADVVLNGFGDAAAIEELRAGLAAEFGVRVGYHGADLSKPAEIAALIGHAEETFGSVDVLVNNAGIQHVAPVEDFPADRWDAVIALNLSAVFHGTHHALPGMKRRGWGRILNIASVHGHVASVNKSAYVAAKHGVVGLTKTVALETASTGVTCNAICPGWVLTPLVQKQIDAIASTKNIPEPQAKAELLGAKQPSGAFVTPDELGGLAVFLCSDSAAQMTGASLLMDGGWTAQ

SEQ ID NO: 13956 - protein, 103 aa, Eimeria tenella
MSGRGKGGKGLGKGGAKRHRKVLRDNIQGITKPAIRRLARRGGVKRISGLIYEEIRGVLKVFLENIIKDSVTYTEHARRKTVTAMDIVYSLKRQGRTLYGFGG

SEQ ID NO: 13957 - protein, 291 aa, Danio rerio
MEHQLFCCEVDTIRRAYQDSNLLNDRVLQTMLKAEENYLPSPNYFKCVQKEIVPKMRKIVATWMLEVCEEQKCEEEVFPLAMNYLDRFLSVEPTKKNRLQLLGATCMFLASKMKETVPLTAEKLCIYTDNSVRPGELLQMELLALNKLKWDLASVTPHDFIEHFLAKLPIHQSSKQILRKHAQTFVALCATDVNFIASPPSMIAAGSVAAAVQGLYLKSTDSCLSSQNLTNFLSQVIRSDPDCLRSCQEQIESLLESSLRQAQQHISTETKRVEEDVDLSCTPTDVRDINI

SEQ ID NO: 13958 - protein, 816 aa, Legionella pneumophila
MRRENTKSNIDFKSIFDSLPDLYLLLDRDFNIVGVSDAYLQATMVSRKQILGKNVFDAFPDNPNDPKATGAKNLYASLLRVLKNKSADTMAIQKYDIQRPADRGGGFEERYWSPINTPVLGADQEVEYIIHRVEDVTEFVHLKKTGSAQLKLMEELRTKAGEMEIEIYQRAQEIQEANKQLEEANKNLARLDQIKTQFFANVSHELRTPLMLILDPLEMLLAEKKLPSFVQNTLRRIQNNAQILLKHVNDLLNISKLDAGKMILHYANIDLVKLIQQTIALFEAQIPERKLVFSMDLPDELQAQIDPDKIQHVLINILSNAIKFTPQNAKVRIRLVQINPETCRLQIEDNGPGIPSDLCETIFERFFQIEESTTRTVGGTGLGLSIAKDFVELHGGSILAGNARNGGAIFTIELPLKAPQNAKVYSSYSQLLLGEKEISASLAEFRNKVKPIKEGAEEYFEQDYYDRPLILVVEDNQEMNHFICKILNTFYRTESAFDGREGLQKSLALHPDLIVSDIMMPHMSGVEMVHAIREHPLLLKTPIIILTAKADDELTARMLEEGAQDYVIKPFSAKEFKARVANLILVKKAEDELDQFVYHASHDLKAPLPAMEHLISWIEEDLGEMLSEQSKKYLLLLRQRASRMSKLLDGLLKYAQSGYVFDKVRTIHTDRLITDIIKKLNPPQTVTFQLEDTLPVLNTCELPLREVFTALLDNSIRHHHRKDGHIIIGTKEKDRFYEFFVADDGPGIEKKYQDRIFQLFQTLQPRDKLETSGVGLSIAKKIVEFQGGKISVESEKNKGSVFRFLWPKDKEIGDAC

SEQ ID NO: 13959 - protein, 1060 aa, Legionella pneumophila
MVWSGISLSAWVWCSACHSRKDSIVALIRFLWKDTNMVQKDLRCLIRNYCFIFSFLLLGSSALFAQHEQHGASTQPLPHPKTTSSQSKPAQYKMKQPIPVKTVTPLTMTGGAKRTVNLVVAYKTVNFAGKPRRAIAVNGQIPAPTLHFKEGDDVTINVYNHLDEGTSIHWHGLLVPWQMDGVDEVSQKPIPPGGVFHYRFKLYQRGTYWYHAHAKVQEQEGLYGTFIIDPPKPPSYQYTKDYVVVLSDWSNTPAEQVLANLKKDGDYYGPRFPLQPSLMKFLHDYRKASPEERKKLIADYKMMQQMRMSIYDLSDVAYDAYLLNGHPKSHPWTAPVKVGDRVRLRFIGAGASTIYRVKIPDAKVEMVHIQGNDVRPYPIEDFWIAPGETYDVLVTIQKNKPYVIYAESIDTLGKAYGALVTYPNQVVNYQHVTPFPEPLPVTREMMANMMMSMNGGGMGGNQQHALMNKKTSSTAMKPSMTMPSHSQAMSSQSANHSMSSKTIQKKMDKASNHSAHTSSMKSKSSSTSMNKSMDMPGMNHGAMSQNKTSNSAQMKSDSSSTSMNKSMAMPGMNHGAMSQSKTSNSAQIKSDSSSTSMNKSMAMPDMNHSAMGQNKTSNSANDTSMNRNMKSDRPMEQGMSMNGSMNMKMPIEPTIIGDKIEPPDSAKATTLGTKYQELKGAVKTNNPNKPVDGIIKMELFGYMDRYIWFINGLPEYKAKPILIEPGKRYRIIFTNNSMMRHPMHIHGHWFILRNGHGAYDPLLHTIEVPPGATAVADFDTEASGQWFFHCHHLLHMTAGMARVFQYTTIIEIANGTRKPDNYAYQQAYINRPVVREDEVMPLDASLIKHPAGHHQGFYRSSYIELGEDPFHNAQEMTFRGLYGPDYNKLQLYTEDAEIYKGTVENADIDVFYWHLISQFWAVKGGVNYFYRPGGPYWQPGIGIEGLMPWYIDTNIRTYYRDGSVKFDIQLARANQLTNNFFFLTGIRSILATHTVVKNEIGNGLNQMRYILRPYYRLKPGLNIFSEYEHDVEYGALKRILRSQGEPTTQDTITLGVAVLF

SEQ ID NO: 13960 - protein, 330 aa, Oryza sativa (japonica cultivar-group)
MAMVFLQFGFAGLFLISVASLRQGMSHYVLVVYRNAVAAVVMAPFALWFERPVLDQNFFYMGAKNTSASFSSALTNILPAVTFVNAIILRMERISIKERRSQAKIAGTLITVGGAMLMILFKGPVINFPWTKNANHNISDSSDHNNGHWLMGIFMILLSCFCWSAFFILQSYTLRGYPAELSLTTLICAMGVAQSGAVALVMERDIKAWLIGFDMRLFTAVYSGIMCSGVAYYVQGMVIKERGPVFVTAFSPLCMIIVTILGSFILCEVVTLGRVIGAIIIVVGLYALIWGKNKDHGNQVDQDDNFEKQKTFELPLSTTNVNEARSPNHI

SEQ ID NO: 13961 - protein, 119 aa, Oryza sativa (japonica cultivar-group)
MAFLRKVGNLVRQSAGSGSPLFQAVRCMSSSKLFIGGISYGTDDQSLKEAFANYGEVIEARVIVDRTTGRSRGFGFVTYTSTDEAAAAITGMDGKTFPKTEPFGHAGWQRCFATPATVA

SEQ ID NO: 13962 - protein, 58 aa, Neillia thyrsiflora
VARGKKNGLDYLFHLYEQCRDFLIQVQNIAKERGEKCPTKVTNQVFRYAKKAGASYIN

SEQ ID NO: 13963 - protein, 58 aa, Lyonothamnus floribundus
VARGKKNGLDYLFHLYELCRDFLIQVQNIAKERGEKCPTKVTNQVFRHAKKAGASYIN

SEQ ID NO: 13964 - protein, 58 aa, Vauquelinia californica
VARGKKNGLDYLFHLYEQCRDFLVQVQNIAKERGEKCPTKVTNQVFRYAKKAGASYIN

SEQ ID NO: 13965 - protein, 58 aa, Kageneckia oblonga
VARGKKNGLDYLFHLYEQCRDFLIQVQNIAKERGEKSPTKVTNQVFRYAKKAGASYIN

SEQ ID NO: 13966 - protein, 58 aa, Fragaria nubicola
VARGKKNGLDYLFHLYEQCHQYLTQVQNTAKERGEKCPTKVTNEVFRYAKKQGANYIN

SEQ ID NO: 13967 - protein, 490 aa, Guillardia theta
MNQLKNEKTLAFQKFGNFGSSIFLGDLISTNQNFFRNNKKDFNVEKSKKFLPLFGQIHKSKMNLNLDSSIISKDSLVNNTRKVFHELTEGEMEEVIRSFGIHNGARNDTGEEDGSITKPQTVKGLHKADDSVRWYLQLIGRVRLLRPEEEIQLAREISQLLHWEHVKISLREKLQREPTSSEWTAACKVSDVKKFRSILHNARRAKERMVAANLRLVVSIAKRYVNRGMSLQDLIQEGSLGLIRAAEKFDSEKGFKFSTYATWWVKQAVTRAIADHSRTIRLPVHLYDTISAIRKTTRTLNIEIGRSPTEEEIAEKMDMSVEKLRSVLQSAQPTLSLERPLKNDDDASQLSDFIEADQESPEEHVEKSMLRDDLENVINSLSPRERDVVRMRYGLDDGRIKTLEEIGQIFSVTRERVRQIEAKAIRKLRQPYRSSILRDYVLATPSNLDRNLNTNLSNLTLSHRTLSRGSLHTRMIRPKRNGRISRFNHN

SEQ ID NO: 13968 - protein, 431 aa, Cyanophora paradoxa
MPSAFVSGLPGRSAAAVSLQAPGIAHVALAVRPSRDRPAIVELDRQFLGSSLRRPSTQFVGRIKRPERLVDVAPAPPPASPHASAAVLVEEVAAPVAPPRAPRVARKGLSEDSGRRYLQEIGEISLLKAEDEIELAKRIETFRKLEKVKEHMKWKTGVEPTDEEWARAAALSDAEELRHMVRVGTLARDRLVRANLRWVVAVAKKYHKQRGTMSMQDLIQEGNIGLIRAVEKFDPRMGYRFTTYATWWIRQAITRSIQNSSREIRLPAHRHEKINRIKRATVALSRSLGRQPTEAEIAEHVGLDPSRMRKFVESAAAVATVSLDVPINESDNQSATIGDFIRSENEGPADRAERELMRESVARTLAKALSEREYMVLRMRFGLDDGEPKTLNQVGETLGVTRERVRQIEMKALRKLRRPGFSSALRDLSSD

SEQ ID NO: 13969 - protein, 427 aa, Cyanophora paradoxa
MMEAAFAVPAAVRQASNAAPSPAPRDIGFCSLLAPAPRRRIARTWAGEQVSGPRFEHSGRKSLQWVSSSVRMEAAAPPETKEEKPKVSMPVERRGRRAGGSSDSFNSFIKEVGSFELLSAEEEIELSRQIRDLVQLETVKKRLAARIGREPREDEWAMAAGTQPGPAFQSRILKGRRARARLVQSNLRWVVSIAKKYANKHTMPLQDLIQEGSIGLMKAAERFDLDKGFKFLTYATWWIRQAIFRSLQDQGRTIRLPVHVHDSLYLIKKTRQQLASRLGRIPTPEELADELNIPVSRLAFITQAASLPISLESPISSETSSTKARNNLGDFIESECLQPDEQLERTMLREDLENVLATLKARERDIIRMRYGLVDGSPKTLDEIGEIVGLTRERIRQIEQSAMRKLKAPYRKAILCDYIGQEFRRFK

SEQ ID NO: 13970 - protein, 431 aa, Glycine max
MVLSWSRRNVFRRAKKEKSQTQLEVEVVIPNHFHCPVSLELMTDPVTLSTGITYDRVSIEKWIEGGNRTCPVTNQVLTTFDIIPNHAIRRMIQDWCVENSSYGIDRIPTPRIPISAYEVSDTCTRILSACQRGDDKRCQELVGKIKVWSRESERNKRCIVGAGAGAVLAYAFDCFSSNSIEKHVVLLEEVLEVMTWMVPLGEEGVSKLSSGASLNSLVWFLEGKDLASRQSAALLLKEVCVQELAKVGEVVEALVKMVREPIGSTSTKACLATIFNLVSLAANREGIAQRFVELGLVSLLLEAIVDGEKGVCEKALGVLDCICDCEKGKEVVKSNALALPLVVRKLLRVSPLASGFAVSILRKICDKREEGILIEALQVGLFQKLSVLLQVGCDESTKENATGLLKLLNGYRNKAECTDSSLNFEHLKKPF

SEQ ID NO: 13971 - protein, 567 aa, Glycine max
LQLPTLLILCFFLILGNFHKAEARIRHHKWEVKYEFRSPDCFKKLVITINGKTPGPTIQAQEGDTIVVQVNNSLVTENLSIHWHGIRQIGTPWFDGTEGVTQCPILPGDTFIYQFVVDRPGTYLYHAHYGMQREAGLYGMIRVAPRDPEPFAYDLDRSIILNDWYHKSTYEQAAGLSSIPFQWVGEPQSLLIHGKGRFNCSKSPSVSTDVCDTSNPQCSPFVQTVIPGKTYRLRIASLTALSALSFEIEGHNMTVVEADGHYVEPFEVKNLFIYSGETYSVLVKTDQDPSRNYWITSNVVSRNRTTPPGLGMFNYYPNHPKRSPPTVPPSPPAWDDVEPRLAQSLSIKARQGYILKPPTTSDRVIVLLNTQNNISEYRHWSVNNVSFTLPHTPYLISLKENITGAFDPTPPPDGYDFANYDIFSVASNANATSSSGIYRLKFNTTVDIILQNANTMNKNNSETHPWHLHGHDFWVLGYGKGKFDVNNDTKKYNLENPIMKNTVPVHPFGWTALRFRTDNPGVWAFHCHIESHFYMGMGVVFEEGIERVGKLPSSIMGCGQTRGFHRP

SEQ ID NO: 13972 - protein, 458 aa, Pyrus pyrifolia
MATGVIDKLKSHVATLSQISENEKNGFINLVARSVSGEAQHVDWSKIETPTDEVVVPHAGLEPAPKDTAEIKALLDKLVVLKLNGGLGTTMGCTGPKSVIEVRDGLTFLDLIVMQIEHLNDKFGSSVPLLLMNSFNTHDDTQKIVEKYSKANVQIHTFNQSQYPRLVVDDFTPLPSKGQTGKDGWYPPGHGDVFPSLKNSGKLDLLLSQGREYVFISNSDNLGAIVDLKILHHLIKNKNEYIMEVTPKTLADVKGGTLISYEGKVQLLEIAQVPEEHVDEFKSIEKFKIFNTNNLWVNLNAIKRLVDADALKMEIIPNPKEVNGVKVLQLETAAGAAIKFFDHAIGINVPRARFLPVKATSDLLLVKSDLYNVRDGFVIRNKLRRDPQNPVIQLGPEFKKVDDFLSRFKSIPSLLECDGLRVDGDIWFGSGIKLKGNVHCSVSSEEMLNIPDNITLRE

SEQ ID NO: 13973 - protein, 458 aa, Pyrus pyrifolia
MATGVIDKLKSHVATLSQISENEKNGFINLVARSVSGEAQHVDWSKIETPTDEVVVPHAGLEPAPKDTAEIKALLDKLVVLKLNGGLGTTMGCTGPKSVIEVRDGLTFLDLIVMQIEHLNDKFGSSVPLLLMNSFNTHDDTQKIVEKYSKANVQIHTFNQSQYPRLVVDDFTPLPSKGQTGKDGWYPPGHGDVFPSLKNSGKLDLLLSQGREYVFISNSDNLGAIVDLKILHHLIKNKNEYIMEVTPKTLADVKGGTLISYEGKVQLLEIAQVPEEHVDEFKSIEKFKIFNTNNLWVNLNAIKRLVDADALKMEIIPNPKEVDGVKVLQLETAAGAAIKFFDNAIGINVPRARFLPVKATSDLLLVKSDLYNVRDGFVIRNKLRRDPQNPIIQLGPEFKKVDDFLSRFKSIPSLLECDGLRVDGDIWFGSGIKLKGNVHCSVSSEEMLNIPDNITLRE

SEQ ID NO: 13974 - protein, 533 aa, Rhus vernicifera
VDVHNYTFVLQEKNFTKWCSTKSMLVVNGSFPGPTITARKGDTIFVNVINQGKYGLTIHWHGVKQPRNPWSDGPEYITQCPIKPGTNFIYEVILSTEEGTLWWHAHSDWTRATVHGALVILPANGTTYPFPPPYQEQTIVLASWFKGDVMEVITSSEETGVFPAAADGFTINGELGDLYNCSKETTYRLSVQPNKTYLLRIVNAVLNEEKFFGIAKHTLTVVAQDASYIKPINTSYIMITPGQTMDVLFTTDQTPSHYYMVASPFHDALDTFANFSTNAIIQYNGSYKAPKSPFVKPLPVYNDIKAADKFTGKLRSLANEKFPVNVPKVNVRRIFMAVSLNIVKCANKSCNNNIGHSTSASLNNISFALPQTDVLQAYYRNISGVFGRDFPTVQKKANFSLNTAQGTQVLMIEYGEAVEIVYQGTNLGAATSHPMHLHGFNFYLVGTGAGTFNNVTDPPKYNLVDPPELNTINLPRIGWAAIRFVADNPGVWFLHCHFERHTTEGMATVVIVKDGGTTNTSMLPSPAYMPPCS

SEQ ID NO: 13975 - protein, 520 aa, Homo sapiens
MSQDNDTLMRDILGHELAAMRLQKLEQQRRLFEKKQRQKRQELLMVQANPDASPWLWRSCLREERLLGDRGLGNPFLRKKVSEAHLPSGIHSALGTVSCGGDGRGERGLPTPRTEAVFRNLGLQSPFLSWLPDNSDAELEEVSVENGSVSPPPFKQSPRIRRKGWQAHQRPGTRAEGESDSQDMGDAHKSPNMGPNPGMDGDCVYENLAFQKEEDLEKKREASESTGTNSSAAHNEELSKALKGEGGTDSDHMRHEASLAIRSPCPGLEEDMEAYVLRPALPGTMMQCYLTRDKHGVDKGLFPLYYLYLETSDSLQRFLLAGRKRRRSKTSNYLISLDPTHLSRDGDNFVGKVRSNVFSTKFTIFDNGVNPDREHLTRNTARIRQELGAVCYEPNVLGYLGPRKMTVILPGTNSQNQRINVQPLNEQESLLSRYQRGDKQGLLLLHNKTPSWDKENGVYTLNFHGRVTRASVKNFQIVDPKHQEHLVLQFGRVGPDTFTMDFCFPFSPLQAFSICLSSFN

SEQ ID NO: 13976 - protein, 491 aa, Sphingomonas paucimobilis
MSFPATPDYTGLNKPVGQEVSIKGLKASEGTIPADVRGAFFRAVPDPQFPPFFHPDTALSDDGMISRVLFNADGTVDYDIRYVQTPRWKAERAAGKRLFGRYRNPYTNDPSAFDLEGTVSNTTPVWHAGKLIMTKEDGPGHQVDPHTLETIGAYDFGGVLRSKTMTAHVRVDPETKEMFVYGYEADGLCSKTMAYWWTDRDGKLVKEQWFEAPFCSLVHDFVITENYAIFPLQPTTADLERVKGKGAHWVHQQDLDYHVGIMPRYGDVSQIRWFKGPKGMSSFHMMNAFETDDGKVHMDHHVTDTIAFPHIQADSGINVPPQMLGGGFQRWIMDMKGDGESVAVTPLGPPGDMPRIADADQGRPYRRGWYCSMNPQPMGPPVMGGVVGVMFSALLRKDFETGEIVGYNLPPAHGMSETVHVPASEPGHEGWLIAVVDHQLGPDTFEHALWIWNAGDLPAGPVAKVPVPTRMRPQVHGWWVPMADYEAARAA

SEQ ID NO: 13977 - protein, 529 aa, Arabidopsis thaliana
MSIGLTECVTNKLAAEHPQVIPISVFIAILCLCLVIGHLLEENRWVNESITAILVGAASGTVILLISKGKSSHILVFDEELFFIYLLPPIIFNAGFQVKKKKFFHNFLTIMSFGVIGVFISTVIISFGTWWLFPKLGFKGLSARDYLAIGTIFSSTDTVCTLQILHQDETPLLYSLVFGEGVVNDATSVVLFNAVQKIQFESLTGWTALQVFGNFLYLFSTSTLLGIGVGLITSFVLKTLYFGRHSTTRELAIMVLMAYLSYMLAELFSLSGILTVFFCGVLMSHYASYNVTESSRITSRHVFAMLSFIAETFIFLYVGTDALDFTKWKTSSLSFGGTLGVSGVITALVLLGRAAFVFPLSVLTNFMNRHTERNESITFKHQVIIWWAGLMRGAVSIALAFKQFTYSGVTLDPVNAAMVTNTTIVVLFTTLVFGFLTKPLVNYLLPQDASHNTGNRGKRTEPGSPKEDATLPLLSFDESASTNFNRAKDSISLLMEQPVYTIHRYWRKFDDTYMRPIFGGPRRENQPEC

SEQ ID NO: 13978 - protein, 321 aa, Oryza sativa (japonica cultivar-group)
MDRQWRCLAAAASTSGNSKLPPLPMALGGAVEYGQLVHGAAAPVAPFFVDAEQQSLSPATAMVLGAGWYNYNLVTPSQAAQLHHRLRRAVGAAPCSMKRCGGMAAAAAGRLALVGPAPVQAKLYRGVRQRHWGKWVAEIRLPRNRTRLWLGTYDTAEDAALAYDGAAFRLRGDAARLNFPELRRGGRHHAPALSASVDAKILQATTTTTADTAAAAAPASTNTTPPPSPRVVKTEPGCCSVSEASTTTTADAADVSSTGSSPSPTSSNQAATATPPAPRPPPPLPETIQQLDFTEAPWDEADGFALRRYPSWEIDWDAILS

SEQ ID NO: 13979 - protein, 158 aa, Drosophila melanogaster
MDAPTIKLESSDGMIFSTEVRAAKLSETIKTMLEVSAVENDENAIVPLPKVNAFILSKILTWIYHHKDDDAHGAEGVELSPQSPHDISAWDANFINVDQPTLFEIILAANYLEIKGLVDLCCKTVANMIRGKTPEEIRHTFNIPDEIPSRTAQLGEDL

SEQ ID NO: 13980 - protein, 627 aa, Drosophila melanogaster
MRRPKKYESGEATQYISRRAALRKLQLSLNDFRRLCILKGVYPREPKHRRRAQKGSSEIKVLYHTKDIRFLLHESIVWTLRDYKIFAKKSNRDRAIKDFRNLKRRLALFPEIKLDHIVKERYPTFIDALKDLDDCLTLLFLFSTFPSLHLIPREQSNLCRRLTIEFLHYVIASKSLRKVFISIKGYYFQAEIKGQKVTWIVPHYYPFKPQSRQEVDFKVMSIFVEFYTIMLGFTNFRLFHGLNLAYPPQFPSSVLQDSEESLKDEASFVSDRIAALNFELLRTDKVQEDEEELDIDMELLEQDGDSKRIIKMKQEAQEVSRLRTLFKGLKFFINREVPREPLVILIRSFGGKVSWDSSIFAGSTYDEGDETITHQIVDRPSITTQYISRDYIQPQWVFDCVNQRQLLPTNKYFIGETLPPHLSPFVDSKRDSYIPPEEKALLDPSLIETHAQSDDDSEDEAQEEEETVDQELLDAQLQLAYQQETAEYKKYGGPDGVNEDEEDPDDEDDNEDDDEEEEELDEKTKRLQEEKQKMSVQSGKVHKVNKRQVHKAEVDEHRLQARMVKPRHRNLFRKLIREKQTKEKEEWLLRKKRRTIEANEKEARKTAKREARKEAAAAAAKASKLGK

SEQ ID NO: 13981 - protein, 311 aa, Drosophila melanogaster
MQAPPPEHCPGVESEEAGKGSACSGCPNQGLCSDPNKKLEDPGKALVVESMKDVKHKLLILSGKGGVGKSTVTSLLTRYLARSNPDSNFGVLDIDICGPSQPRLMGALGESVHQSGYGWSPVGIEDNVCLMSIGFLLGSVDDAIIWRGPKKNGMIRQFLSEVDWGNLDLLLLDTPPGTSDEHLSVVSYLKDDANPESLRAVMVTTPQEVSLLDVRKEINFCKKQNIPIVGVIENMSSFRCGHCGNSSEIFPAKTGGAAAMCAEMGIPLLGSLPLDQQISKACDSGEDLTEFKNVTTEALEGICSKIMASFS

SEQ ID NO: 13982 - protein, 357 aa, Drosophila melanogaster
MGRKKKKASKPWCWYCNREFDDEKILVQHQKAKHFKCHICHKKLYTGPGLSIHCMQVHKETVDKVPNSLPNRSNIEVEIFGMDGIPAEDLRDHERQKNGGKSDSDDDEPVAKKKVEYAMSVPPPMMMPPNMMPPHMLGQYGMGMMQHMPPLPPYPVPMMPHMMPPRPLFPAAMATTSAAAAAAAAHHHHAAAMAQQKPTFPAYSNATISAPPTTNHAGGASSAPPSGPPDAQQHQQRPPAPPAASGTSAAAVTTKIMHPQEDLSLEELRARQPKIQARLAAALASLANPQSRKSPSNNGGPSTSIPTTPPPPSLAGISPTGSNSSSGMANSIVVSAAMSKAQEVSSYHSYRNHSQYK

SEQ ID NO: 13983 - protein, 564 aa, Drosophila melanogaster
MESEQPAAVKASAPIEEPQSTETAVELGKHSTLKADLSIDKLETATTEATNAVVEPVEMEQQVENELVNESTQAMTSTTTQEKVVGSVNNLVEEQQCVEMEFETSSDLVVQGSPSEESKKVASDASATVTAPQVQPAPHVDSSPQASGLSLLAAYSSDDSDDEKVTPVQNGDNDVIEVPVTDPASSTTAYRPVVAVSSDDESSKSSSSSSDSDSDSEGEYLTVLRKKIDKRINTVDCDEDDEDFDEDGATGDRSRRRQPPKVRGEMLLDDLPPIHQLEITVPEDECVELGKVQSIVDQLVLVSVLPNSMLFDLDTVLFLEKGRKVLGEVFDVLGQVSDPLYCVRFNSNKQILDRGIKIGDVVYCAPKTEHTQFVILSKLMQVRGSDASWEHDVEPPARYVDHSDDEEEREARAEQRKRRQRDRTNSTDSVDTVTSVATTATKASSVAPPPRQRGRRGQRESFRQSQRPSINQHNQNQPQDEQYNFHPSYNPGSWHSNYYQNYHQAAANFNMAQQHPGMPFPVPNYGYGMPYAMPPMYPHMYPPPPPFAPPPPNNQSHQGQPPPS

SEQ ID NO: 13984 - protein, 156 aa, Drosophila melanogaster
MSNSEDSQQYLNDMLVKEEDEASGDDSDKQDGGIMLREQDRFLPICNIIKIMKVPVPQNGKIAKDARECIQECVSEFISFISSEAIERSVAENRKTVNGDDLLVAFSNLGFDNYVEPLSIYLQKYRESNKSDRNLFLDASYPHNEDGSSANDAGKQ

SEQ ID NO: 13985 - protein, 334 aa, Drosophila melanogaster
MTQQRPAFDSNAMTLTRFVLQEQRKFKSATGDLSQLLNSIQTAIKATSSAVRKAGIAKLHGFAGDVNVQGEEVKKLDVLSNELFINMLKSSYTTCLMVSEENENVIEVEVEKQGKYIVCFDPLDGSSNIDCLVSIGSIFAIYRKKSDGPPTVEDALQPGNQLVAAGYALYGSATAIVLGLGSGVNGFTYDPAIGEFVLTDPNMRVPEKGKIYSINEGYAADWEDGVFNYIAAKKDPAKGKPYGARYVGSMVADVHRTIKYGGIFIYPATKSAPSGKLRLLYECVPMAYLMIQAGGLASDGKISILDIVPKKIHERSPIFLGSKSDVEEALSYLK

SEQ ID NO: 13986 - protein, 446 aa, Drosophila melanogaster
MIYIDDSEPEGVLEPAFPMRDVTINRNVDAHKHYDVLGEVGRGKFGTVYKCRDKANGLQLAAKFVPIPKREDKRNVEREVEIMNSLQHHLIIQLYAAYEYQKMMCVVLELIEGGELFDRVVDDEFVLTERVCRVFIRQVCEAMAFIHGNGIVHLDLKPENILVLTQKGNRIKIIDFGLARKFDPDKRLRVLFGTPEFVAPEVVNFDCISYGTDMWSVGVICYVLISGLSPFMGENDIETMSNVTIAKYDFEDECFNGISPECLDFIAKLLAKDLSTRMTAAECMKHKWLQQRPATAATATPITKAASAASKSRLKSVSPVTAPSESSEDSTETIEDEDDEEEVAVQQAKQKDQQQDEELANLCGDAELENKELDATKDNLKNFIVRWETHPNSPYVFDVEGNVIAPLSETSYPHPRRTHGADSLSSSRGEYGSQRQRDRHALIHGK

SEQ ID NO: 13987 - protein, 161 aa, Drosophila melanogaster
MPIIRLESADKEIFDTDQEIAKCSETIRIAIEDLGDESDNSVLPLPNVNSLILKKVLHWATYHKDDPVVTEEVENKEKRTDDISSWDADFLKVDQGTLFELILAANYLNIQGLLDVTCKTVANMIKGKSPQAIRDTFAIQNDFLPQEEEQVRKENEWCEDK

SEQ ID NO: 13988 - protein, 417 aa, Drosophila melanogaster
MYGTWGVFLGGILLLQVLQLSMGLDNGLALKPPMGWMSWERFRCITDCKLYPDECISEKLFQRHADLLVSEGYADAGYEYVIIDDCWLEKNRDNDTQKLVPDRKRFPNGLNALSDHIHNQGLKFGLYQDYGTNTCAGYPGVIKHMKLDAQTFADWDVDYVKLDGCYANISDMASGYPEFGRLLNETGRPMVYSCSWPAYQEDAGEMPDYESLKQHCNLWRNWDDIEDSLESLMQIIDYFAKNQDRIQPHGGPGHWNDPDMLLLGNYGLSYDQSKLQMAIWAIMAAPLIMSNDLAAVRPEIKAILQNRAVIAVDQDELGIQGRRVLSRNQIEVWKRPITPVTKSGHHSYAVAFVSRRDDGAPYRIPFTVKELGLTNPKGYNVQDLYDASSKLGVFQSESQFITRVNPNGVTFYKFTAL

SEQ ID NO: 13989 - protein, 443 aa, Drosophila melanogaster
MEAYIRQKRASPGMVQASDLQINRPMSGMRSNSRELHAYDGPMQFISSPQNPDQILTNGSPGGINPVAMNTSRNHSNNMRSLSTINQEADLIEEISSHELEDEESSPVTVIEQHQQSASHSANSTQSQKPRARQHSFSDNLDEDDYTNRNVAGAAPVRPAGMASSPYKDATLDGSSNGTGNGTGGESEGDVIGNIDQFVMQPAPQGVLYKCRITRDRKGMDRGLFPIYYLHLERDYGKKIFLLGGRKRKKSKTSNYIVSCDPTDLSRNADGFCGKLRSNVFGTSFTVFDNGNKESTESPRLDLAVIIYDTNILGFKGPRNMTVILPGMTEDDQRVKISSADPKQQGILDLWKMKNMDNIVELHNKTPVWNDETQSYVLNFHGRVTQASVKNFQLVHDSDPEYIVMQFGRTSEDVFTMDYRYPLCAMQAFAIALSSFDGKIACE

SEQ ID NO: 13990 - protein, 116 aa, Drosophila melanogaster
MGTVVSTLQRPTLYVSMDSSHAQFVRDTISGNKVVIFSKSYCPYCSMAKEQFRKINVKATVIELDQRDDGNEIQAVLGEMTGSRTVPRCFIDGKFVGGGTDVKRLYEQGILQKYFQ

SEQ ID NO: 13991 - protein, 561 aa, Homo sapiens
MGARTPLPSFWVSFFAETGILFPGGTPWPMGSQHSKQHRKPGPLKRGHRRDRRTTRRKYWKEGREIARVLDDEGRNLRQQKLDRQRALLEQKQKKKRQEPLMVQANADGRPRSRRARQSEEQAPLVESYLSSSGSTSYQVQEADSLASVQLGATRPTAPASAKRTKAAATAGGQGGAARKEKKGKHKGTSGPAALAEDKSEAQGPVQILTVGQSDHAQDAGETAAGGGERPSGQDLRATMQRKGISSSMSFDEDEEDEEENSSSSSQLNSNTRPSSATSRKSVREAASAPSPTAPEQPVDVEVQDLEEFALRPAPQGITIKCRITRDKKGMDRGMYPTYFLHLDREDGKKVFLLAGRKRKKSKTSNYLISVDPTDLSRGGDSYIGKLRSNLMGTKFTVYDNGVNPQKASSSTLESGTLRQELAAVCYETNVLGFKGPRKMSVIVPGMNMVHERVSIRPRNEHETLLARWQNKNTESIIELQNKTPVWNDDTQSYVLNFHGRVTQASVKNFQIIHGNDPDYIVMQFGRVAEDVFTMDYNYPLCALQAFAIALSSFDSKLACE

SEQ ID NO: 13992 - protein, 747 aa, Homo sapiens
MEIPNPPTSKCITYWKRKVKSEYMRLRQLKRLQANMGAKALYVANFAKVQEKTQILNEEWKKLRVQPVQSMKPVSGHPFLKKCTIESIFPGFASQHMLMRSLNTVALVPIMYSWSPLQQNFMVEDETVLCNIPYMGDEVKEEDETFIEELINNYDGKVHGEEEMIPGSVLISDAVFLELVDALNQYSDEEEEGHNDTSDGKQDDSKEDLPVTRKRKRHAIEGNKKSSKKQFPNDMIFSAIASMFPENGVPDDMKERYRELTEMSDPNALPPQCTPNIDGPNAKSVQREQSLHSFHTLFCRRCFKYDCFLHPFHATPNVYKRKNKEIKIEPEPCGTDCFLLLEGAKEYAMLHNPRSKCSGRRRRRHHIVSASCSNASASAVAETKEGDSDRDTGNDWASSSSEANSRCQTPTKQKASPAPPQLCVVEAPSEPVEWTGAEESLFRVFHGTYFNNFCSIARLLGTKTCKQVFQFAVKESLILKLPTDELMNPSQKKKRKHRLWAAHCRKIQLKKDNSSTQVYNYQPCDHPDRPCDSTCPCIMTQNFCEKFCQCNPDCQNRFPGCRCKTQCNTKQCPCYLAVRECDPDLCLTCGASEHWDCKVVSCKNCSIQRGLKKHLLLAPSDVAGWGTFIKESVQKNEFISEYCGELISQDEADRRGKVYDKYMSSFLFNLNNDFVVDATRKGNKIRFANHSVNPNCYAKVVMVNGDHRIGIFAKRAIQAGEELFFDYRYSQADALKYVGIERETDVL

SEQ ID NO: 13993 - protein, 156 aa, Homo sapiens
MSGGLLKALRSDSYVELSQYRDQHFRGDNEEQEKLLKKSCTLYVGNLSFYTTEEQIYELFSKSGDIKKIIMGLDKMKKTACGFCFVEYYSRADAENAMRYINGTRLDDRIIRTDWDAGFKEGRQYGRGRSGGQVRDEYRQDYDAGRGGYGKLAQNQ

SEQ ID NO: 13994 - protein, 303 aa, Homo sapiens
MASWAKGRSYLAPGLLQGQVAIVTGGATGIGKAIVKELLELGSNVVIASRKLERLKSAADELQANLPPTKQARVIPIQCNIRNEEEVNNLVKSTLDTFGKINFLVNNGGGQFLSPAEHISSKGWHAVLETNLTGTFYMCKAVYSSWMKEHGGSIVNIIVPTKAGFPLAVHSGAARAGVYNLTKSLALEWACSGIRINCVAPGVIYSQTAVENYGSWGQSFFEGSFQKIPAKRIGVPEEVSSVVCFLLSPAASFITGQSVDVDGGRSLYTHSYEVPDHDNWPKGAGDLSVVKKMKETFKEKAKL

SEQ ID NO: 13995 - protein, 494 aa, Homo sapiens
MEVVEAAAAQLETLKFNGTDFGVGEGPAAPSPGSAPVPGTQPPLQSFEGSPDAGQTVEVKPAGEQPLQPVLNAVAAGTPAPQPQPPAESPACGDCVTSPGAAEPARAPDSLETSDSDSDSDSETDSDSSSSSSSSSSSSSSSSSSCISLPPVLSDGDDDLQVEKENKNFPLKTKDELLLNELPSVEELTIILPEDIELKPLGMVSSIIEQLVIIESMTNLPPVNEETVIFKSDRQAAGKIFEIFGPVAHPFYVLRFNSSDHIESKGIKIKETMYFAPSMKDFTQYIFTEKLKQDKGSDASWKNDQEPPPEALDFSDDEKEKEAKQRKKSQIQGRKKLKSEFNEPGEDFTEVHQNWNAHSSASEHAKGYRNREFTRGFSRARYPRSCHGRPPPQHFYNSEHMVSQETSGFPSQRQNNPIMPQYPFPLPVFDMHNFPLRPPPPPPPPPVNMGWATPNMAAHPLLNLPYSLPPPPPPPPLPPPPSSGDSNSHFGPYY

SEQ ID NO: 13996 - protein, 155 aa, Nicotiana tabacum
AFTSVKILVLIQVSVLALSSFSELSFGKGIESSSLDKGQHHPIFSTVHLFFGKSPKKSPSSPTPVNKPSPSPPPQVKSSLPPPAKSPPPPPAKSPPPLLPPPPSQPPKQPPPPPPPPAKQPPSAKPPIKPPSPSPAAQPPATQRATPPPAMQRAP

SEQ ID NO: 13997 - protein, 228 aa, Chimpanzee cytomegalovirus
MSLRGQVQVARSVFLLRIYILMWVQSLILMSVCGFCWLVFPHKLEHLFPSVRLTLSCLMISIVCLGLLRWAEPNFPKNVWLLLTYTLLTSVAVTASGFHFSHRSVIYAMIATVVLFCFLTLATYTFARDVELQRSLLTAASALILLLFLVFSLFPEEVGEIVVMVAGLAVIVTSVVCDTQDILHDIEYESYIQGALYLYMDLMYLFVSVLYFMPVNRPTTGATQNFVS

SEQ ID NO: 13998 - protein, 267 aa, Nicotiana tabacum
NSAHGGVYAHPGVPIGSHPPGHGMATSPAVSQAMDGASLSLDASAKSSENSDRGLLAMSLGNGSADNIEGGADHGNSQSGDTEDSTDGSDTNGAGVSERSKKRSRETTPDNSGDSKSHLRRCQPTGEINDDSEKAIVAVRPGKVGEKVMGTVLSPSMTTTLEMRNPASTHLKASPTNVSQLSPALPNEAWLQNERELKREKRKQSNRESARRSRLRKQAEAEELAIRVQSLTAENMTLKSEINKLMENSEKLKLENAALMERLKMNS

SEQ ID NO: 13999 - protein, 535 aa, Daucus carota
MGDMEGSPGSSMHGVTGREPSLAFSVASRIDTSAEFHVPVDSEHKAKVFKFKSFSPPHGLQFQLTWISFPTCFVSTFAARPLVVIIRDNLNPTKMDVGNAGVASVTGSILSRGAMGAICDMLGPRYGCAFLIMLSAPKVLCMSFVSSAGGYVAVRFMIGFSLATFVSCRYWMSTSMHSDIIGLVNGTAAGWGNMTGGATQLIMPLLYDIIREAGATPFTAWRIALFIPGWLHVISGILVLTLGQDLPDGNAQNEASLRKKGRVHKDKFSKILRYAATNYRTWILVLLYGYSMGVELTTDNVIAEYFFDRFDLKLHTPGIIAATFGMANLLARPFGGWSSDVAAKHFGMRGRHWNSWDLQTLGGVFCLLLVRATTSPIDALAITWMIIFSIGAQAATGVTFGIIPFISRRYLGIISQMTGANGNFGSGQTQPLEFDSTKYNTGLGLTYMGMMIIACTLPPMLVWFWQDGSMFLPPSKDPIKGTEPEHYFGSEYTEDEKVKGMHQNSIKFAENSRTEFGKKRVGSAPTPPNVYPNRV

SEQ ID NO: 14000 - protein, 108 aa, Oryza sativa (indica cultivar-group)
DDDVVVACVVKAADAAAEGTFVKFLCSYGGRILPRHADGALRYVGGDNRVVSVDRSLPFHELQRKLREMCGWEAVCLRCQLPTEDLDALVSVTGDDDLANLLEEYDAA

SEQ ID NO: 14001 - protein, 138 aa, Secale cereale
MASSSVLLGAGAAAFTGAAAGKALPRPCFLAARPHTVSGARLCLQTPPRATPANDAVENVKGAAGEAGDKVSEGADSVSKAAGDAGANVQEAAEGGLEGAKDLGRKAKQATEEAWDATKEAAQGVADNVAAAVDDVSK

SEQ ID NO: 14002 - protein, 146 aa, Secale cereale
MASSSVLLGASATAAHRYPGSKALPRPSFLAARPRTVSGGRLCLQNAPRATPAYNDAADATDKAIDGVKGVADGLKKGVAEAAEAVSGNTEKAAEEAGKGASEVDDKAKDFGEQAKKATEEAWDGAKDAAQGITDKVADAAKKEAN

SEQ ID NO: 14003 - protein, 348 aa, Sus scrofa
MQSRTGTCKWRASLKRSKILHMALMGTSDPSGEDEASQEKPFVLRALQIALVVSLDWVTSISMVFLNKYLLDSPSLQLDTPIFVTFYQCLVTALLCKGLSTLATCWPGAVDFPTLHLDLRVARSILPLSVVFIGMITFNNLCLKYVGVAFYNVGRSLTTVFNVLLSYLLLKQTTSFYALLTCGTIIGGFWLGVDQEGAEGTLSWTGTVFGVLASLCVSLNAIYTKKVLPAVDGSIWRLTFYNNVNACILFLPLLLLLGELRALHHFPLLTSAHFWGMMTLGGLFGFAIGYVTGLQIKFTSPLTHNVSGTAKACAQTVLAVLYYEDTKSFLWWASNMMVLGGSFAYTWV

SEQ ID NO: 14004 - protein, 483 aa, Eudianthe coeli-rosa
MDQDPFTASLFKWDYPRGGTTTGINQASVPVPPPQSIPAYLARGLLASGYPGVGMGMGMGMSMQGISMANSQLCGGSSNNNVGNNSNNNNGGLEELFQAYGIRYFTAAKIAEMGFTVNTLVDMKEEELEDMMNSLSHLFRWDLLVGERYGIKAAIRAERRRLDDLEDSRRHRHHNHHNNNLISYSNTPPHESGHHPLDALSQEGLSEEAGVHEKEVVVSGGGGGGGGSWEMVTGNGAVQYQQRKKRRHPPQQQQLARKTTMMGGSRKGLEGRLIINNNNNNNLDDEMDDEDEVEDDDLDHGGGGGGGGGVCVERQREHPFIVTEPGEVARGKKNGLDYLFHLYEQCREFLLQVQNISKDRGEKCPTKVTNQVFRFAKKAGATYINKPKMRHYVHCYALHCLEEDTSNALRRAFKERGENVGAWRQACYKPLVAIAGRQGWDIDSIFNSHPRLSIWYVPTKLRQLCHAERSSSSATSIVAPLPF

SEQ ID NO: 14005 - protein, 290 aa, Juglans nigra x Juglans regia
MDQYEKVEKIGEGTYGVVYKARNRKTNQTLALKKIRLEQEDEGVPSTAIREISLLKEMQHGNIVKLQDVVHGEKRLYLVFEYLDLDLKKHMDSSPEFANDLRQIKMFLHQILRGIAYCHSHRVLHRDLKPQNLLIDRRSNSLKLADFGLARAFGIPVRTFTHEVVTLWYRAPEILLGSRHYSTPVDVWSVGCIFAEMVNQRPLFPGDSEIDELFKIFRVLGTPNEDTWPGVTSLPDYKGAFPKWPPKDLAAVVSSLDSTGVDLLSKMLSLDPSRRITARTALEHEYFKDI

SEQ ID NO: 14006 - protein, 199 aa, Mus musculus
MSWLLGYMDPTEPSFVAAVITIVFNPLFWNVVARWEQRTRKLSRAFGSPHLACYSLGICILLLNILRSHCFTQAMMSQPKMEGLDNHTTYFLGLAFLGWGFVFVLSSFYALGFTGTFLGDYFGILKESRVTTFPFSVLDNPMYWGSTANYLGWALMHASPTGLLLTVLVAIVYVVALLYEEPFTAEIYRQKATRLHKRS

SEQ ID NO: 14007 - protein, 495 aa, Mus musculus
QDGASQFQEVILQELELSVKKELEKILTTAASHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPIAKDVSYSGENTEAWYPPGHGDIYASFYNSGLLDTFIEEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLGAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 14008 - protein, 241 aa, Mus musculus
FNSSDHIESKGIKINDTMYFAPSMKDFTQYIFTEKLKQDRGSDASWKNDQEPPPEVLDFSDDEKEKEAKQRKKSQIQGRKKLKSELNESGEDFGEVHENWNAYSSSEHSKGYHHREFSRGFARGRYSRRSHGRPPPQQYYNSDHMASQESLGFTPQRQDNPVMPHYPFPPPMFDMHNFPLPPPPPPPPPPPPSMGWAAPSMASHPVLNLPYSMPPPPLPPPPPPPPPSPGENNSSHFGPYF

SEQ ID NO: 14009 - protein, 355 aa, Mus musculus
MAGCCCLSAEEKESQRISAEIERQLRRDKKDARRELKLLLLGTGESGKSTFIKQMRIIHGSGYSDEDRKGFTKLVYQNIFTAMQAMIRAMDTLRIQYMCEQNKENAQIIREVEVDKVTALSRDQVAAIKQLWLDPGIQECYDRRREYQLSDSAKYYLTDIERIAMPSFVPTQQDVLRVRVPTTGIIEYPFDLENIIFRMVDVGGQRSERRKWIHCFESVTSIIFLVALSEYDQVLAECDNENRMEESKALFRTIITYPWFLNSSVILFLNKKDLLEEKIMYSHLISYFPEYTGPKQDVKAARDFILKLYQDQNPDKEKVIYSHFTCATDTENIRFVFAAVKDTILQLNLREFNLV

SEQ ID NO: 14010 - protein, 372 aa, Psilotum nudum
MMSHKNVPPLDVSFVATDRRDINPLRDLFKDYGVRMTTTAKVVEMGFTVNTLVNMTEQEIDDVIKTMLECYRIELLVGERYGFKSAIRAEKKRQEEEMGRQYLQLLSKSGKRRKGEDTLLVATSLEGISREQRADNDLMFPEVAGAVGPFNLNSKEAALFEQSHTQLGTPRLLAIPEPSSDNEKKKVGRKKQKHKMSQEPGDDGDDRTREHPFIVTEPGELARGKKNGLDYLFDLYEQCARFLDEVQQMSKERGEKCPVKVTNQVFRHAKLKGASYINKPKMRHYVHCYALHCLDLQQSNHLRKLYKDRRENVGAWRQACYLPLVEMARQNGWDIEGVFNRNEKLRIWYVPTKLRQLCHTEKSKDSDSCSYE

SEQ ID NO: 14011 - protein, 350 aa, Botrychium multifidum var. robustum
MKSLEELFKDYGVRITTIAKVVEMGSTVSTLVNMTEQEIDDVIKTILDGYHIELLVGERYGFKSAIRAEKRRHEEEVERQRLQLLSRSGRKRKDDTAVVATSLEGIPREQGADNGLMFPDAIATIGPLNLNSKEPVLLEQSHTHFGAPALLAIPEPSSDNEKRKLGRKKQKRRHSREPGEDGDDRPREHPFIVTEPGELARGKKNGLDYLFDLYEQCARFLGEVQQISKERGEKCPTKVTNQVFRHAKLKGASYINKPKMRHYVHCYALHCLDLEQSNHLRKLYKERGENVGAWRQACYYPLVEMARQNGWDIEGVFNRNEKLRIWYVPTKLRQLCHMEKSKDSDSCSYE

SEQ ID NO: 14012 - protein, 367 aa, Isoetes asiatica
FKWEPRIPLQQRDPLRDPRAFELSFPQPDRQNLQSLEDLFKDYGVRLCTIAKIAELGFTISTLINMTDSEIEELMKVMRDSCHIELLVGEKYGIKTAIRTQKKHLEDEAERQRSRITKRGKGPESSTETSKEGALETGDHQIMPPENIVPGDMNGRDPLLVIQGANTGTSAVISVPETSSDDDGKRHGKKKQRRKRNRELGDDGEDRQREHPFIVTEPGELARGKKNGLDYLFHLYEQCGRFLEEVQQICKERGEKYPTKVTNQVFRHAKHVGASYINKPKMRHYVHCYALHCLSVEHSNHLRKLFKNRGESVGAWRQACYYPLVEMARENHWDIEGVFNRNDRLRIWYVPTRLRQLCHIEKGKECI

SEQ ID NO: 14013 - protein, 312 aa, Equisetum arvense
LKSAIRAERRTRDEDAARQHLHILAKSVKKRKGELENDSNNNNNNNNNNNNNNEQQALGWVEGSAREQGGDNALMFPDAVTAVVGGPLSLSTKDTAVALEQQSHLHFSAPGPLSIPEPSSDTGIRKHEKKKQKRLLSREHGEDADDRTREHPFIVTEPGELARGKKNGLDYLFDLYEQCGRFLEEVQQMCKERGEKCPTKVTNQVFRHAKLKGASYINKPKMRHYVHCYALHCLDVEQSNRLRKLFKERGENVGAWRQACYHPLVELARQSGWDIEGLFNRNEKLRIWYVPTKLRQLCHMEKNKDSDSCSYD

SEQ ID NO: 14014 - protein, 351 aa, Angiopteris lygodiifolia
MRPLEELFKDYGVRLTTIAKVMELGFTVSTLVNMTEQEIDDVIKTMLEGYPVELLMGEKYGFKSAIRAEKKRQEDEMEAQRLQLLSKSGKRRKVDESAAAATSMDGTPREQRGDNGMMFPDPIVAAGPRSLNTKEPFLLEQSHAHFGTPGLLAIPEPSSDNEGRKLAKKKQKRRLSREHREDGDDRPREHPFIVTEPGELARGKKNGLDYLFDLYEQCAKFLDVVQQISKERGEKCPTKVTNQVFRHAKLKGASYINKPKMRHYVHCFALHCLDQEKSNSLRKAFKERGENVGAWRQACYYPLVEMARANGWDIEGVFNRNEKLRIWYVPTKLRQLCHSEKSKDSDSCSYE

SEQ ID NO: 14015 - protein, 344 aa, Angiopteris lygodiifolia
MKSLEELFKDYGVRYSTLAKMSEMGFTVDTLVNMTEQELEDLVMVILESCQVQLLVGEKYGIKSAARAEKKRVDEECERLRLDMFSKAARKRKIDEPAALLAPKEGVAKESHRDDSIILTDTVNSILPLNFKEPLLIGQDSVHLGACGLESQSDPGSDSEGRKFSKKQQKRRPSMETGEDGEDRPREHPFIVTEPGELAGGKKNGLDYLFDLYEQCGRLLQEVQRISKERGEKCPTKVTNQVFRHAKHNGCGYINKPKMRHYVHCYALHCLDTEQSNNLRRLYKERGENVGAWRQACYHPLVAMARENDWDIEGLFTRNEKLRIWYVPTKLRQLCHSEKSRDSE

SEQ ID NO: 14016 - protein, 344 aa, Angiopteris lygodiifolia
MKSLEDLFEDYGVRYSTLAKMSEMGFTVNTLVNMTEQELEDLVMVILESCQVQLLVGEKYGIKSAIRAEKKRVEEEFERQRLDLVAKVDRKRMIDDTAAVFSSKEGVAKESQRDDSIILTGTVNSILPLNVKEPLLIGQNSVHPAECGLVSLPEPGSESEGRKLSKKKQKRRRTKEAGEDGEDRPREHPFIVTEPGELARGKKNGLDYLFDLYEQCGKLLLEVQRISKERGEKCPIKVTNQVFRHAKYTGSGYINKPKMRHYVHCYALHCLDIEQSNNLRRSFKERGENVGAWRQACYYPLVVMARENGWDIEGLLNRNEKLRIWYVPTKLRQLCHLERSKDSD

SEQ ID NO: 14017 - protein, 395 aa, Methanosarcina acetivorans C2A
MNEQGLSEKEIFSYLENAKSEDTDYYRVLSSMCTHPHKIAVEANRLFIEANLGDLGLFAGASRLEQEVVGMLGELLHAPSIDVPFGGSCESSACGYLTTGGTESNIQAVRGMKNLVTTGKKELKGAPNIVIPESAHFSFDKVADMMGIEVRRASLDSEFRVDMASIESLIDANTIGLIGIAGNTEFGQIDPIDKLSEIALENELFLHIDAAFGGFVIPFLEKPQPFDFKLPGVTSIAVDPHKMGLSTIPSGALLFRSASFLDSLKVNTPYLTTKAQFTLTGTRSGASAAATCAVMKYLGNEGYRKNVQYCMQLTEKLVIEARKIGFEPLLEPVMNVVALKVPNPDFVREQMLERFGWNVSITRTPRALRLVLMPHNTLEDIEIFVQDLKEVTVEI

SEQ ID NO: 14018 - protein, 255 aa, Methanosarcina acetivorans C2A
MKNLFDLTGKVAIVTGASSGLGVEFARALANQGANIAIIARREEKLKEVQKEIEKLGVTCRYYLCDVMKTEQIKNAVEQVVKDFGRIDILVNNAGLGLVDAADKTTDEMWHNMIDTNLNGVYFFAREVGKIMLRQKHGRIINIGSIHSTVSMKGLPVTAYCSTKGGVLMLTKSLATEWAKEGITVNAIGPGYFALGMAEGVVADPEFAKIIEFMCPMGRAGQSGDLDTTVVYLASDESKYITGQIITVDGGWTAL

SEQ ID NO: 14019 - protein, 213 aa, Methanosarcina acetivorans C2A
MKVLYIYAHQEPKSFNAALKDTALAALKEKGHEVELSDLYAMNFNPVLTEKDFTDRKKPDVFKPFLEAIQASKTGAFAPDILAEMEKVKWADFLIFQFPIYFTSMPAILKGWIDRVLAPGFGFNPLTNSAYETGLLKGKTTMITTTTGASEEWYSEGGEHGDLNRHLESVTHCVFEYMGMKVLPSHIIYEVSSLTKERGAEELEKYRKRISEL

SEQ ID NO: 14020 - protein, 256 aa, Methanosarcina acetivorans C2A
MAINETKQFLGKVAFVTGGATGIGQATAVAFAREGANVALTYHNQGAEQTVRRIEELGGQALAIKCDVIREEDVKNAIEKIIQTFGQLDYAFNNAGIEGKTVITAEYPVEEWNRVIATNLTGVFLCMKYEIPQMLKQGAGAIVNCSSGAGLTGFPDISPYVASKHGVVGLTKTAALDYAKSNIRINAVCPGMTDTPMMERYSGGTPEGYEKIIEQEPIGRMGRPEEIAIAVLWLCSDAASFVTGDVMRVDGGQLAH

SEQ ID NO: 14021 - protein, 258 aa, Methanosarcina acetivorans C2A
MSQAFKIIENEFEGKVAIVTGAGTGNGESIAERLYAGGASVALVSRHIAPLDDICNRIDSSGKRTFPIEVDVRDPHSVQIAVSSIIERFGKIDIAVNNAGITGPANTPLQDLDIEIWRDVIETDLTGVFYCMKYEIPAMLKNGSGAIVNMSSANGLVGLAGMAAYTTAKHGVIGLTRSAALELAESNIRVCAVAPGYVATPRIIDSGKEAMDYMAAAHPMKRLATREEVADLVAYLLSERAAFITGSVHCIDGGYTAE

SEQ ID NO: 14022 - protein, 883 aa, Methanosarcina acetivorans C2A
MSKFVYFFGKDVTDGKSSMKDLLGGKGANLAEMANLGVPVPPGFTITTEVCVLYLNEKKYPEEVLSQVEEAIDKLEALNGKKLGDPEDPLLVSVRSGARVSMPGMMDTVLNLGLTDKSVIGLANKVNDERFAYDCYRRFIAMFGDVVLGVEFRKFDSLIGDKKKELGAKSDTELDSKALKELAERFKEVIKLEKGFEFPQDPKVQLQMAVDAVFDSWNNQRAITYRKLNNIGDGWGTAVNVQTMVYGNRGNTSGTGVAFTRNPSTGEKKFFGEYLINAQGEDVVAGIRTPDYIDTLGNKIPEAYAQLVDICQKLESHFKDMQDIEFTIQEGKLYMLQTRTGKRTAAAAVKIATDMVEEGLIDKETAVNRVNAEHIDLLLHPRIDPEAKLEIIATGLPASPGAAVGKVVFTAEAAEEMAEIGEKTILVRTETSPEDIGGMAAAQGVLTVRGGMTSHAAVVGRGMGKPCVVGCGEISIDIKSSLFMVNGFTIKEHDYITIDGSIGSVILGKTDLIDAEINEDLKKLLIWADEIRTLGVRTNADNPADAALARELGAEGIGLCRTEHMFFGEDRIPAVREMIMSEDEKARKKALKKLLPMQKEDFLGIFRSMEGLPVTIRLLDPPLHEFLPDKEELDEKLRELETSGDCGKIEDVKKVIQRVVSLKELNPMLGHRGCRLGITYPEIYNMQVRAIMEAACELTAEGLKVIPEIMIPLVGLVKELSLTKEEVCKTAETVMTEKGMKIDYKVGTMIELPRATIVADQIAREADFFSFGTNDLTQTTFGFSRDDVSKFVPIYQKAGILEHDPFAVLDQEGVGELMKIGIQKGRSVKPKLKMGICGEHGGEPRSITFAHGIGIDYVSCSPYRVPIARLVAAQSTMQMRNAK

SEQ ID NO: 14023 - protein, 468 aa, Methanosarcina acetivorans C2A
MNSILISDSFWGKSMKIKSINPYTEEINRTYGSFPIEECRNRIEKSRAAFSGWSSLPAEERAKFFLNVAELLRRNTEIYAGIITEEMGKPIRQSRSEVQKCVRLCDYYAENAAGLLKAEIVELGAEKSYVTFEPLGVVFGIMPWNFPFWQVFRFAVPAICAGNVCVLKHASNVPGSALEIEKIFLEAGFREYVFKTLLIDSKTAMEIIKEELVDGVSLTGSTGAGSKIGKLAGEAIKPQVLELGGSDPFIVLEDADIERAAQAGVRSRFLNAGQSYTAAKRFIVVEEVVGDFIEAFELHMQELKIGDPIDEETDIGPLAKKEFVEILEKILEDARKKGAEPQTYGEKHKKGFFFNPTIIPAASTYMEVCNIEVFGPVAPVITAKDEDEAVEVANSIEFGLGAKIWSGDLERAEKLAKRIRAGSVAVNGMIRSDPRLPFGGTGKSGVGRELSHYGLKEFVNIKTVVVNK

SEQ ID NO: 14024 - protein, 420 aa, Methanosarcina acetivorans C2A
MVSKDLPFTKEEILKITEKYPTPFHIYDEKAIRENARRMKSAFKDVPGFKEFFAVKALPNPFILKILKEEGFGADCSSLPELILAEKAGMTGDDIMFSSNDTPAEEFAKAKELGGFINLDDISHIHYLEKAAGLPEIVCFRYNPGPLKEGNAIIGKPEEAKYGFTREQMFEGYRVLRDKGVKRFGMHTMVASNELNSDYFVETARILFELIVEISKELGIQFEFVNLGGGIGIPYRPEQEPVSLEAVAKGVKEAYNATITANGLAPLKVYLECGRIITGPYGYLVSQVRHLKSTYKDYVGMDSCMSNLMRPGMYGAYHHITVLGKENKPPVHKYDVTGSLCENNDKFAIDRMLPEVEVGDILVIHDTGAHGHAMGFNYNGKLRSAELLLREDGSVVQIRRAETIEDYFATLDFEQLKSFR

SEQ ID NO: 14025 - protein, 174 aa, Methanosarcina acetivorans C2A
MATGPRYKVPFRRRREGRTNYHLRLKLLLSRQDRVVVRKSSRNVQIQLIAPTPDGDITYSSAVSNELAKYGYTGATGNTTAAYLTGLLFGLKSLQKGYEGGILDIGLQASSAGSRVYAALKGVVDSGFEIPCSPEVFPPDERIRGEHIAGYREESSDLPEQFEATKEKIFAEFS

SEQ ID NO: 14026 - protein, 849 aa, Methanosarcina acetivorans C2A
MLGILKKKVKSEFCFCSTIPANGLTAIYKETEERTDLIAAYIKAGLQQNEHCIWIVPDPESAELAKELLSNSELDIENYIEKSRLKIIPLQGTEAISAEQTEGSGSYFDWNAGVFQKEILKFIHTGNWQYLRINLEVKPLGKSIPGSLKELKRILDENRPEKKIWPLFTIKEEDLSPGEVFDIIEAGGKLLIYRDGRWKHFKIKRESKDKKFKTLIESSNDSILIHDMKGRVMEANHVACEIFGYTRSKILGKHIKDLQTGIHLIEFGQQIEKLKQTGYFIFETDSLRKDGTVTPQEINNRLIEYEGEAAVLSIGRDISEQKKNEEALRASERKYRTLFEEFPGGIAQFDTGGVITLCNESFVNLTGNREKEKISFSLLSLLDGGNPDEKSGTYLPEVSVHNDLKYISRNGKEAIPVAITYKPLMSENSELAGGIVLVEDLTGIKRLEAVRLQQTECLRKLVDSVPVPAFCKDRNGIYIACNTAFETFMSMQKEEILGKSMHNFAPSEIAEKCHTMDIELLKHKKTRVYETSIKFADGSIHQIMFNKLVFSGVTEEDSMLLGIMIDITEHKQAEEKMLQAKMAAEAANRAKINFIVNMSHELRTPLNAVIGFSDLLLSETAGPLNEKQKRYTENISKSGSHLLDVINDVLDISRLELGNIELYYETVDIPGVIEEVRRVLSSLSAEKNIRIEYKVEQGLKTIDVDRVKFKQILYNLLNNAIKFSSEDGKVNIKARSEGDMVEISVKDEGIGINEADYARVFLPFVQIDESISRKHGGVGLGLALVKRFVELHGGQVWVEASPGKGSTFTFRIPKRPEKEIKEKEVTNPLQTLYSLEIEKEEEKFGEKGT

SEQ ID NO: 14027 - protein, 362 aa, Methanosarcina acetivorans C2A
MPHPKTVEEMFESAGPIEYRLLPRLIHVTEAAAIAAAYQMGRGDKHFADQVAVASMRRMLNKLDMKGIIKIGEGERDEAPMLYIGEEVGTENGDLEVDIAVDPLEGTNLTADGCPGSVAVMAMAERGGIFHGPDIYMDKIVVGPDVVRYEEEHPGERIDLDAPVSHNLEIVAKALGRKVEELVVVILDRPRHAQKITEIREAGARVRLVTDGDLMPGVATAVRGSGIHVVMGAGGSGEAVLTAAAIKILGGKILARLVLPTVANGKTKEKIDEEIEEKMPRLEAMGITLENINDILDIDKLVPGKDVIFSATAVTPGHFLREVNLFGGGDARVHTVSMGASGAVRFTDSIYIKDKRETPLYL

SEQ ID NO: 14028 - protein, 126 aa, Methanosarcina acetivorans C2A
MKEIIAIIRPKKVEPTKEALVELGIPSVTVVPVFGRGKQRGIAEELNIDIRPGLLDQGLLAGMKYMEFIPKRLLYLIVSDEDVDTAVDTIIKVNQTAQIGDGRVFICPVDNAIRVRTDDQGDSALL

SEQ ID NO: 14029 - protein, 105 aa, Methanosarcina acetivorans C2A
MKMIKAIIRPEAADDVIDGLEGAGFFSLTKIDVFGRGKQKGITVGIIHYDELPKTVIMLVVEDKSVEEVAKLIKYKAYTGNCGDGKIFITPVDDAYTIRTGVSGL

SEQ ID NO: 14030 - protein, 105 aa, Methanosarcina acetivorans C2A
MKMIRAILRPEWTEEVTDGLSEAGYYSLTKINVFGRGKQKGITVGDMHYDELSKTMIMMAVEDEAVEEVIKIISGKAYTGSMGDGKIFVSPIDDAYTISSGAKGL

SEQ ID NO: 14031 - protein, 123 aa, Methanosarcina acetivorans C2A
MKEVTAVVRPNKMSTTKDALDKIGFPAMTAIPVLGKGKQRGISGELNFYIQPRLLAKRYSTGMKYIPKRLLSIVVNDEDVDLVVKTIIEVNQTAQIGDGRIFVEPIDDVIRIRTGEKGELSLK

SEQ ID NO: 14032 - protein, 411 aa, Methanosarcina acetivorans C2A
MTEQELVESGNMKMEWARNHMPVIAIIREKFEKEKPLKGLKVGMALHVEAKTAVLVETLAAGGAQVAISGCNPLSTQDDVARALDTRKNISCFARYGCCTSEYYEAIDKVLDIEPDITIDDGADLIFKLHKERTDLLPKILGGCEETTTGVHRLHAMEKEGALKMPVIAVNDAMTKYLFDNRYGTGQSAWDGINRTTNLLVAGKNVVVGGYGWCGRGVAMRAAGLGANVIVTEVDPIRALEARMDGYRVMRMADAARLGEIFVTTTGNRDILTAEHFKVMPDGAVLANSGHFNVEIDMEALTSLAKSVKTVRHNIKEYDIGDRRINVIAEGRLVNLAAGDGHPAEVMDMSFANQALCVRYIAENTLLNGVHGVPRGIDTYVAKLKLESMGISIDELTSKQECYMTGWECGT

SEQ ID NO: 14033 - protein, 454 aa, Methanosarcina acetivorans C2A
MKIKSINPYTEEVNWVYDVLSFGDCEDQIKKSRATFSGWSSLSVEERTRYIARAAEVLRQSKRVYAEIITKEMGKPIRQALGEIDNCACLCDYYAENSAEFLKDEVVETEAEKSYVTFEPLGIILGIAPWDFPFWQAFRFAVPALTAGNVCLLKHASNVPMSALEVEKVFTEAGLPENVFKTLLIDSKTAMEIVDEDLVDGVSITGSQVAGSEIGELAGRLVKPFVLELGGSDPFIVLEDADIDRASQFAIESRFLNAGQSCIAAKRFIVVEDVVVDFIEAFELHIQELKIGDPMDEETDIGPVAKKECVNILEKILKDAKRKGAEPHVYGEEHAKGFFFRPALIPAASEDMKACNFEVFGPIAPVIIAKDEDEAVEIANSTEFGFGAEIWSADLERAERLAKRIRAGFVTINGMVKSDPRLPFGGVKKSGIGRELSYYGLKQFVNIKTVVVNK

SEQ ID NO: 14034 - protein, 299 aa, Methanosarcina acetivorans C2A
MDRIISVVGHTALDYIIDVENIAGKNESSPVIDYEEYPGGGAANIAVAIAKLGGKSQLMSPVGMDFSSSGYEQLLKDAHVDLSRLYSIEALKLSKAFIFTDREDNQTTYFYWGASSKFKELEPEPVDFAHLATADCIYNAKIAQIAGFVSFDPGQDLVTYSQEKLETILAHTDILFANRHEIKRVSEMTGKSFSELRAMIEVIVITYDAEGSRIYTGNEEWKIPVVSVKAVDPTGAGDAYRAGFLLAYTREYSLPTCGKIGSTVASFAVQSRGCQTSLPTWEEMKSRYEASFGKLEVES

SEQ ID NO: 14035 - protein, 429 aa, Methanosarcina acetivorans C2A [sequence omitted]

SEQ ID NO: 14036 - protein, 742 aa, Methanosarcina acetivorans C2A
MLFSFSLFRVYGVFGIDISKKIFIITILIFAVLTATFAFTYNIQLSNFLGLEKADTLKNVERVQNAVYTEQSYINNMAQDWACWDDTYRFIEDGNQEYINVNLQNQTLDGLKVNVMLFVNETGKLVYSKSIDINTGEETPVPVDLLELVESGVLSTKSEDDVIRGYVLLNRSPMFVSCHPILTTRYEGPMKGTLIFGRYFDIDLLNYFRESTYSSILMYRVDEKMPPDFQGKFQNSSDLSDRVIVEPLSEEKIAGYFELSDVSGQPAIIMRTDFPRDLYMNSKRALNSMYFFLLLTGLVTGVGVKFALDNFFVSRLTEIDNFVTKVRSEKDLSRRLDLKDNDELYRLAKEINGMLNEIELAEQELKVQEREKKVLLDSLNEMVIFVNPQLNIVWANKAALEYMHMDLEKAKGIHLKAIPSMSGPLVEHLPLEEIFSSGNKESGEFTTEDGNSWSIQATPVTDDDGKIIGVLETFRDITGKKAVEKLIQEKQIAEIANRTKSEFLANISHELRTPLNSIIGFSDLLCEQIFGELNEKQLRYAGNISKSGKHLLSLINDILDLSKVEAGKMELDYTEFELAGKLNTIKNLLAPIADRKSIQIEIEVDSRLTNLYADEAKFAQIMYNLVDNAIKFASENSPVNVGARMKGDKVEITVTDIGAGIKPEDQHKLFKPFSQVDYFASKQHQGTGLGLYLVKQIVQMHRGYVWFRSVPGEGSTFAFAIPINGKKSDGNDTAPHIKEQNS

SEQ ID NO: 14037 - protein, 468 aa, Methanosarcina acetivorans C2A
MISRKMNLESLDESKKYRVGAYSARYVPKTKEKGIPKYEFPEEGMSPRAAYQLVHDEQSLDGNPFLNLASFVNTWMEPEADKLVMENISKNIIDIFEYPQTSRVIHHNMVNMLGRLFNGHHTDFVGTSTAGSSEAIMLGLLAHKWSWKKSGRGTDKPNIIFGNDAHVCWDKFARYFDVDTRKVPIDKDRRTITAEAVAERIDENTICVGCVLGTTFTGEIDPVKDINDLLLEYKEEKGWDIPIHIDAASGGFILPFTEPDFEWDFRLERVKSINVSGHKYGLTYPGLGWLIFRNKNALPEDLIFHVNYLGEMEDSYTLNFSGGSAMVAAQYYNFLRFGRAGYTGIMKKILAVSQDLAEKVDRLGRFEMLNKGERLPIIAFRQKEKTGYSLLQLSHKLREKGWIVPAYCLPENAADIEIMRIVVRENLTPDMASIIVEDLEKACQFLENGTEAGAEKPCPSGKDMAHIC

SEQ ID NO: 14038 - protein, 499 aa, Methanosarcina acetivorans C2A
MSSFTLLIIIFYFWSIGRKSANISRKGWFLIIAGFFLLFAGHLADLYESLRLVGENPVSPLHNIFLKAFLGGPVSYVLIAAGLLKWVSTVASVEKLKAEVEKRKEMQEKLSRERSMLSGLLNSIPDAVFFKDPEGTYLGCNPVFCEFVKRPTEGVVGKKNPDFYSKEVASFLNAEDKEIFETGKAIIRERWATRPDGRKVLLQTVKAPLYDETGNFIGLVGVSRDITERQRAEDALLKVRIAEDASQAKSEFIATVSHELKTPLNSIIGFSDLLLEDSSGKLSERQARYINNISISGKHLLQFIDDILDLSKIEAGKTFLEPENFEFTKIFKDIEKVFRPRVSGKKLSLNFEVDSGIKSFYADKMMFKQILYNLISNAVKFTPEEGSITVSAAKIGNMVRICVKDTGIGISREDMDSFFQPFKQPDSFFKRRYERTGLGLFLVKRFVEMHGGNIQAESVPGEGSSFIIELPLKTGNEGIMGVISGNEDKGQFISAVSSL

SEQ ID NO: 14039 - protein, 1000 aa, Methanosarcina acetivorans C2A
MCGLKKRLFIDCYEGESIEEIRGKKRADREETEVQEKSHLEEKLVRLEWQADSAVTGLITMDFDGTLSYVNPFFVRMWGYGSAEEPPGRQVSELWASPAEFLQAERECREKGEWIGELQARRRDGTFFYVHTSLSLIRNREGLPLGISGSFVDITRLKQVEEELRNRTLELSEAKARLDLALEATEMGTWDWDVLTNGMTWDDNLFRLVGISREEFLQTHDSLLELSNRILSPEDNRRMLEVMQAVADGKTDSYEFEHDVLRPDGTVRHFLVKGRAHRDSEGKLLRVTGTTTDITDQKIAEDALRRSEANLARSQAMAHLGSYSFDAHTGEIYWSEELKTIWDYDPGPNYSFETVISRIHPEDRKRILEALKNAGQGKHPFNSEYGILKPDGSIRYVHDQGEISLDGNGVPVRMFGTLQDITHRKLMEEQLLKAKEAAESANKAKGDFLANMSHEIRTPMNAVLGMLEMLLETSLTDEQREYLQLAHASAESLLSIIDDVLDFSKIEQNKLELEQISFELESLISHIINLLSGKAGSKGLKLAFHIEKDLPSTFIGDPVRLKQVLFNILGNAIKFTKKGEIALSVEVYMPSERNSGLSNSDFPEEVALLFKVKDTGIGIPPEKLSQIFDPFIQADASVTREYGGTGLGLAISSQLVELMEGRIWVESEVGKGCTFYFTVRVKRGESSENYGQGNNIPEESLLVCMEAKESYGNGITSGESLNVLFAEDHPINQKLILGLLEKKGHKLTLVTSGKDALDALSRRDFDAVLMDIQMPGMDGLEATRRIRDPSSGVRRHNIPIIAFTARALKEDREKCFEAGMNYYISKPLKKEKLLNILEDIRVGKNTREKTARERTVQDRIVQEKNIQERAATPLDLESIAFDFPEDQVFNLEEVLERTEGDEVLLKEMVKIFLGMAPELLDSINSALRKGEAEALRENAHILKSAAGSIGANRVFRVAYYLEQVGRRDRMELASDKFEEIKARFKELEPVLVRYLEKQIC

SEQ ID NO: 14040 - protein, 887 aa, Methanosarcina acetivorans C2A
MKKSNELIFILVLGFIFTLVASNYNLFESVVLFVEEYNLDGLGLLLILSIYTSFGMGIFSLGRWMELENTLTLYRKAEEDLREKDQMYRALFEMSNDAVIISDGKKVLDINNKGCEIFGFREERPLNVSLISFIPPEYLSELQQALKETFKQASSCFEMRYQKAEGEIVDIEVSLSLIDRNNNIIHIVAQDITGVKNAERLEQENRERFKTVLDNTLCSILLIEASSRKIVDANPVALKTTGYSEKELIGMVCSRLICQAGEERCNVPSLDPAGELSESILFKAGGDKISILRNVVPVSIGGNGYFVESFIDLSERKKVEEELLQAKLAAEGANRAMSEFLATMSHELRTPLTAIIGFSELMLGEATGEFDELNRKFLGHISNSGKHLLSLINSVIDLSRIEAGKMDLEPDFFSLYDIFADTKSISSPLALKKNISMDFNVESDFLIYADRTRFKQIMYNLVSNAIKFTPAGGSVEVVGRRSENRIRVTVSDTGIGISQDEIKHLFKPFKQINFALSREYESTGLGLVLSKNFVEMHGGRIWVESEPGKGSTFTFEVPVEILNSGEKMKIPEICGINGANNFEIPAETGEAGNSEIGSQTEKSEEKDFVEIFEPEGSDGSEPLVMIVEDDKLSRELLIFTLKEAGYRVVRALSGKQALSLAQKLNPFVITLDLMLPEMNGWDVLKNLKKDSETAGIPILLLSIDERDECNMVWGAFDHLVKPVEKSILLSTLERLNKKTKKGSPKILIADDQEDMVELMVSLVKEEGYIISRAYGGKEAIDKALTELPDAIILDLMMPEVSGFEVIRTLKKDPETVDIPVIVCTARDLSAEETELLNSNVSVVMQKEDLNKQILMQLIRSLESREEGCRTCILSAPREDRSFCKAEE

SEQ ID NO: 14041 - protein, 325 aa, Methanosarcina acetivorans C2A
MHGLSCQIRFINFSLYFYWGGNIMANLRRVRKVMRSMPTIEGAGVHLKRVFGFQNVPELDPFLLLDDFHSEKPEEYIMGFPWHPHRGIETITYVLQGEVRHEDSLGNKGAIRPGELQWMTAGSGIIHQEMPEGDENGILWGFQLWANLPASHKMMNPRYQEIKSNVVPELFMEKGLKVRIICGEVNGIEGPVREIVTNPEYLDVTVPPAEKFFHLTVPGYTVFAYVIEGSGNFDREKDPCTFEVEGKRYLDPAVDCMIEKETLVLYGDGDSIEVTAGERGVRFLLVAGKPIGEPVAWYGPIVMNTQAELKTAFEEYRKGTFIKHP

SEQ ID NO: 14042 - protein, 572 aa, Methanosarcina acetivorans C2A
MLGKQGIKSLIVLPLYVSGKLAGFMGLDNVVNTGTWEKDDVSILRIAVNLIGMGIQRKRTEKAIHEGEEIYRSMFKNAANLILLVEKNGNIVDCNSRVGELLGYRRFELLGQPIRNLIFPDCLEKIKKSSEEVENRGFSFNKEYRMVRKDGKTVDVNVNSSGLKDENGFHVQTIYIVEDITERKKAEKLVKENESRYRSLFQNNRAVMLLLDPDTGNILDANSAACAFYGYPREKMLGLNIADINILPKEQILEELEQEKSRDINHFYFTHRLSNGVLRDVERYSYPILMGGKKLLYAIVSDITDNRKMQSELVRAKMEAEIASKAKSEFLASMSHELRTPLNSIIGFSDMLLTQNFGPLNKKQLRYVNNISVSGNHLLKLINGILDLSKVEAGKMELKVEEFSVLDSISEVKVLLTPLASKKDIQILSVVDKELTTIRADRTKFKQILYNLVDNAIKFTHEDGFVIVDARVEGDQAKIMVKDTGIGISKAGVKKIFQPFTQLENSEYGKQKGTGLGLSLVKKFVEMHTGKIWVESEFGEGSKFIFTIPLSLTIPLSLTIPLSLTIPLNPAN

SEQ ID NO: 14043 - protein, 725 aa, Methanosarcina acetivorans C2A
MNVSDKTLIIICLIFASLIAISGGASRTILLSGYLDLEEQDISEKLELVESNFQSEVSRISSLNHDWASWDKTFEFMENGSQTYINSYLTDEIFSEAGINLVLYVNNSGEIVYEKVIDPETGETLQIPSELRRVVHENGSLLALHPGDQKSGLIRTGNGPLIISSRPILTSTDSGPVGGTLIMGRYVTESFLNEIAGIQGIQITLEDVEILGSEPASYFEDLPSRNPDTEIDGQHIEVIDEKWIAGYIRLNDLEEEPGILIKVNSPRTLYAQGKHNLVFFIIIFSLACIIVAIATNYLLKRLIISNLTEIERFVTDIGEENNLSKRLEIKGGDEFIRLSGGINSMLQDLELSQKEVMHRESEKHALLNSLIEVLIYLDSELKIAWTNNKVSEYFGEKTEAITGRTHHELWGDKNPILAPFVRKALNNGKTQSFEINVSDKDSWTGEIWSVTIGSVRDRDGKLIGTIESILDITEVKKSEEKMLQAKILAENSNRSKSEFLSNMSHELRTPLNAVIGFADILNEEGFGPLNKKQKRFVGNISTSGKHLLKLINEILDLSKIEAGKMEFKCTEFSVKEKFDEIKDILFPVFSKKKIRIEFEIGDGITTIYSDEGKFVQVLYNLVSNAIKFTEEGGFVKVSARKNGDMLQLSVKDTGIGITEEDLMKIFHPFVQVDSFSTRQYEGTGLGLALVDQMVQLMGGEICVFSQPGIGSEFICMIPLKNYDRK

SEQ ID NO: 14044 - protein, 1233 aa, Methanosarcina acetivorans C2A
MEEPEFQAYVGPRPFEQEDKFIFFGRDREARDLLSLVIAHNLVLVYAQSGAGKTSLINAGLIPLLKENRFEVFPVARVKGTPLRNIKTDEISNIYVLNTLTSWAEDEYDVERLTKMKLVDFLNEQERLQDEDGIPLPRAVIFDQFEEIFSLYQDRWKDREGFFEQISAALETDPLLRVVFVIREDFIAQLDPYVELLPERLRTRFHIERLRREAALLAIKEPLRDTGRSFAEGVAEKLVDDLLKIRVETTPGETTEVTGEFIEAVQLQVVCQNLWRELPPDVKQITFHHLKTYGNVEQELYRFYEEAIRTAAATAHIDEESLRRLFGEVLITTMGTRGMVYRAQESTGGIPNTAIDVLESMHLIRAEWRAGARWYELTHDGFIKPILSSNRVFNDELAEKERAEKERIEKERIEKEWAEKEWAEKERLEKERAEKERLEKELRAEKELAESKQLFYKRLAAISFLAILLALVAVFEWHQAKENAEEARASDLNLNSALLQGDPRNLDKSVLLAIESLKIHITSTADHLIRQGLLSMPHRVVILKHYSDVNNVVFSPDGKYVATASNDNTSRLWDVSTGKQIFVLNHTDPVRNVVFSPDGKYVATASADKTAGVWNTTTGEGISVLNHTGRVNNVVFSPDGKYIATASDDNTSRLWDTATGKQIFVLNQTDPVRNVVFSPDGKYIATASADNTSRLWDTTTGKQIFDMKHDGPVNIVVFSPDGKYVATASADKKARLWNATTGKKIFDMKHDSGINTVVFSPDGKYIVTASDDKTAGVWNTTTGKKIFDMKHDGSVNTVVFSPDGKYIATASADNTSRLWDTATGEKIFFLNHYGWVNTVVFSPDGKYVATASADKTAHLWDVSTGKQISYLRHDSGVNNVVFGPDGKYVVTASADKTADVWNTTTGEKIFVLNHTGRVNNAVFSPDGKYIATASADNTSRLWDTTTGKQIFVLNQTDPVRNVVFSPDRKYIATASDDNTSRLWDTATGKQILVLNHDGPVNTVVFSSDGKYIATASDDNTSRLWDTATGEEIFVLNHTDRVNNVVFSPDGKYIATAGDDNTSRLWGTATGEKIFDMKHDGPVNNVVFSPDGKYVATAGYDNTACLWDTATGEKIFVLNHAGRVNTVVFSPDGKYIATASADKARLWNATTGKQISYLRHDSGVNNVVFSPDGKYIATASVDKTARLWTAKLWISDTEDLIDEANNRLTRNLKPEEWKEYMGDKPYHKRFPNLP

SEQ ID NO: 14045 - protein, 726 aa, Methanosarcina acetivorans C2A
MQVCGFTSGSLLVMCMDVSKKLLIVTFTMFALLTVLLIIAAHTILLSSFSDLETQDTIKNTGKIEQAIAWEALSLDRTARDWGFWDDTYKFVDTLSPEYIESNLDDSTLYDLDLNVMLFVNKSGVLVYPMSVDLVNMTNVPVPEGLLKQIDSGILTTRENTDQIQGVVLLDEGPMLIVARPILTSFGEGPSAGTLILGKYIDNSYISSLEERTQTSLSLYTLNEEMPPDFQEVFDEAASNDGSAVKILGSERVAGYFILRNTNGEPVALMRADYPRDLYAQGKKTLVYIYGFLLLSGLVIGTATKFSLDSLLVSRLITIDGFLENVKKEKDISKRLEVEGEDEIHRLSKGINEMLSSIRLAEQELKAREYEKKFILDSLEEMVVLRDPNFNIRWANRAALNNKDLLKAEDKAPEADSPEAQDRYNIPKPLYPLAPDYAAHELTSSEGKTWLLRSKPVCDKIGNTIAVLETGVEITERKNYEIELFRAKQDAEVANRAKSAFLANMSHELRTPLNSIIGFSDLLYEKVYGELNLKQTKAVGNISNSGKHLLNLINEILDLSKVEAGSFELHYSTFWLAEVFAEVRDMIFPFATSKGLKIELEIDSNLSRVYADKERILQVLSNLVTNAVKFSNENGCVKVKAVQMDGFLKITVADDGIGIAAADHEKLFKPFSQIDSSFSKRYQGTGLGLALVKEIVQLHGGTVWFESEVGKGSVFGFSIPLPGRSE

SEQ ID NO: 14046 - protein, 740 aa, Methanosarcina acetivorans C2A
MLGVYAIDISKKVLIITLLIFAVLTASFTFTHNMQLSNFLELEQADTLENVERVQNSVATEQGYLDYIVQDWACWDDTYRFIDDKNQEYINVDLQNQTLAGINVNVMIFVNNSGEVVYIKSVNTHTAEEMPVSDDLLAMIKDGSLLTTGDEDSISGFVLLEEDPMFISCHPILTTTYEGPSKGTLIFGRYFDDELLDSFKRVTRSSLLMYRADENMPADFQTKIKNASENPDRIIVEPLNEDQIAGYFGLKDINGDLALLIRADFPRELYRHGERTLNYMYWFLILTGLMTGVGVKFALDKLFISRLVEIDDFVTKVRSEKDLSKRLDLKDNDELYRLSREINGMLNEIYLAEQELKAQAREKKVLLDSLNELVVFVSPELKIIWANKAALEYMNMDLESAMGVCLKATPGISGPLVEFMYLEHIFTSEEKKSGEFTAKDGKVWFFQATPVTDDQGKIIGVLQTCRDVTERKEAEKLLQEKQVAEVANRTKSEFLANMSHELRTPLNSIIGFSDLLYEKIYGDLNEKQLKAVGNISRSGKHLLNLINDILDLSKVEAGKLELEYKEFELSSKLNSIKNLLSPIADRKMIEVQIQVDESLNTIRADEARFAQIMYNLLDNAIKFSKENGLVEIDAKRKGDTVEITVKDYGIGIKVEDQSKLFKPFSQIASFSSKKVQGTGLGLALVKQIVNLHGGYIWFNSRIGEGSTFAFTIPINGNKRTEGDSEVEASNIAGKAEDSES

SEQ ID NO: 14047 - protein, 1051 aa, Methanosarcina acetivorans C2A
MTVIINKLKNTKNSLPLLEFTLTKLWESRSDGMLTHEAYTRIGGTSGAIGQWANETYNSLNTEEKELARKIFTRLIHYGNGDFPDSRRRLPLESLAGESDEQAVHRLIKKLADAHILVTDCDLSKGTETVEIIHDSLLIEWKQLNKWISEHRGFLTWRQRLEDKMEEWNRKGDEGNLLRGAPLVEAKNWMEKNKRELQSDEIKYIEASSELEEKTRAEKEKARSLIIKGLAIFSIFILILAGVAAYQWYQTEQQKQLAESLSLSSKSTSISSFLQKNPKNRDKSILFAIESFQILKTVDADQLIRQGLLFIPHSVVVLKHDDWVNKTIFSPDGKYVATVSNEKAQIWDLSTEETIDVISHNGSVRDVNFSPDGKYVATASRDKTSHIWNISTHKEIAVLNHNDELAKVFFSPNGKYIATMSYGSTAYVWNASTYEQIAVLKHADKVCDVELSPDGKYIATASQDNTSRLWDVTEAENITLKHTLKHNGSVLDVTFSPDGEKVATASQDKTACIWDVSTGKQITVLNHSNSVSKIIFSSDGKKVAMMISGNIACLWNSTGKQIDVMNHTDVMRDVAFSPDGEKVATASADRTSRLWNVSTGKEIAVLKHDYSIKKVFFSPDGKKVATASADETARLWDAYTGKEIAIMNHGKDVVDIAFSPDGKKVATASADNTSCIWDVYTEIPVLNHKDSVLNVEFSPDGVYVATASQDNTARVWDAYTGEEISVLKHDAGINKAVFNRDGKYVATASQDNTARVWNTSTGKDITLKHGGGVLDVAFSPDGKYVATASQDNTARVWNWNAPTGENITLKHEGWVNKIVFSPDGKYVATASADNTARIWSASTGKQIDVISHDGSVQDVEFSSDGKYVATASDDNTAKVWNWNTSTRKNITLKHTLNHSNKVHDVAFSPDGKKVATASWDKNARIWNLSISNDFTNLSHDDYVSRVEFSSDGKFIATTSYGETAFIWDASTGDKIAAISHDGVVNDVVFSPNGKYIATASDDNTAKVCLCNIEDLINETKNCLDRNLTQEELKEYMDNESYHDQETFPNLL

SEQ ID NO: 14048 - protein, 804 aa, Methanosarcina acetivorans C2A
MSENKSKYTRWFEETKIEDVPLVGGKNASLGEMYRELTSKGVKIPNGFSVTAEAYWYVLKAGGILEKLKQTMEGLDTSDVSELAKRGKAARDLILGAGIPDDLWEEIKTGYDGLCKQYGENTDVAVRSSATAEDLPTASFAGQQETYLNIRGYPALRDACSRCLASLFTDRAISYRVTNNFDHFKVALSIGIMKMVRSDMASSGVMFTLDTETGFRDVVFITGSYGLGENIVQGQVNPDEFYVFKPTFREGYKPIIQKNLGDKQIKMIYGRGDSKVLTRNVEVPEVDRVRFCINDEEVLKLAEYAITIEDHYSNKYKEPRPMDIEWAKDGVTGELFIVQARPETVQSQRKRDILETYVLEKKSNALARGKSVGEKIASGKAHVIPDISDLPSFKPGEILIADTTTPDWEPVMKTAAAIVTNKGGRTCHAAIVSRELGIPAVVGAGNATEVLETGREITVSCAEGEDGLVYEGILPFHKDAQDLKDLKRPKTEIMMNLGNPEEAFGFSMIPNDGIGLARLEFIISSYIKIHPMALVHPEKVKDPEVLQEIEKLTGNSDREEYFVDKLSQGVGTIAAAFYPKPVVVRMSDFKTNEYASLLGGSYFEVTENNPMLGFRGASRYFNERYREGFALECRAMKKVRDEMGLTNLILMIPFCRTVEEAKKVIAEMEKNGLKRGENDLQVYVMCEIPNNVLQIDEFSEYFDGFSIGSNDLTQLTLGVDRDSELLAAEFDERDPGVMEIMAMAVQGAKRNGRHSGICGQAPSDFPEIAEFLVKEKIDSISLNPDSVMKITLKVSDTEKELGRQ

SEQ ID NO: 14049 - protein, 242 aa, Methanosarcina acetivorans C2A
MIKGIVMSLVGQTALVTGGNKGIGRAICFALAKEGVNIIIAARNESESKETQDQLKDMGSKAFEIPVDVRNEEDVRRLISRTIDKCGRLDILINNAGVALKKRLEETTVEEYDKIIDTNLKGVFLCTKYAIPYLRRSKNGKIINISSIGGLHGIPEFSVYCASKFGVNGVTEAIAAELEGQIKVYSICPGAVDTDMYRSIYKSRPELKPENVAQKVLEIASPESRVASGKIIEISALPIPQI

SEQ ID NO: 14050 - protein, 320 aa, Methanosarcina acetivorans C2A
MGIREDIKTVFEKDPAARSTLEVLCCYPGLHAIWMHRVAHSLWNKDLLFLARLTSHISRALTGIEIHPGAKLGKRVFIDHGSGVVIGETAEVGDDVLIYMGVVLGGTALEKKKRHPTVENNAVLGSGAIVLGPITIGRGAKVGAGSVVVRSVPPEATVVGVPARIAGTPQPSAPSEQLDHNKLPDPVLTVISQVLDRMSRLEERFQAHEKASTTPVPVSFVSSENPSVKKDEQIYSLLKDVIDPAVGIDIVNLGFVKEVTVNGTNVDVNLVLTTSACPMIEYFRNQVKRKVMGIKGIENVTVNILDEPWKWDGAGRQAFH

SEQ ID NO: 14051 - protein, 390 aa, Methanosarcina acetivorans C2A
MRKESYEFPLEDFIPREDFNKIKKFSRDKETPFLVIDLQKIERSYEELVEHMPFAKIHYAVKANPMDRVVLALKDKGSNFDVATIYELDQVLRLGVEPERISYGNTIKKEKDIAYAYEKGVRLFVTDSESDLKKLSREAPGSRVFFRILTESDGADWPLSRKFGSHPDLIYKLILKAEKLGLEPYGLSFHVGSQQRDIGQWDNAISKCKYLFEAAAEKGIQLKMINLGGGFPAKYQAQANDLETYAREIRRFLHDDFGEELPEILIEPGRSLVADAGIIVSEVVMISKKARFNQYKWVYLDIGKFGGLIETLDECIKYPIFCDKKGCAEEVILAGPTCDSMDILYEHHKYSFPHTMREGNRAYIFTTGAYTQSYCSVNFNGFPPLKAYLI

SEQ ID NO: 14052 - protein, 503 aa, Methanosarcina acetivorans C2A
MVLYSLFQGDFVVQEYKLHIGGESRDSATGETFDNINPATLENLATVQVAGSEDVDRAVEAAEEGFRVWSEVPAPRRAEVLFRTARILQERKEDLARLMTEEMGKVLPETRGDVQEAIDIAIYAAGEGRRMFGETTTSELKDKFCMTVLRPIGVVGMITPWNFPLAIPGWKIMPALIAGNAIVFKPASDTPLLAIKLVEILMEAGLPPGVVNLVTGPGGSTGKAIVQHPRIKAISFTGSLETGKWIMEECAKTMKRVSLELGGKNPVIIMDDADLELALEGVLWGAFGTTGQRCTATSRLILHEKIKDEFTARLLAKTKLLRVGNGLLPETDIGPIINKAQLEKIERYVRIGMEEGATLLLGGKAIDPGLPGYFFEPTVFTDVRPDMRIAQEEIFGPVLSIITVSGLEEAIEVANNTRYGLSSAIYTENVGKAFRAVKKIEAGITYVNAPTIGAEVHLPFGGVKGTGNGFREAGTEAIKEFTEIKAVYIDYSGRLQRAQIDME

SEQ ID NO: 14053 - protein, 1447 aa, Methanosarcina acetivorans C2A
MITSKSVAADELESRLKGRIAELEKSNGELRARLLEYKHSEEAMSKSEEKLGYISPQGKEYRFNTRIVPEFVDGEVASVLAISHDITDIKEAKTRLKETRDNLEELVEDRTTQLEKAYRSLKESEKDLAEAQKIAHPGNRNWNIVTDELYWSDEIYRIFGCTPQEFGATYDTFLSYMHPEDQDYVNYVNNAVNGALNGKPYSTDHRIALAGGEEWIVHEQGEVIFGKGKLRTSGIDIIGDIPWGTHFCQFYQTKEDLMDVLVPYLKAGLENNEFCMWVTSQPLDMKDAKEALRRAVPDLDTYLGKGQIEIIPYTHWYVQEGSFDSERVLNGWIEKLNKALANGYDGLRLTGNTFWLEKKDWNDFVDYEEEVDRVIGNYRMIALCTYCLEKCNSTEIVDVVINHQFALIKREEKWEQIESSKRKRAEETALQAAKDWKYTFDAVPDLIAIIDTEYKVVRANRAMAAKLGVTPEECVGLTCYRAIHGTNEPPSFCPHRQLLKDGIEHTTEVCEDCLGGYFLVSTSPLHDSEGKLIGSVHVAHDISERKQAEEALIRSENEFRTLAENSPDLIARFDRQNRHLYINPVSVEIYDHPQEKVIGKTHSELGRDPEQIKFWEEHHEKVFAIGKPETMEFEYTSPQGKKYYFNTRIVPEFVDGEVTSVLAISRDIADIKEAEIRLKETLDNLEELVEDRTTQLEKAYRSLKESEKGLAEAQKIAHLGNWNWNIVTDELYWSDEIYRIFGCTPQEFVATYDTFLSYVHPDDSESVENAVKGALDGKPYSIDHRIILAGGEERIVHEQGEVIFGEGNVPFRMNGVVQDITERKKVEKALELANAYNRSLIEASLDPLVTIGPDGKITDVNKATELVTGHLRSELIGTDFSDYFTEPEKAKEGYKQVFREGLVRDYALEIQHRDGHITPVLYNASVYRDKDWEVIGIFAAARDVTEYKRAEKALKLANAYNRSLIEASIDPLVTIGPDGKITDVNNSTESITGYSRNELIGTDFLDYFTEPEKAREGYQHVFQNGLVRNYPLEILHKCGHLTPVLYNASVYRDETGKVIGVFAAARDITELKKAEEKIQTLANVVESSNDAIITESLDGIITSWNKGAEQVYGYLAEEVMGKNMSILESDNLKGEIKQLVDRVKQGKKVQNHETLRLKKDGTILNISVTLSPVFDVSGKLVAISNIAGDITEKKISENLLHEKQMAEIANRTKNDFLANMSHELRTPLNSIIGFSDMLYEQAYGELNRKQLRAIGNISSSGKHLLNLINGILDLSKIEANKMELNYREFDLATKLELIRNVLYPVADKKNIDIEIDMDTELTKICADEEKFTRIMYNLVDNAIKFSYENSLVKIGARKNGNLVEITVTDAGIGIKAEDQHKLFKPFSQVNSFPSKKFQGTGLGLSLVKQIVNLHGGYVWFRSEQGEGSTFAFAIPIASKMKVLACYH

SEQ ID NO: 14054 - protein, 761 aa, Methanosarcina acetivorans C2A
MVFKMIELYTSDKPKVLIIDDEKDQVELLCLQLEDEYLPIPAYSGKEAIELVKAKLPDLILLDLMLPENDGYEICSTLKSDPEYRFIPIIIISRFFEKTNKMKATRCGADDFIHKPINRFELKTRIKSLIRIKKNYEALQESENRYKQLFNNSPAVTLLIDPVDYLIADANEPACAYYGYTYAEMTAKKITDISIYSRERNRKISQQVFSEKKGHFYSCHKLASGEIRHVEMYINTINIRGRELFFTNVYDVTASKKIERELTESEEKFKQVVELSIDGIIIGANSGKIVDCNEAACRIFGYGKEEMLELNVDNILREDFMQSIPEIITTGKAVSENKTIESINKRKDGTFFTAEIATRTFKLGDEDRLIVYVRDITERKKAERDLKSSEENFRALVNNTLDGIIILNFEGEVIAANAAVGKMFNVELEKITGTNIAKYLAPESVPVAIRDQINVLNNQGGYLSVYKAISSMGEHFWIEGLGTKIIYQNQPANIVVIRDITVRKKAEEALINAKTAAEVANRTKSEFLTNMSHELKTPLNSIIGFSDLLKEEIAGPLNEKQSRYVQFISSSGKNLLEIINDILDLSKAESGEEDLNVEKFSVDESINKVISVVLPQAQEKNIILNYQSENRTLWITADEGKFRQIMENLLSNAIKFTPAGGSIDVTLKQEGLLVTIEVKDTGIGIPEDSFEKIFKPFIQIDSSLSRNFEGTGLGLTLVKKYVEMHGGNIYVESKIGEGSSFRFELPVTRKRTVEPVLKVLE

SEQ ID NO: 14055 - protein, 802 aa, Methanosarcina acetivorans C2A
MPGDKNKYIRWFEETTIEDVPLVGGKNASLGEMYRELTSKGVRIPNGFSVTSEAYWHMLKAGGILEKLKKTMEGLDTSNVSDLAKRGKAARDLILGAGLPDDLWEEIKASYDRLCEQYGEDTDVAVRSSATAEDLPTASFAGQQETYLNIRGYPGLRDACIRCFASLFTDRAISYRVTNNFDHFKVALSIGIMKMVRSDLASSGVIFTLDTETGFRDVVFITGAYGLGENVVQGQVNPDEFYVFKPTFREGHKPIIQKKLGSKEIKMIYGRGDSKVLTRNVEVPEAERLRFCINDEEVLKLAGYAIDIEEHYSNKYGESRPMDIEWAKDGITGELFIVQARPETVQSQRAKDVLETYVLEKKSEVLAKGRSVGDKIASGKAHVIPDVSDLPSFRPGEILIADTTTPDWEPVMKTAAAIVTNKGGRTCHAAIVSRELGIPAVVGAGNATEVLETGREITVSCAEGEDGFVYAGLLPFHKDTMSLKDLKRPGTEIMMNLGNPESAFAYSMIPNDGIGLARLEFIITSYIKVHPMALVHPEKVKAQGEIQEIEGLTRGYEKKEDYFVDQLARGVGMITAAFYPKPVVVRMSDFKTNEYASLVGGSYFEMDENNPMIGFRGASRYFDERYREGFALECRAMKKVRDEMGLTNLILMIPFCRTVEEAEKVIAEMEKNDLRRGENGLQVYVMCEIPNNVLLVDEFSEFFDGFSIGSNDLTQLTLGVDRDSELLAAEFDERDPGVMKIMSMAVQGAKRNKRHSGICGQAPSDFPEIAEFLVKEGINSISLNPDSVMKITLKVLETEKEL

SEQ ID NO: 14056 - protein, 249 aa, Methanosarcina acetivorans C2A
MNLNTRIKNYWEGEAQGYSEAIEDELNGFERKAWADLVLEYAPSRDCLDILDIGTGPGFFPIVLTQGGHNVTGIDLTENMIEFARFNLAREGVNANLMTMDCQNLKFPDNSFDLLVCRNLTWTLDDPARAYKEWYRVLRPGGRILIFDACWYLHRFDENLKIAYEKKEKEVLMKYGHPMHQHKNQAEDDALSRKLFMSDKVRPQWDLDIMLKLGFSKVFADTSVGERVLNEEQQDRNSMHPPFLAGGEK

SEQ ID NO: 14057 - protein, 685 aa, Methanosarcina acetivorans C2A
MLSGRMVEIMDMLIYLAPICALIGLIFAGISYKNVQNEGAGNDLIKKITASIHGGAMVYLNRQYRAIAVFVVFLAIIIALILPNGALTAACFVFGAVLSATAGYAGMLTATIANGRTTNAATRGIGPAFRVSFASGTVMGMSVVGLGLFGLSLSFIILESVYTDLDLLTIVNIVAGFSLGASSIALFARVGGGIFTKAADVGADLVGKVEAGIPEDDPRNPAVIADNVGDNVGDIAGMGADLYESYVGSILATMLLAASTAATTFPNIPVENVILVPLIISAIGILASIVGTFFVRTNKTESSAIHMAFNMGLIAAIILTVIASYFVTSMLLGEYGLNVFFATVAGLVAGFLIGQITEHYTSYDRKPTLRVANSCQTGSATNIITGFAKGMESTLWPVVIISIAIYIAFQLSGLYGIAIAAVGMLATLGISLSVDAYGPVADNAGGIAEMSHQKEEVRQITDTLDAVGNTTAAIGKGFAIGSAALTALALFASYGIAVGLSAIDVMNPNVFIGLTIGAMLPYLFSSMTILAVGNAAGEVVVEVRRQFREIAGLMEGKADPDYGKCIAISTHSALKEMIPPGLLAVIAPLLVGLVLGPGALGGLLAGSVASGFMIAITMSNAGGAWDNAKKYIELGNFGGKGSDAHKAGVTGDTVGDPFKDTAGPAINILIKLMSIVAVVFAPLFM

SEQ ID NO: 14058 - protein, 671 aa, Methanosarcina acetivorans C2A
MESLIFIAPLAGVISLVFAAFFAKSILKEDAGNKRMKEIAGAIQEGAMAYLNRQYKTIAVVSIILSFLILFLLDDGLKIAIGFLAGAISSAAAGYIGMSVSVRANIRTAHAASSGLEKAMSVAFRGGAVTGLAVVGLALLGTSSFYILYGDVDLVVGFGFGASLISLFARVGGGIFTKAADVGADLVGKVEAGIPEDDPRNAGVIADNVGDNVGDCAGMGADLFETYVVTSLAAMLLGSLIIGTYENAILYPLVLGSVAIFASIISVFFVKIGKEGKIMQALYKGVGGSAIISLIAFYFVTNSLMGDIRLFYATVVGIIITVLMVIITEYYTSTDYRPVKTIAASSETGAATNIISGLSIGFESTLVPTVVIVIGILISYFIVGGAADAGIGLYGIAIAAVAMLSTTGMIVALDSYGPITDNAGGIAQMANLPAQVRKVTDALDAVGNTTKAVTKGYAIGSAALGALALFADYRSKVNLGGQSLNLDDPVVLAGLLLGALLPFVFSAVTMSAVGKAAFEVVNEVRRQFREIPGIMEGTAKPEYGRCVDIVTKAALHEMAMPGFLAVLVPLLVGLILGPKALAGLLIGLIVVGFMLALMMDNGGGAWDNAKKLIEDGNHGGRGSEAHKAAVVGDTVGDPFKDTAGPALNALIKVVNMVAILFSSLIIHSGLF

SEQ ID NO: 14059 - protein, 108 aa, Methanosarcina acetivorans C2A
MKTMQMIRAVIRPGMESKVVECLEKEGCISLTKMEVFGRGKQKGIHIADIHYDELQKTMLLMVVEDEHKDKVIKTIMEAARTGKYGDGRIFVNPVEEAYTIRTGKAGL

SEQ ID NO: 14060 - protein, 125 aa, Methanosarcina acetivorans C2A
MKEITAIIRMNKVQKTKNALLGCGFPSFTVRRVMGRGKQRGLCFEFNPPLPDPEKEAETCIRFIPKRMFTVVVDDENVSEVVQKIIEVNQTGNAGDGKIFVSNITEAIRIRTGESGEATISKELM

SEQ ID NO: 14061 - protein, 126 aa, Methanosarcina acetivorans C2A
MKWDRGYLLVVAMKYIIAMIRPEKLDAVKRELQKVEVNRLTVSSVSGYGAQKGQLEIYRAMEFEADLLEKIKIEIAVNDEFLYPTIEAIKSGAKGSEGHIGSGKIFVLPLEDVIRIRTDESGPVAI

SEQ ID NO: 14062 - protein, 375 aa, Methanosarcina acetivorans C2A
MDVGKYITSSHLEIMPAGTLSESILLFESAVKELLKEGSGKSFSEGFSGFRTNLDVKGTENPFKACFEGLEKILEDISQGNGRNFTFLCTFPLEELSGSALLELVEEKGVLVNRKGKWEYLVNTCDVNGQKELEITLLKAKKDAEATNRAKNSFIMNMSHELRTPLNSVIGFSDLLLEGAFGPLNTKQSKYVNNILISGKNLLEIINNLLDISRLEAGEKTLKYENVDIASLIGDVRMSLLSPASVKRITVELKIDPSVGNVRADITKLRQILYNLVSNAIKFTPAKGKVVISACKKEGVLEVKVSDTGIGLSKDSHEKIFMPFTQADSSAARGYGGAGLGLYIVRNFVDLHGGKIWVDSEVGKGSIFTFTLPAE

SEQ ID NO: 14063 - protein, 479 aa, Methanosarcina acetivorans C2A
MVAMKMQINGKAVEACGGEVFGIKNPATGELIEQVPRGTEEDVAVAVEAASSAFTGWASASPQQRGEVLYRAAEIVRQRKDELASLLTQEQGKPIVEARNEIEGFAHVLEYYCGLSGSQRGDFIPVPGNGYAFTVKKPLGVCAAIIPWNMPALIMGWKIAPVLISGNTLVLKPASNTPLTNLTLASIFVEAGLPAGVLNVVTGPGETVGESLVRSPEVRKISFTGEARTGKRVAELAACGMKRITLELGGSDPMLVCDDADLESAAAGALRGRFYNCGQTCTAVKRLYVFESVAEEFIKKLETGIKSLRLGNGMDKNISMGPLNNRTQWEYIKELAAEIEEKDAGRIITGGKVPEFKDSEKGYFFEPTLVSDVPGDSRLLKEEVFGPLLPVVTVKNLDEAIVGANSTCYGLGASIWTKNIDRARKGCEQLNAGIIWINQHLKVAPEVPFGGVKESGFGRENGPESLSEYLETKTIMLKI

SEQ ID NO: 14064 - protein, 112 aa, Methanosarcina acetivorans C2A
MCKVEAIIKPLKLHQVKDALEESGFPSLTVTDVKGRGQQKGIVQQWRGKKYCVDLLPKTKVEVVVPEEEVEKIIQVIQSTAYTGEIGDGKIFVIPIETVVRIRTGERNGDAL

SEQ ID NO: 14065 - protein, 280 aa, Methanosarcina acetivorans C2A
MTDKVQPLESLSKKPEEPKIVVNLRRIKRKIMVMSGKGGVGKSTIAANLAVGLALRGYRVGLLDCDIHGPTIPTIFGLESARPEVSEEGILPIQVLPNLSIMSIGFLLENKDSPIIWRGPAKMGAIKQFLEEVYWGALDFLIIDLPPGTGDEPLSVAQLIPNCDGSVLVTTPQDVALISVRKSITFSEKLNVPVIGLVDNMHGLICPHCDKPIDVFGSGGVEKASEDFNIPILARLPIEPKVAEMEDKGTIIQDQLKHGTEWQKSFEKVVDAVQETLKEE

SEQ ID NO: 14066 - protein, 347 aa, Methanosarcina acetivorans C2A
MAEERHHTEHIPQWKKDEIENIKELIQSHKVFGMVGIEGILATKMQKIRRDLKDVAVLKVSRNTLTERALNQLGETIPGMKEYLDKQTALIFTNESPFKLYKLLEQTKTPSPIRGGAIAPADITVQKGPTSFPPGPILGELQSAGIPASIDAGKVAVKETKVVCKAGEVVPQKLATMLSKLEIYPLIVGLDLRAAYDDGTIYEPELLAVDESKYFSDIIRAAQNAFNLSVNTAFPTSATISTLLAKASSEAKNLGVNAVILEPGVMDTLLAKAHVQMTSVASEAADKDANAVDDDLREVLGAAASAAAAAAAAAPAEEEVKKEEEPEEEEEDHAEEDGMAGLGALFG

SEQ ID NO: 14067 - protein, 315 aa, Methanosarcina acetivorans C2A
MKKNSQNSVGSDGKSMSESSGNQDAQTGKEVAATKKWLSVKEAEALGYYDFMSYLGVPYYHTGGLVSTGKLAELCRIDSNKKVLMVGCGTGFSACYLARKIGCEVVGIDIAEVSIEEAKERARRQRVSDKAKFRVGDAYALPFEAGTFDAVVTESVSQFLDRKKAFKEFSRVLKPGGYIGINEMYKEEKIPPKTAEEIAHAEEVFREITGLPFSLPTPEEWKKGLEEVGLKEINVRKFRPSPSLGEIKTFIEGMEGIWNFTFHFAELMLKIGKYSLFSRKIRYRFKRLGEGKKILLRKKSTSKYAGYVLATGIKE

SEQ ID NO: 14068 - protein, 1028 aa, Methanosarcina acetivorans C2A
MNVSRKILVIIYIIFALLTSVVIFASQNILDSSFSGLEEKEAIENVESVHNVIDFQIIQLDETSSALVSREDVRAFMVSENPKDLGGTLLTDLFTLSGCDFVFFVNSSGTMIYSQVSDSKNASDASSDLIITEIDQKINEGDLLCRERLSPLSGILLLENGPVIVSCRPVSAALDNSKMIGTIVLGKKLDSDFVDSIQKITGNPVLLYGPDNAPPEFEHVFSENGSENFTQLVDVEGDRLAGYFIHRDINGNPTIMVRTTADRNIYEEGRKSLRYIVLFLLFSGLMVGAGCKFLLDREVVSRLVAIDSFVDRVGKDEDFSAHCIMEGDDELSRLTEGINRMLDRLRLNSDKVKAQEHEKKVILNSLSELVIFMDLELKIVWANRASLDYAGLKLENIVGHSYEKLSPISDAVSGRALAQKALESGNEETGEVVTPDGKIWTIRMNLIKDEDGKVTGFLQTGLDITAHRRSEEKLLQAKLEAEAASCTKSEFLANMSHELRTPLNSIIGFSDILIERVFGELNEKQLKYVNNISGSGKHLLGLINDILDLSKVEAGKMDLHYSEFTVDSVFEEVKSTLFPLAQAKSLEINFVVGPDFGDIQADRSRLIQILYNLVSNAIKFTPEGGRVSVYCKKSGSRALFSVTDTGIGISSEDQKKLFQPFTQIDSSSARQYCGTGLGLALVKKIVNLHKGDIWVESELEKGSTFMFTIPLTKPPESPKADTKGIEDVMLEFEMSKAAAFSAKECEEALKEELELPEILLPENREAQSLVLVVDDDINSNELISVVLREAGYSTASLHNGKDVLEVAKKLKPDVITLDVLLPDTSGWNVLKQLKSDLDTTSIPVLIISVTDNNELGVALGATYSFTKPVRRVELLDSLREITGKFSFDEPKVLIIDDDENAVELLSSMIESEGFEIVKAYSGQAGLDKLFSEQQPDILILDLLMPEISGFEIISRLRDGEQTKDIPLIVCTAGEFTEKNIEKLNGELKGHLISIMKKGTFGRKELINRIKQLAMLKRREDERNSYCRR

SEQ ID NO: 14069 - protein, 202 aa, Methanopyrus kandleri AV19
MIALATGPRYRVPFRRRREGKTNYYKRRELIKADAPRLVARKTLNHNIAQIVDFAPHGDVTLASAHSIELRNKFGWKGHCGNTPAAYLTGYLCGLRALERGIERAVIDIGLHRPVRGSRVFAMLKGALDAGMDIPHGEEVLPPEDRIRGEHIANLARQIKEEDPEEYERRFSKYLERGLKPEELPEHFEEVKSKIEEEFGGA

SEQ ID NO: 14070 - protein, 117 aa, Methanopyrus kandleri AV19
MYMIEAVIRPEKLDDVKEALDEAGYPGMTVIHVKGRGRQRGIVHRYRDEEYRTDLLDKILLKVAVPTEDDVEKVIDVICEHAKTGRPGDGMIFVIPLEDAVRARTGERGDDALSTEE

SEQ ID NO: 14071 - protein, 290 aa, Methanopyrus kandleri AV19
MSPLAEGNEPREGHPHHPSREELEKRLEKEREAIEKNLESVEHVLVVMSGKGGVGKTTVSVNLALALAEDDEVGILDLDIHGPNVPEQLGVTEPPQGTPAGLFPLSGYRDVKVMSIGTMLEREDLPVLWRGPRKSGFIREILVKTRWGDLDYLIIDMPPGTGDEVMTALQMLPEDARNVLLVASPESLAFSDVVKAGEAVDKLEARLIGIVSNMHGIVCPECGSTIEYFSDDYSEKLAERFDTEVLARIPLDPEAKRKAEEEGKPFVIAAPDSRVSEAFSELAEAVRDRL

SEQ ID NO: 14072 - protein, 770 aa, Methanopyrus kandleri AV19
MKYVRWFEEISKDDVDVAGGKGANLGEMTQAGLPVPPGFVVLSTAYDEFLERTGLKEKIKEILSSHDLSDNDELQEAAEEIQRLIVEVEMPEEIREEIVKAYRELCEKVGKEEEFVAVRSSATAEDLPEASFAGQQETFLNVQGEEDVVKYVQKCWASLFTPRAVAYREEQGFEHLDVSIAVVVQKMVDSEKSGVMFTVHPYTGERDKMVIEAVWGLGEAVVSGEVTPDTYIVDKNTFEVIEEQISEQEWMYTKDPETGETVKAEVPEDKRDARKLTDEEIKELAEIGVAVEEHYGFPQDIEWAIEDDEVYVLQSRPVTTIPEEKGGEEEIEAEELEGKILVRGLGASPGIGTGEVKIVMDVDEIDKVEEGDVLVTKMTTPDMVPAMRKASAIVTDEGGITCHAAIVSRELGIPCVVGTGNATEVLEEGQVVTVDGERGVVYEGDVRKALRAEEEEEEREEKEIVVERPAAEPVTATEIKVNVSMPEAAERAAKTGADGVGLLRIEHMILGVGVHPRKLIEEGEREKLVQVLMDGIRKVADAFYPKPVWVRTLDAPTDEFRELEGGEREPEETNPMLGWRGIRRDLEERETLECQFEAIRRLHQEGYDNIGVMIPLVQHPEELRRAKRIAKEVGLKPHRQVEFGMMVETPAAAVLIDEFIEVGLDFVSLGTNDLTQYTLAVDRNNDKVAYLYDEKHPAVLRLIKHVINECKEAGVKTSICGQAGSDPKMAEILVKAGIDSISANIDAVPQIRRIVARVERKILLDKMREF

SEQ ID NO: 14073 - protein, 424 aa, Methanopyrus kandleri AV19
MVVVKEGEYAIRDPSLAPKGRDMIEWARDHMPVLGAIRERFEEERPLEGITVGMTLHLEAKTAVLVETLMAGGAEVAITGCNPLSTKDEVAAALVEEGVHVYAWRGETEEEYYQNIDRVLSHEPDIIVDDGADCIARVHTEFPDLAERVIGATEETTTGVNRLHAMHREGVLKFPVIAVNDAKTKYLMDNRYGTGQSALDGLMRATNILLAGKTVVVVGYGWCGRGIARRARGLGANVIVVEVDPIKAMEAIFDGFRVMPMDRAAEEGDIFITATGNRDVIRGEHIEKMKDGVILANAGHFDVEIDKEYLEEHCEEKIDRRGGLVTEYRMPDGKRVYLIAEGRLVNLAAGEGHPIEIMDISFALQALSVEVLAKEGKEMEPGVYKVPKDVDKRVAELKLESMGIELEELTPEQREYMKSWEEGT

SEQ ID NO: 14074 - protein, 245 aa, Methanopyrus kandleri AV19
MRPLSELDPEELIRYISESPKRTIAKFYVKTDDPEGLAERLEERLEDAKVFTGVDHVIVIGEHDDVVEVLESEDSVEYYHKELDHRNRAVPLADYSEFEDVRIEPGAIIREKVKLGKGVVVMMGAVINIGAKIGDGTMVDMNAVVGSRAEVGKNVHIGAGAVIAGVLEPPSAKPVVIEDDVVIGANAVILEGVRVGKGAVVAAGAVVTEDVPPSKVVAGVPARVVKDVDKKTEAKTQIVDALRCL

SEQ ID NO: 14075 - protein, 405 aa, Methanopyrus kandleri AV19
MVESSTTSWRRPVRGHRCTSTTRMLPVKAAREYQEAFSWFPDRVYVCYAMKANFNPYLVEHIVDETRAADVVSLWEMKVAVNAGAETVVVNGNAKSSDEIRAAVERSWVINVDSFEEFQRIEKIARHEGERALVALRVNPKVSPDTHSHIATAVEGSKFGVELEIAERVCRRMIESEWVEFLGLHYHIGSQITDLRPFSEALRSVRTFLEDTGLIEEISYLNIGGGLGIRYRRGEEVPSPHDLAEELQEDLKELHSESSGFDLYLEPGRSIVGEAGILVTSVRQVKRGRRRWVFVDTGMNALIRPALYDAYHEVVVHGGDYSATEKASVAGPLCESGDVLAEDRELPIDISEGDLVVFLSAGAYCESMASNYNCYPIPGSVVVRNGEITGVRRVQDYEAFSKTWW

SEQ ID NO: 14076 - protein, 376 aa, Methanopyrus kandleri AV19
MVNVVVCVTGSVAAYRAPDVCRELVRRGHRVRVVASEEALRFVGKDALGFAAEEVIFRLTSRAEHVELAEWADVVAVVPATLNTLAKIARGVADAPVPLTAVTSLGAGKRLVVAPAMSLHMYRSPPAREILRQLEDMGVTVVGPVIEEGKAKLASIEEIVEAVEGELSGFRVLVTGGPTMEPLDDVRVITNRSSGRTACEICRELRARGAEVVFVHGPLRVDPPPMDERVEVETTREMLEEVVKRIDDVDAIVMAAAPSDFRPAERADGKLDSRREHEIRLIPTEKIVREVFPDFDGVRVAFKLDPEPVEGARRLLDEVPCELVVANPPETAGAEGSEWWILDGDGEVIERVKGDKRELARKLVDALSKLLRGDRG

SEQ ID NO: 14077 - protein, 297 aa, Methanopyrus kandleri AV19
MLDVVGLGALNVDELLYIPRMPERDDSVPVERRVRRGGGSAANTICWLAHLGREVGFVGKVGSDDAGDLLLREFEEYGVDTSRVVRGDGHSGTAFCLVSGDDRRILVDPGVNDELRPDEVDLDYIRKARVLHTSSFIGLRSETSLETLKRTMKAVADELMVTFSPATMVLRGWSYLEPYFEAADVVFLNETEAVHLTGDIEETLNRLAELVEVTIVTRGSDPAIVQEGTEISEVAPEPVPEEDIVDPTGAGDAFAAGFIEGILRGEPADRCCERGHAVAAECLRIEGCRPPTEGRSE

SEQ ID NO: 14078 - protein, 362 aa, Methanopyrus kandleri AV19
MGDCAMAVKAKGQPPSGYEPKVAEWKRREVKELKELMDEYENVGLVDLEGIPAPQLQEIRAKLRERDTIIRMSRNTLMRIALEEKLDERPELEPLLDYIEGPVAFIFTNLDPFKLYKLLEESKASAPAKPGDIAPEDIVVPEGPTPFEPGPIVSELQQAGLPAQIQDGKVVITKDTVLVKEGEEIDEKTAEILKKLEIEPMEVGVDIVAIVAEGTLFERDDLAIDFDEYEDMAKEAAQHAFNLSINAAIPTAETADVIVAKAHTEALNLAVNAGVPVPDETVMGCILAKAHGEMLALAGAIAEVDEEALDEELLEMVSRSAEAAERKEKEEEEEEEAEEEEAEEEEEEEEEEAAAGLGALFG

SEQ ID NO: 14079 - protein, 471 aa, Methanopyrus kandleri AV19
MEYGCLIGGEWLEGDREIVVENPYDGSEVGRVLAPEVDVEALLKDAREGQRRWRERPTYEVREALAEAAHLLKKHEDELAELIALEGGKPIRDARYEVYRTREVLRLSAAEAERLYGETLPGDAQRGRTAELILTVREPVGVVLSITPYNFPLLLPTHKLGPALAARCSVVHKPATVTPLSSLRLAEILLDAGVEPLALQVVVGPGAELGEELARADFDALSFTGSRSVGEHLREISPIPRITLELGGNDPVIVDETADVEAAAEAAVRGACYHAGQVCIAVERAIVVEDVYEEFLEAAVEVAESLKVGDPLDEDTDVGPLIDDGAVEKVRRHVEDAVERGAEILTGGEPEGRLFPPTVLADVPEDALVAREETFGPVLPVIRAKDFEEAIRIANSTDYGLHAAVFTERLDRAVKATRKLEAGGVIVNESTIYRADYMPFGGVKASGVGREGVPQAVREFTEEKTVVIGRR

SEQ ID NO: 14080 - protein, 372 aa, Methanopyrus kandleri AV19
MILQRDSDYSDGTVLGSMCTEPHPVAAEAFVAGLHVNLGDPYLFPNAYRAERECIGWLAETLLDHPAPEEAEGSIVSGGTEANILAAYAAREVTGGREIIVPATRHFSFEKAARMLRMKLVEAPLRSDYTVDVDAVQDLISRDTALIVGIVGTTETGSVDDIEALSDVAEDHGVPLHVDAAFGGFTAPFLREEYPLPRFGFDLEAVVSVTVDPHKMGLVPPPAGGIVFRDDEFPKAIEVYAPYLSGGGASQYTITGTRPGAPVLALYANILELGEEGYRRIAFRCYEETLKVAEKARELGLELAVDPPHLNLVNIRLPDRGTAERLLRESEREGWKISVSTKPLGVRIVMMPHLDAETVSRFLELVARVLGG

SEQ ID NO: 14081 - protein, 502 aa, Methanopyrus kandleri AV19
MVGRYTRKLEDAELALTFDDVLLLPERSSVEPADVDVSTRVTVNYRINIPILSAAMDTVTEAEMAIAMARHGGLGVIHRNMTVEEQVKEVRRVKEARDVVQRDVVTISPDESVKRAVELMEKHDVGGLPVVDEEGKVVGIITRRDVGLLSEEEIGELDVKSVMTEEPVVIEEGEDLEERALRVMREEKIERVPVVDDEGRLLGIVTAKDVTELREETEAATDEERRYLAAAAVGPKDPDRAIALDEAGADILVVDCAHAHTETVINFVKEIKREVDADIIAGNIATAEAAEDLIAAGADALKVGIGPGSICTTRIVAGVGVPQITAVAWVADVAEEHDIPVIADGGIRYSGDIAKAIAAGADAVMLGNLLAGTDEAPGRVIRLRGRLYKQYRGMGSLGAMMKGESADRYFKQPEQGGRHVAQTKFVPEGVEGVVPYKGPVSEVLYTLVGGLRSSMGYVGAKNIEEMKKKARFVRITRAGYEESHPHDIAITDEAPNYPISNQ

SEQ ID NO: 14082 - protein, 427 aa, Methanopyrus kandleri AV19 [sequence omitted]

SEQ ID NO: 14083 - protein, 226 aa, Brassica napus
MASNQQSYKAGETKRKTQEKTGQAMGAMRDKAEEGKDKTSQTAQKAQQKAQETAQAAKDKTSQAAQTTQQKAQETAQAAKDKTSQAAQTTQQKAHETTQSSKEKTSQAAQTAQEKARETKDKTGSYLSETGEAVKQKAQDAAQYTKETAQNAAQYTKETAEAGKDKTGGFLSQTGEHVKQMAMGAADAVKHTFGMATEEEDREHYPGTTTCTTQSTDPTRHTYERK

SEQ ID NO: 14084 - protein, 226 aa, Brassica rapa
MASNQQSYKAGETKSKTQEKTGQTMGAMRDKAEEGKNKTSQTAQTALQKAHETTQAAKDKTSQAAQTTQQKSQETAQAAKDKTSQAAQTTQQKAHETTQSAKEKTSQTAQTAQEKARETKDKTGSLLSETGEAVKQKAQDAAQYTKETAQNAAQYTKENAEAGRDKTGGFLSQTGEHVKQMAMGAADAVKHTFGMATEEEDREHYPGTTTGTTRSTDQTRHTYERK

SEQ ID NO: 14085 - protein, 316 aa, Homo sapiens
MATFVELSTKAKMPIVGLGTWKSPLGKVKEAVKVAIDAGYRHIDCAYVYQNEHEVGEAIQEKIQEKAVKREDLFIVSKLWPTFFERPLVRKAFEKTLKDLKLSYLDVYLIHWPQGFKSGDDLFPKDDKGNAIGGKATFLDAWEAMEELVDEGLVKALGVSNFSHFQIEKLLNKPGLKYKPVTNQVECHPYLTQEKLIQYCHSKGITVTAYSPLGSPDRPWAKPEDPSLLEDPKIKEIAAKHKKTAAQVLIRFHIQRNVIVIPKSVTPARIVENIQVFDFKLSDEEMATILSFNRNWRACNVLQSSHLEDYPFDAEY

SEQ ID NO: 14086 - protein, 364 aa, Homo sapiens
MSGPRAGFYRQELNKTVWEVPQRLQGLRPVGSGAYGSVCSAYDARLRQKVAVKKLSRPFQSLIHARRTYRELRLLKHLKHENVIGLLDVFTPATSIEDFSEVYLVTTLMGADLNNIVKCQALSDEHVQFLVYQLLRGLKYIHSAGIIHRDLKPSNVAVNEDCELRILDFGLARQADEEMTGYVATRWYRAPEIMLNWMHYNQTVDIWSVGCIMAELLQGKALFPGSDYIDQLKRIMEVVGTPSPEVLAKISSEHARTYIQSLPPMPQKDLSSIFRGANPLAIDLLGRMLVLDSDQRVSAAEALAHAYFSQYHDPEDEPEAEPYDESVEAKERTLEEWKELTYQEVLSFKPPEPPKPPGSLEIEQ

SEQ ID NO: 14087 - protein, 1398 aa, Drosophila melanogaster
MSTCEAAAAGENGSQAKSEESQPPEDQKKKQPQHERNEKQLDKPPENLPQNGKTEAKGAEGACSHPPLDALRSSVLLDAGAASPSIDAIVACKDALLAQKLFASGGGSTPGPSPTSSAVGAGGISGKDLLKLKEPMRVGFYDIERTIGKGNFAVVKLARHRITKNEVAIKIIDKSQLDQTNLQKVYREVEIMKRLKHPHIIKLYQVMETKNMIYIVSEYASQGEIFDYIAKYGRMSESAARFKFWQIISAVEYCHKKGIVHRDLKAENLLLDLNMNIKIADFGFSNHFKPGELLATWCGSPPYAAPEVFEGKQYTGPEIDIWSLGVVLYVLVCGALPFDGSTLQSLRDRVLSGRFRIPFFMSSECEHLIRRMLVLEPTRRYTIDQIKRHRWMCPELLEHVLIAKYNLGAERQTSVEPSEDILRIMAEYVGIGSDKTRASLKKNTYDHVAAIYLLLQDRVSHKKEQSNGLGASALASSTSASRMIYSSRNDHQPTQQQSQQQSKTISTSSILAKDQCHKRLSRHQTVLMSERNAHAGATPTVPDPGPGYYAKYGPLQLPLPLTGHSHLTGYLNGGGVEVDASGIPLPMRYTPLPTAASPAPSNCSSTSSRVGRHSLSSSSPRSHRPVAISLSIDNNPSLANLRCREMMEAGGGPVGAVGVPLASKQLHQTISEFIIKQSTEDCRALLQQSTAVAEGKDDPPKAESSVGGVPPPASTTPTSSTAGPESGSAPCPGEINGKTIKTMSSSSSFDSKANLGQSFRYKMSAEASKLFQTLQESPLPVEQRTKRRVHVGSTNGSGGDSGQETNDAKSNGDSRSEKKVLAQGSSSTDEGCETDQGNDPGSASQESKGSNGGGSGNANGGPTSHSSSDLTRLVGTTTSGQSHKMRSYASSSSSSGVLAGSAGSYSKSLSQNLSRGSSKSNCSGPYDSLDFALPSGKGSLPSCMGSSSMLATPTPASASPAGISSEHSSERSLYGSHNSCIHMPGALPLGLGLPQSSASTPTPNPTPPPNGGGVTFLDKRSPIHFREGRRASDGLVAQGLLSSGSLLGTSRVYGSYRYEQAKRHGWLEIQQLQQLQQEAAVGHSHPHAHQHPHQHPHPHPQAYGLEELCQFPNGQFYALPGKHHPLLTLPHHHAHPAQHHHGHHSLFHSGHQATPLLLEAAAGGDMYGHGCYAPPPPPPGLYTHHQLGVGMAVPMSPMQKPPLQQQLLQHRLLQQKRQLFQKQYALEAQLAGRHHHHQQHSHHHHHHFGHSLGPPPPPAPAPEHHLADELYELALLDRPRSGTPRLQHSMTMPGAHAFSQMNLKTSYISQSDQVPGAAPNGAGSGGSAAGVSCSAPPSTAPGTPTVKCKPTTPHGHSLDSDYHTSTPVLSLFTPNWQSLVKPLSESPILEISEHLESV

SEQ ID NO: 14088 - protein, 343 aa, Drosophila melanogaster
MSSTAGKRKEIYKYLAPWPLYSMNWSVRPDKRFRLALGSFIEEYNNKVQIISLDEDTSEFSAKSTFDHPYPTTKIMWIPDSKGVYPDLLATSGDYLRVWRAGEPDTRLECVLNNNKNSDFCAPLTSFDWNEVDPNLVGTSSIDTTCTIWGLETGQPHARVYVAGHVKTQLIAHDKEVYDIAFSRAGGGRDMFASVGADGSVRMFDLRHLEHSTIIYEDPAHTALLRLAWNKQDPNYLATVAMDSCEVIILDVRVPCTPVARLSNHRACVNGIAWAPHSSCHICTAGDDHQALIWDIQQMPRAIEDPILAYTAAEGEVNQIQWGATQPDWIAICYNKACEILRV

SEQ ID NO: 14089 - protein, 305 aa, Drosophila melanogaster
MCTFGCRTCKSQPDCEGCSPKCCSPCISYCIFDLESAVFDTRHVYRKALKELVRCYDKRIPDILHVQSGPMTISEMSELFCRKLDIPMSWESFRYELNERTSHLIANPPFMDGIERLVPHLRNSCMELGLITSSNEANYCSKIRGREDFFENFSTVVCADDPELRAPKPEPDVYLIAMSRLGDAGPDCTLVFDGTPKGVQAASDARLPVIMLAEKDLPCCWSELAALRFEYLDDFEPEMYNLPPFTDPAPKRRSSRRRTRYSQRLTVIRARAAEAAAAEEAEAEEEEPAEPPPPAALPSILNLRE

SEQ ID NO: 14090 - protein, 240 aa, Drosophila melanogaster
MPTKKCYCPVTHVIFDCDGTLIDSEGIYLKTVQDLLAKYGKTYTKVDQTQHMGMPVGTFSQHIVKDLKLPLSPAEFQKEFEAAVDKSMGSVALLPGVRDLILHLHEYRIPFCIATSSFRKLFKVKAESFKDIFLAFHHVVCGDDPALGPGRGKPYPDIYLLAASRFNPPADPKKCLIFEDAPVGLIGGKAAGSQVIFIPTDNVSKQQKKGATMVLKSMADFKPELFGLPPFDTCSKFEFG

SEQ ID NO: 14091 - protein, 181 aa, Drosophila melanogaster
MDEGKKKAAEAAAAAKEAAASAAQAAKTKAAGAAGSAKEAAGAAASAAKDKAGAAAASAKEKAAGAAVAVQQSASSAAIAAREKAANAAEFTKEKATAAAAAATEAATSAASTVREKAAAAAVAVRAKASATAIAVRDSVTAVAVAAQGAAAAAKDKVATAAASAAAAAKSKVTRQSQDEV

SEQ ID NO: 14092 - protein, 112 aa, Drosophila melanogaster
MVELSSVISKFYNDYVQNTPKKLKLVDIYLGYILLTGIIQFVYCCLVGTFPFNSFLSGFISTVSCFVLAVCLRLQANPQNKSVFAGISPERGFADFIFAHVILHLVVMNFIG

SEQ ID NO: 14093 - protein, 331 aa, Drosophila melanogaster
MGLTRVLVKDGGFGTQMTVHVGDSVDGDPLWSARFNATNPAAIISTHLDFLQNGADIILTNTYQSSVDGYMEYLELDEEQSIELIKNTVRLAHIAKERYLTECYQAQLSVQEGYPLIIASIGPFGAHLHDGSEYTGSYADFVPAKEITDWHRVRIEACLEAGVDALAIETIPCQMEAEALVEMLCDDYPDVKFWVAFQCKDENTLAHGETFADAANAIWDLLAERNAQDKCLAIGVNCVHPKFVTPLFKSLNGDREVGEQIPLVVYPNSGEVYDVVNGWQGREHCVPLANYVPEWAQLGAKVIGGCCRTYARDIRHIGEAIRDWNKLKKLS

SEQ ID NO: 14094 - protein, 465 aa, Drosophila melanogaster
MSKGSVLPQYIAGLSASFGALCMGASIGWSSPVENMITVNTEYGFPISSSQFGWVSSLLTLGATVICIPIGFAIDWIGRRPTMLALIPPYMVGWVLMLFAKNVTMLYFGRFILGMCGGAFCVTAPMYCTEITATALRGTIGSFFQLLIVSGVLYGYLVGAFLPLLTINILCAILPVIFAIIHFFMPESPVYLAMKGRNDDAAKALQWLRGKDADIDDELKEILEESQKQIDMPQVNILSSLRRPIVLKGLGIAVLLQVFQQWTGINAVLFYSASIFEDTGSDISGSDATLIIGVTQVTSTLVAVAIIDKAGRRILLLISGVLMAVSTALMGVYFQLKENDPASMDNFGWLPISSICIFIIFFSIGFGPVPWLVMAELFSEDVKSVAGSIAGTSNWLSAFVVTLLFPILKSSIGPGPTFWIFTAIAVIAFFYSLFFVPETKGKTIIEIQDLLSGGKGVKSDDKSQT

SEQ ID NO: 14095 - protein, 432 aa, Drosophila melanogaster
MDSESLACSSVEKDLTRVVSKLEQLHENAEADIGDIATQMSELVEVLSRAEQLVTTLNSSTQVSQDDPMGDAVSMQVETEPTAPQRLTERQVESVRNALARCHERVQKLSTEHRDLHGSISKIGKAIDRNFSADFSSTMRVDVLQDEENLMLLNKAIAKHYCRQGMDDVARTLIRECKMSPEHAQDVFDSEREFADIYGIWVKIQKRDLTDALKWAKMYSQQLSDRHSLIEFRLHRMRFMQLVSYGLDSQREAISYARLNFKKFAVRYEHEIANLMASFIYLPSGLENSPYKHFLGQEKWTELSFIFLKDACQLLGISKNSALSVVVNAGCTALPALLNIKQVMQSRQVLGMWNGCDELPIEIDLQPEFRFHSIFACPILRQQTSEDNPPKKLTCGHVISNDALHKLSVGHILKCPYCPVEQNAEEAVRIYF

SEQ ID NO: 14096 - protein, 171 aa, Drosophila melanogaster
MPVIKLQSSDGEIFETDIETAKCSSTIKTLLEDCPVEAENDTLIPLPNVNSTILKKVLIWAKHHREDIAEENEEEAAKSVAVQITPWDAEFLSMDQGTLFELILAANYLDIPNLLNAACMTVANMIKGRTTEEIRQTFHITNDFSPSEEDLMTMESEVPQEDEAIEYGEII

SEQ ID NO: 14097 - protein, 254 aa, Malus x domestica
MAAHPLSLASIALSLVLFNLHLHGVLAVYGSWEGVHATFYGGGDASATMGGACGYGNLYSQGYGTNTAALSTALFNNGLSCGSCYEMMCNNDPRWCRPGSIIVTATNFCPPNFAESNDNGGWCNPPLQHFDLAEPAFLQIAQYRAGIVPVSFRRVPCMKKGGIRFTINGHSYFNLVLITNVAGAGDVHSVSIKGSRTGWQPMSRNWGQNWQSNSYLNGQALSFQVTTSDGRTVTSYNVAPGNWQFGQTFSGGQF

SEQ ID NO: 14098 - protein, 255 aa, Musa acuminata
MAKSISSLSIALFFLTSSFSFFISGAVGDSYGWQNAHATFYGGGDASGTMGGACGYGNLYSQGYGTNTAALSTALFNNGLSCGACYEVRCADDPRWCLPGSIVVTATNFCPPNYALPSDNGGWCNPPRQHFDLAEPAFLQIAQYRAGIVPVSFRRVACVKKGGVRFTINGHSYFILVLITNVGAAGDVHAVSIKGSKTGWQRMSRNWGQNWQSNSYLDGQSLSFQVTTSDGRTITSYNVAPAGWQFGQTFQGQQF

SEQ ID NO: 14099 - protein, 605 aa, Malus x domestica
MESCDCIDAQWPPDELLVKYQYISDVFIALAYFSIPLELIYFVQKSAFFPYRWVLVQFGAFIVLCGATHFINVWTFSMHTKTVAIFMTVAKVSCAVVSCATALMLVHIIPDLLSVKKRELSLKSRAEELDKEMGLMLTQEETGRHVRMLTHEIRSTLDRHTILKTTLVELGRTLGLQECALWMPSRTGMNLQLSHTLNYHIQAGSSVSMDLPVVNEVFNSSRAIRIPYTCPLARIRPLVGRYVPPEVVALRVPLLNLSNFQINDWPDVSAKSYAIMVLILPTDGTRKWREHELELVDVVPDQVAVALSHAAILEESMRARKQLTEQNDALDLAWREAEMAIHARDDFLAVMNHEMRTPMHAIIALSSLLLDTELTPEERLMIETALKSSNLLETLVNDELDLSRLEDDSLELDTERFNLHGVFREVMNLVQPVASVKKLSMTLIQSPDLPVYAVGDENRLLQTILNVAGNAVKFTKQGYISITASVAKSESSRDWQPSEFYPASTDGYFYLRVQVKDSGCGVLPEDIPHLFTKLSQPRNGSNQININNGAGLGLAICKRFVNTMGGHIWIESEGIDRGSIVAFIVQLGICDNHSDTTTHQVQIAT

SEQ ID NO: 14100 - protein, 424 aa, Atriplex prostrata
YLRAIAAKITERKDHFVKLETLDSGKPFDEALLDIDDVAGCFEYYADQAEALDAKQKAPIALPMDTFKSHVLRQPIGVVGLISPWNYPLLMATWKVAPALAAGCAAILKPSEMASVTCLELADVCKEVGLPPGVLNILSGYGPEAGGPLASHPDVDKVAFTGSTATGSKIMSSAAQLVKPVTLELGGKSPIILFEDVDLDQAAEWAAFGCFWTNGQICSATSRLLVHESIAAEYLDKLVKWCKNIKISDPFEDGCRLGPVVSKGQYEKVLKFISTAKSEGATILCGGSRPEHLKKGYFIEPTIISDVSTSMQIWKEEVFGPVLCVKTFSSDEEAIELANDTQYGLGAAVLSKNLERCEKVTKALEVGIVWVNCSQPCFCQAPWGGAKRSGFGRELGEWGIENYLNIKQVTSDISDEPWGWYKSP

SEQ ID NO: 14101 - protein, 500 aa, Atriplex prostrata
MAFPIPVRQLFIDGEWREPLLKNRIPIINPSTEEIIGDIPAATAEDVEVAVVAARKAFKRNKGRDWAATSGAHRAKYLRAIAAKITERKDHFVKLETLDSGKPFDEAVLDIDDVASCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDIDKIAFTGSSATGSKIMASAAQLVKPVTLELGGKSPVIMFEDIDIETAVEWTLFGVFWTNGQICSATSRLLLHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 14102 - protein, 543 aa, Trichoderma harzianum
MAIGNIYVIAGVSVVGGALFGFDISSVSAQLAEQSYLCYFNQDENPPTTADGKCGGPRSLVQGGITASMAAGSWLGALISGPLSDRLGRKYSIMVGCIIWVIGSTLSCASQNIGMLIVARIINGISVGIESAQVPVYIAEISPPSKRGRFIGMQQWAITWGILIMYYISYGCSFIGEDNPVSYNTAAWRIPWGLQMIPAFFLFFMMMPLPESPRWLARKDRWEDCRAVLTLVHGKGDPNHPFVAYELQDIKDMCEFERQHADVTYLDLFKPRMINRTFIGLFTQIWSQLTGMNVMMYYIANIFSMAGYSGNANLLASSIQYIINVLMTIPALLWVDKWGRRPTLLIGSVLMALWMYANAGILATYGEVVPGGIDHVAAQSMRVTGAPAKGLIACTYRFVASFAPTWGPVSWTYPPELFPLRLRGKGVAMATSGNWAFNTALGLFTPVAFANIKWKSYLIFAVFNTVAFFHVFFVFPETAGKTLEETEAMFEDPNGIPYMGTPAWKTKVATSLTVRAEQGDLEAKIAHDTEKPPIHTHEEETTQ

SEQ ID NO: 14103 - protein, 346 aa, Zea mays
SKIIGTVNGLAAGWGNMGGGATQLIMPLVYDVIRKCGATPFTAWRLAYFVPGLMHVVMGVLVLTLGQDLPDGNLRSLQKKGNVNKDSFSKVMWYAVINYRTWIFVLLYGYCMGVELTTDNVIAEYMYDRFDLDLRVAGTIAACFGMANIVARPMGGIMSDMGARYWGMRARLWNIWILQTAGGAFCLWLGRASTLPVSVVAMVLFSFCAQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHV

SEQ ID NO: 14104 - protein, 309 aa, Arabidopsis thaliana
METDSIDSVIDDDEIHQKHQFSSTKSQGGATVVISPATSVYELLECPVCTNSMYPPIHQCHNGHTLCSTCKSRVHNRCPTCRQELGDIRCLALEKVAESLELPCKYYNLGCLGIFPYYSKLKHESQCNFRPYSCPYAGSECAAVGDITFLVAHLRDDHKVDMHTGCTFNHRYVKSNPREVENATWMLTVFQCFGQYFCLHFEAFQLGMAPVYMAFLRFMGDEDDARNYTYSLEVGGSGRKQTWEGTPRSVRDSHRKVRDSHDGLIIQKNMALFFSGGDKKELKLRVTGRIWKEQQNPDSGVCITSMCSS

SEQ ID NO: 14105 - protein, 415 aa, Mus musculus
EKDEYLKPVLEDDLLLQFDVEDLYEPVSTPFSYPNGLSESASVVEKLKHMEARALSAEAALARAREDLQKMKQFAQDFVMNVDVRTCSSTTTIADLQEDEDGVYFSSYGHYGIHEEMLKDKVRTESYRDFIYQNPHIFKDKVVLDVGCGTGILSMFAAKVGAKKVIAVDQSEILYQAMDIIRLNKLEDTIVLIKGKIEEVSLPVEKVDVIISEWMGYFLLFESMLDSVLYAKSKYLAKGGSVYPDICTISLVAVSDVSKHADRIAFWDDVYGFNMSCMKKAVIPEAVVEVVDHKTLISDPCDIKHIDCHTTSISDLEFSSDFTLRTTKTAMCTAVAGYFDIYFEKNCHNRVVFSTGPQSTKTHWKQTVFLLEKPFPVKAGEALKGKITVHKNKKDPRSLIVTLTLNSSTQTYSLQ

SEQ ID NO: 14106 - protein, 375 aa, Homo sapiens
MSQPKKRKLESGGGGEGGEGTEEEDGAEREAALERPRRTKRERDQLYYECYSDVSVHEEMIADRVRTDAYRLGILRNWAALRGKTVLDVGAGTGILSIFCAQAGARRVYAVEASAIWQQAREVVRFNGLEDRVHVLPGPVETVELPEQVDAIVSEWMGYGLLHESMLSSVLHARTKWLKEGGLLLPASAELFIAPISDQMLEWRLGFWSQVKQHYGVDMSCLEGFATRCLMGHSEIVVQGLSGEDVLARPQRFAQLELSRAGLEQELEAGVGGRFRCSCYGSAPMHGFAIWFQVTFPGGESEKPLVLSTSPFHPATHWKQALLYLNEPVQVEQDTDVSGEITLLPSRDNPRRLRVLLRYKVGDQEEKTKDFAMED

SEQ ID NO: 14107 - protein, 729 aa, Cricetulus longicaudatus
MAAALAASGMLPTADLFLRRKLTRPHFCANIEELVGNMKVFCGRANPTTGSLEWLEEDEHYDYHQEIARSSYADMLHDKDRNIKYYQGIRAAVSRVKDRGQKALVLDIGTGTGLLSMMAVTAGADFCYAIEVFKPMADAAVKIVEKNGFSDKIKVINKHSTEVTVGPDGDLPCRANILVTELFDTELIGEGALPSYEHAHRHLVQENCEAVPHKATVYAQLVESRRMWSWNKLFPVHVQTSLGEQVIVPPSELERCPGAPSVYDIQLNQVPSTDFTALSDVLPMFSVDFSKQVSSSAACHSKQFVPLASGQAQVVLSWWDIEMDPEGKITCTMAPFWAQTNPQELQWRDHWMQCVYFLPQEEPVVQGSPRCLVAHHDDYCVWYSLQRTSADENEEVYQVRPVCDCQAHLLWNRPRFGEINDQDRTDQYAQALRTVLMPGTICLCVSDGSLLSLLAHHLGAEQVFTVESSAASYRLMKRIFKANHLEDKVSIIKKRPELLTSADLEGKKVSLLLGEPFFATSLLPWHNLYFWYARTSVDQHLEPGAVVMPQAASLYAMIVEFRDLWRIRSPCGDCEGFDVHIMDDMIKHSLDFRESREAEPHPLWEYPCRSLSEPQQILTFDFQQPVPQKPVHAEGSMELRRPGKSHGAVLWMEYHLTPDSTVSTGLMNPLEDKGDCCWNPHCKQAVYFLSTTVDPRVPLDGPQSVSYAVEFHPLTGDITMEFRLADTLN

SEQ ID NO: 14108 - protein, 117 aa, Pisum sativum
MAKTSSTTKDAQDLFHAIWSAYSATPTNLKIIDLYVVFAVFTALLQDVYMALVGPFPFNSFLSGVLSCVGTAVLAVCLRIQVNKENKEFKDLGPERAFADFVLCNLVLHLVIMNFLG

SEQ ID NO: 14109 - protein, 275 aa, Salmonella typhi
  unsure (1)..(275): unsure at all Xaa locations
MANPTIIRLQDGNVMPQLGLGVWKASNEEVIAAIHKALEVGYRSIDTATAYQNEEGVGKALKAASVAREELFITTKLWNDDQKRPREALQESLKKLQLDYLDLYLMHWPVPAIDHYVDAWKGMIALQKEGLVKSIGVCNFQIHHLQRLIDETGVPPVINQIELHPLMQQRQLHAXNATHKIQTESWSPLAQGGEGVFDQKVIRELADKYGKTPAQIVIRWHLDCGLVVIPKSVTPSRIAENFAVWDFRLDKDELGEIAKLDQGKRLGPDPDQSGG

SEQ ID NO: 14110 - protein, 275 aa, Escherichia coli O157:H7
MANPTVIKLQDGNVMPQLGLGVWQASNEEVITAIQKALEVGYRSFDTAAAYKNEEGVGKALKNASVNREELFITTKLWNDDHNRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 14111 - protein, 115 aa, Betula pendula
MARSTSKDAQALIQSLRSAYAATPSNLKIIDLYVVFAVFTALIQVVYMAIVGSFPFNAFLSGLLSCIGTAVLAVCLRIQVNKENKEFKDLAPERAFADFVLCNLVLHLVIMNFLG

SEQ ID NO: 14112 - protein, 116 aa, Lycopersicon esculentum
MAKSSATKDAQALFHSLRSAYAATPTNLKIIDLYVIFAISTALIQVVYMAIVGSFPFNSFLSGVLSCIGTAVLAVCLRIQVNKENKEFKDLPPERAFADFVLCNLVLHLVIMNFLG

SEQ ID NO: 14113 - protein, 114 aa, Hordeum vulgare
MPKAAGDAKLLIQSLNKAYAATPTNLKIIDLYVVFAVATALVQVVYMGIVGSFPFNSFLSGVLSSIGTAVLGVCLRIQVNKDNKEFKDLPPERAFADFVLCNLVLHLVIMNFLG

SEQ ID NO: 14114 - protein, 114 aa, Hordeum vulgare
MPKAAGDAKLLIQSLNKAYAATPTNLKIIDLYVVFAVVTALLQVVYMGIVGSFPFNSFLSGVLSCIGTAVLAVCHRIQVNKDNKEFKDLAPERAFADFVLCSLVLHLVIMNFLG

SEQ ID NO: 14115 - protein, 115 aa, Citrus unshiu
MARSTGKDAQALFHSLRSAYAATPTTLKIIDLYVGFAVFTALIQVVYMAIVGSFPFNSFLSGVLSCVGTAVLAVCLRIQVNKDNKEFKDLPPERAFADFVLCNLVLHLVIMNFLG

SEQ ID NO: 14116 - protein, 555 aa, Chlamydomonas reinhardtii
MMRRQHAAPLVGAVNVLMVVLAFVASANAQCVPGGIFNCPPSPAPPSPAPPSPAPPSPAPPSPAPPSPGPPSPAPPSPPSPAPPSPAPPSPAPPSPAPPSPAPPSPAPPSPAPPSPAPPSPPSPAPPSPSPPAPPSPSPPSPAPPLPPSPAPPSPSPPVPPSPSPPVPPSPAPPSPTPPSPSPPVPPSPAPPSPAPPVPPSPAPPSPAPPVPPSPAPPSPPSPAPPSPPSPAPPSPSPPAPPSPVPPSPAPPSPAPPSPKPPAPPPPPSPPPPPPPRPPFPANTPMPPSPPSPPPSPAPPTPPTPPSPSPPSPVPPSPAPVPPSPAPPSPAPSPPPSPAPPTPSPSPSPSPSPSPSPSPSPSPSPSPSPIPSPSPKPSPSPVAVKLVWADDAIAFDDLNGTSTRPGSASRMVGEPDIAGTKCKGNLKGWMPKPSRNPRWGQAVFSGGRTVGSVANVTIRVAFATEKPALIYSSIELVVYNTGATLIRVPIAANVTRSQIRCPGFLTYGTTPIAGYPTGIDATTWPNWKIAGVRINMGAGNKKPKTSIDAVGLNLK

SEQ ID NO: 14117 - protein, 273 aa, Arabidopsis thaliana
MTILVVDRYYMLMNLLFALTCLLLNLTHCFSPKKFNISAATTSDSDWSIAGSTWYGNPTGYGSDGGACGYGNAVAQPPFSKMVSAGGPSLFKSGKGCGACYQVKCTSKSACSKNPVTVVITDECPGCVKESVHFDLSGTAFGAMAISGQDSQLRNVGELQILYKKVECNYIGKTVTFQVDKGSNANSFAVLVAYVNGDGEIGRIELKQALDSDKWLSMSQSWGAVWKLDVSSPLRAPLSLRVTSLESGKTVVASNVIPANWQPGAIYKSNVNF

SEQ ID NO: 14118 - protein, 146 aa, Pisum sativum
MGFTDKQEALVNSSWELFKQNPGYSVLFYNIILKKAPATKGMFSFLKDSAGVVDSPKLQAHAEKVFGMVHDSAVQLRVSGEVVLGDATLGAIHIQKGVVDSHFVVVKEALLETIKEASGEKWSEELSTAWEVAYEGLASAIKKAMS

SEQ ID NO: 14119 - protein, 146 aa, Pisum sativum
MGFTEKQEALVNSSWELFKQNPSYSVLFYTIILKKAPAAKGMFSFLKDSAEVVDSPKLQAHAEKVFGMVHDSAIQLRASGEVVVGDATLGAIHIQKGVVDPHFVVVKEALLETIKEASGEKWSEELSTAWEVAYEGLASAIKKAMN

SEQ ID NO: 14120 - protein, 146 aa, Pisum sativum
MGFTEKQEALVNSSWELFKQNPSYSVLFYTIILKKAPAAKGMFSFLKDSAEVVDSPKLQAHAEKVFGMVHDSAIQLRASGEVVLGDATLGAIHIQKGVVDPHFVVVKEALLETIKEASGEKWSEELSTAWEVAYEGLASAIKKAMN

SEQ ID NO: 14121 - protein, 146 aa, Pisum sativum
MGFTEKQEALVNSSWELFKQNPSYSVLFYTIILKKAPAAKGMFSFLKDSAEVVDSPKLQAHAEKVFGMVHDSAIQLRASGEVVLGDVTLGAIHIQKGVIDPHFVVVKEALLDTIKEASGEKWSEELSTAWEIAYEGLASAIKKAMN

SEQ ID NO: 14122 - protein, 147 aa, Lotus japonicus
MGFTAQQEALVGSSYETFKKNLPTNSVLFYTVILEIAPTAKDMFSFLKESGPKHSPQLQAHAEKVFALTRDAATQLVAKGEVTLADASLGAVHVQKAVTDPHFVVVKEALLQTVKEAVGADEWSDDLSTAWEGAYDGLATAIKKAMG

SEQ ID NO: 14123 - protein, 146 aa, Phaseolus vulgaris
MGAFTEKQEALVNSSWEAFKGNIPQYSVVFYTSILEKAPAAKNLFSFLANGVDPTNPKLTAHAESLFGLVRDSAAQLRANGAVVADAALGSIHSQKALNDSQFLVVKEALLKTLKEAVGDKWTDELSTALELAYDEFAAGIKKAYA

SEQ ID NO: 14124 - protein, 146 aa, Vicia faba
MGFTQQQEALVNSSWESFKQNPSYSVLFYTIILEKAPAAKGMFSFLKDSAGVVDSPKLQAHAEQVFGMVRDSAIQLQATGEVVLKNGSLGAIHIQKGVVDPHFVVVKEALLKTIKEASGDKWSEELSIAWEVAYDGLATAIKKAMS

SEQ ID NO: 14125 - protein, 145 aa, Vigna unguiculata
MVAFSDKQEALVNGAYEAFKANIPKYSVVFYTTILEKAPAAKNLFSFLANGVDATNPKLTGHAEKLFGLVRDSAAQLRASGGVVADAALGAVHSQKAVNDAQFVVVKEALVKTLKEAVGDKWSDELGTAVELAYDELAAAIKKAY

SEQ ID NO: 14126 - protein, 145 aa, Vigna unguiculata
MVAFSDKQEGLVNGAYEAFKADIPKYSVVFYTTILEKAPAAKNLFSFLANGVDATNPKLTGHAEKLFGLVRDSAAQLRASGGVVADAALGAVHSQKAVNDAQFVVVKEALVKTLKEAVGDKWSDELGTAVELAYDELAAAIKKAY

SEQ ID NO: 14127 - protein, 543 aa, Mus musculus
MPLQEETLREVWASDSGHEEDCLSPEPPLRPKQRPAQGQKLRKKKPETPDSLESKPRKAGAGRRKHEEPPADSAEPRAAQTVYAKFLRDPEAKKRDPRENFLVARAPDLGGEENSEEDSDDDDNDDDEEEEEKKEGKKEKSSLPPKKAPKEREKKAKALGPRGDVGSPDAPRKPLRTKKKEVGEGTKLRKAKKKGPGETDKDPAGSPAALRKEFPAAMFLVGEGGAAEKGVKKKGPPKGSEEEKKEEEEEVEEEVASAVMKNSNQKGRAKGKGKKKVKEERASSPPVEVGEPREFVLQPAPQGRAVRCRLTRDKKGMDRGMYPSYFLHLDTEKKVFLLAGRKRKRSKTANYLISSDPTNLSRGGENFIGKLRSNLLGNRFTVFDNGQNPQRGGGGDVGSLRQELAAVVYETNVLGFRGPRRMTVIIPGMNSDNERVPIRPRNASDGLLVRWQNKTLESLIELHNKPPIWNEDSGSYTLNFQGRVTQASVKNFQIVHADDPDYIVLQFGRVAEDAFTLDYRYPLCALQAFAIALSSFDGKLACE

SEQ ID NO: 14128 - protein, 443 aa, Klebsiella oxytoca
MSGEQVDILVVDDDISHCTILQALLRGWGYRVALANNGLQALEKVREKVFDLVLCDIRMAEMDGIETLKEIKTFNPSIPVLIMTAYSSVDTAVEALKSGALDYLIKPLDFDKLQLTLSEALAHTRLSESPVTETPAAQFGMVGDSPAMRALLNNITLVAPSDATVLIHGESGTGKELVARALHASSARSRRPLVILNCAALNESLLESELFGHEKGAFTGADKRREGRFVEADGGTLFLDEIGDISPLMQVRLLRAIQEREVQRVGSNQTLSVDVRLIAATHRDLAEEVSAGRFRQDLYYRLNVVTIDMPPLRHRREDIPPLARYFLQRYAERNRKAVQGFTPQAMDLLIHYAWPGNIRELENAVERAVVLLTGEYISERELPLAITGTPVADAPHGDDSIQPLVEVEKEAILAALERTGGNKTEAARRLGITRKTLLAKLSR

SEQ ID NO: 14129 - protein, 337 aa, Ovis aries
MTDEAPFDTNIVTVTRFVMEEGRKARGTGEMTQLLNSLCTAVKAISTAVRKAGIAHLYGIAGTTNVTGDQVKKLDVLSNDLVVNVLKSSFATCVLVSEEDKHAIIVEPEKRGKYVVCFDPLDGSSNIDCLVSIGTIFGIYKKISKDDPSEKDALQPGRNLVAAGYALYGSATMLVLAMVNGVNCFMLDPAIGEFILVDRDVKIKKKGSIYSLNEGYAKDFDPALTEYVQRKKFPPDNSAPYGSRYVGSMVADVHRTLVYGGIFMYPADKKSPSGKLRLLYECDPMAYVIEKAGGMATTGKEAVLDIVPTDIHQKVPIILGSPEDVTEFLEIKKYTAK

SEQ ID NO: 14130 - protein, 113 aa, Deschampsia antarctica
MALAKAKEIAASSPVVVFSKSYCPYCTRVKQLFTKLGASFKAIELDVEGDGADMQSALAQWTGQKTVPNVFINGKHIGGCDDTLALEKSGKLVPLLREAGAISGSASKETMTA

SEQ ID NO: 14131 - protein, 264 aa, Candida albicans
MPASREDSVYLAKLAEQAERYEEMVENMKAVASSGQELSVEERNLLSVAYKNVIGARRASWRIVSSIEQKEEAKGNESQVALIRDYRAKIEAELSKICEDILSVLSDHLITSAQTGESKVFYYKMKGDYHRYLAEFAIAEKRKEAADLSLEAYKAASDVAVTELPPTHPIRLGLALNFSVFYYEILNSPDRACHLAKQAFDDAVADLETLSEDSYKDSTLIMQLLRDNLTLWTDLSEAPAATEEQQQSSQAPAAQPTEGKADQE

SEQ ID NO: 14132 - protein, 107 aa, Moneuplotes crassus
MPGRGKGGKGGKGYGKVGAKRHAKKALRETILGVTKPAIRRLARRGGVKRISSLVYEETRAVLKGFLESVIRDSVTYTEHAKRKTVTALDVVYALKRQGKTLYGFGG

SEQ ID NO: 14133 - protein, 299 aa, Salmonella typhimurium
MSRKDGFLALLVVVVWGLNFVVIKVGLHHMPPLLLAGLRFLLVAFPAIFFVARPKVPLTLLLGYGLTISFGQFAFLFCAIKFGMPAGLASLVLQAQAFFTMALGAFVFSERLQRKQLAGIALAIIGVLVLIEASLNGQHIAMSGFMLTLAAAFSWACGNIFNKKIMQHSPRPAVMSLVVWSALIPILPFLLSSLLLEGADHITQSLITIDMTTILSLLYLAFVATILGYGIWGALLGRYETWRVAPLSLLVPVVGLASAAVLLGETLTGMQLAGAVLIMAGLYINVFGFRVRRTARVSG

SEQ ID NO: 14134 - protein, 392 aa, Xenopus laevis
MSGPVPSRARVYTDVNTHRPRDYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQTRLTAREAMDHPYFYPIVKDQSRMGGSNMPSGSSTPVSSASMMSGISTVPTPSALGSLAGSPVISATNTLGTPVAAAAGATQ

SEQ ID NO: 14135 - protein, 843 aa, Aspergillus fumigatus
MPQILLLILLLPLVDADITVAYLIAYHNAYLTVLSHASPQTPTFHSVFPSQVMTNQPFDCHLVEDLSQCPRQWPPLPPLSASRLSYTEESSRTSPQSFTPRSLFVGLVIGALITFSNTYFGLQTGWISTMAMPSALIGFSVFKVFSKYLSYPFTPIENVLIQTVAGAVGTMPLGCGFVGVIPALEFLVRDGEDGPSGDGGTGEGGPLKLNFWKLALWSLGVCLFGVVFAVPLRKEVIVREKLRFPSGTASALMLKVLHGSGSSDEKAKKNINSTAVIRGESGTLALMQETGVEEGNALLQKDDSERQLADRQDWRSKMRLLVGAFVVSGVYTLFSYFVPQVRDVPILGLSLAQNWLWTLNPSPAYIGQGIIMGPSTCMHMLFGAILGWGILSPLAKARGWAPGPVGSWEDGSKAWIVWVSLAIMLADSLVSLGWLVLKPVIANAPRLKARFFSSRAGNWILAQASNNGSRHSYVRYSALSPISEESSTAAYSTHLPARHGEPEEEDDAPPSQLISTRTVVILLPLTLMLNVVCMHIVFGDVMSPLLSSLATLLAVLLSIMGVRALGETDLNPVSGISKLTQLLFSLATPASHFSRRTALITNLLAGAVSESGALQAGDMMQDLKTGHLLGASPKAQFYGQMIGSLVGAVLSTAVYRMYVSVYQVPGPMFQTPTAYVWIFTARLVTGQGLPPMAWQASLLAGTVFVAITIVRIYAASPLANGGRRNVSAPWRAWVPGGIAVAVGIFNVPSFTLARAIGGIIAWWWSRKHTNTTTSNIPGETVADLPPGASRVPAAVAGKTAEQAAREADAASSSVVVLASGLILGEGIISIVNLLLASGNVPHL

SEQ ID NO: 14136 - protein, 392 aa, Pseudomonas putida
MSDRSARLQALQHALKERILILDGGMGTMIQSYRLEEHYYRGTRFADWPSDVKGNNDLLLLSRPDVIAAIEKAYLDAGADILETNAFNATQISQADYAMESLVYELNVEGARIARQVADAKTLETPDKPRFVAGVLGPTSRTCSISPDVNDPSYRNVTFDELVENYVEATRGLIEGGADLILIETIFDTLNAKAAIFAVQQVFEDDQVELPIMISGTITDASGRTLSGQTTEAFWNSVRHAKPISVGLNCALGAKDLRPYLEELSTKADTHVSAHPNAGLPNAFGEYDETPAEMAAVVEEFAASGFLNIIGGCCGTTPGHIQAIAEAVAKYKPREIPEIAKACRLSGLEPFTIDRQSLFVNVGERTNITGSAKFARLIREENYTEALEVALQ

SEQ ID NO: 14137 - protein, 96 aa, Oryza sativa (japonica cultivar-group)
MGHHHKNDDKAAAAAGGDHRKEEKHHKHMEQLAKLGAVAAGAYAMHEKHKAKKEPENARSHRVKEEIAATIAAGSVGLAIHEHHKKKEAKKHGHHH

SEQ ID NO: 14138 - protein, 105 aa, Oryza sativa (japonica cultivar-group)
MFGHHKNEEKMAAAGAAPKDAGDYRKEEKHHKHMEQIAKLGAAAAGAYAMHEKKQAKKDPEHARSHKMKEGIAAAVAVGSAGFALHEHHEKKEAKKHRRHAHHHH

SEQ ID NO: 14139 - protein, 646 aa, Oryza sativa (japonica cultivar-group)
MATIQDIGVSAAINILSAITFLLAFAFLRLQPINDRVYFPKWYLKGARESPSHGGAFVRKFVNLDMRSYLKVLSWMPAALKMPEDELISHAGLDSAVYLRIYLIGLKIFAPITVLAFIILVPVNWTNITLQSSKVQHSDIDKLSISNIPVGSKRFAAHLTMAYVFTFWTCYVLLREYEIVATMRLRFLASEKRRPDQFTVLVRNIPPDPDESIGELVEHFFLVNHPDHYLTHQTGFLGCFGSKVDAIEYYTSEIERIEKEETDERGKIMKDPKSVVPAAFVSFRSRWGAAVCAQTQQTSNPTVWLTEWAPEPRDVYWDNLSIPFVYLTIRRLIIAVAFFFLNFFYVLPIAFVQSLANIEGIEKAAPFLKPLIEIIPRTIGEAIPMKATFFITYVMVDGWAGVAGEILRLKPLIIFHLKNFFLVKTEKDREEAMDPGSIGFDSNEPQIQLYFLLGLVYAVVTPFLLPFILIFFGLAYVVYRHQIINVYNQEYESAAAFWPSVHGRIIVALIVSQLLLLGLLSTKGAGQSTPVLLVLPVVTFYFYKYCKNRYEPAFVEYPLQDAMRKDTLERAREPGFDLKGYLMNAYIHPVFKGDEDDEKFSISDEPEAEQVLVATKRQSRRNTPVPSKYNGSESPSLAEIVNDQRL

SEQ ID NO: 14140 - protein, 318 aa, Oryza sativa (japonica cultivar-group)
MSTTVFVFYRHAIAILFLVPVAFVVERKTAPPLSYKILLKLFVHALYGIAGSVNIYGLGLSYSSATSSSAISNLLPVLAFFLAVLMGMESLNLKRIHGIAKVFGVLFSIVGVIILAFYQGPELKSLNLQHLSSRNVVPTGSTAYTTKAWTSGIFLTVLSTTSWALWTVLQIVLPQGLMLEVYPSKLLNTTIQMVFATIQCFFIALAVERDFSRWKLGLDAGLIAVIYSGALVSGLAYYMQVWVIDKSGPVFLAMTMPITLIVTIVLSSFVLGEAVTLGSIISGVVMVGGLYCVLWAKKAEQAIASKEEATLPVQATQV

SEQ ID NO: 14141 - protein, 404 aa, Oryza sativa (japonica cultivar-group)
MGTRAAFVVAFLIRSLYGGMQIVTKFAFNEGMSTSVFVFYRHVIAILFLVPVAFVLERKTAPPLTFKVSLKLFLHALYGISGAINIYSLGLSYASATSSSAIFNLLPAVAFILALLMKMESLNLKRINGIAKVSGVVLCIVGVIILAFYQGPELKSFNHHHLFRTSTVYAAATSHPATTWILGIFLTTLSTTCWALWTVLQGPMLEVYPSKLLNTTIQIVFATIQCFFIALAIERDFSRWKLHLDMGLIAVIYSGVLVSGVAYYMQVWVIDKSGPVFLAMTMPITLLVTIMLSSFVLGEAVTLGSIISGVVMVGGLYCVLWAKKSEQAAISKQQMGLLHAIKAVFPDCAQSPEEGEKRRLICVPSRLKSALTLPTGCSARSGLGNSNKPFALPSHLTPLAHHFM

SEQ ID NO: 14142 - protein, 369 aa, Oryza sativa (japonica cultivar-group)
MAASNLDVFEACHERLQHCARATRCTILTKVAFSQGTSTYVLVFYRNIIAAVVLLPVALAVERKTAPPLSLKVSLKLFVHALCGMSAAMNISCIGLNYSSATAASAVQNIMPVLTFFLAVLMGMESFKLKMCHGIVKISGIVFCAVGVSVLALYQGPDLKSFIKHHLFPHTNRVGTHSSRNWILGIFLQFLATLMWALWAVLQGPLLEEYPSKLLNTTLQIVFSAVQSFFMALVLERDFSRWKLGFDIGLVAIIYCGIVVSAISFYMQIWIIDKRGPVFLCMTVPLTLVITIILELLIGEAVTLGSIISGALMVVGLYTVLLGKRIEEEGISSQGGNAEETARSDLEEQETAAPVPASQDVKEKVDATN

SEQ ID NO: 14143 - protein, 482 aa, Oryza sativa (japonica cultivar-group)
MEKKTKLVEEEDGCYYYDYGGYGDGVVDDEGRATELRPMALSRPHTQAFHLAWMSLFACFFAAFAAPPILPAMRPALVLAPSDASAAAVASLSATLVGRLAMGPACDLLGPRRASGVASLVCALALALAAVFASSPAGFVALRFVAGLSLANFVANQHWMSRIFAPSAVGLANAVAAGWANVGSAAAQVVMPVAYDAVVLRLGVPVTVAWRVTYLLPCAMLVTTGLAVLAFPYDLPGGGGGRCPGGGGGRRRSFWAVVRGGVGDYRAWLLGLTYGHCYGVELIMENVAADFFRRRFRLPMEAAGAAAACFGAMNAVARPAGGVASDEVARRFGMRGRLWALWAVQSAGAALCVLVGRMGAAEAPSLAATVAVMVACAAFVQAASGLTFGIVPFVCKRSLGVVSGMTASGGAVGAIVTNRLFFSGSRYTVEEAISCTGITSLLCTLPVALIHFRRQGGMFCGPSATIDGDGDVDDDDDYMLLK

SEQ ID NO: 14144 - protein, 314 aa, Pueraria montana var. lobata
MAAIEIPTIVFPNSFAQHRVPVVEMGSAPDFTCKKDTKEAIIEAVKQGYRHFDTAAAYGSEQALGEALKEAVDLGLVSRQDLFVTSKLWVTDNHPHLVVSALRKSLKTLQLEYLDLYLIHWPLSSQPGKFSFPIEVEDLLPFDVKGVWEAMQECQKLGLTKAIGVSNFSVKKLQNLLSVATIRPVVNQVEMNLAWQQKKLREFCKENGIVITAFSPLRKGASRGPNEVMENDVLKEIADAHGKSIAQVSLRWLYEQGVTFVPKSYDKERMNQNLQIFDWALTQEDHHKISQISQSRLISGPTKPQLSDLWDDEI

SEQ ID NO: 14145 - protein, 521 aa, Pueraria montana var. lobata
MLLELALGLLVLALFLHLRPTPTAKSKALRHLPNPPSPKPRLPFIGHLHLLKDQLLHHALIDLSKKYGPLYSLYFGSMPTVVASTPELFKLFLQTHEATSFNTRFQTSAIRRLTYDNSVAMVPFGPYWKFIRKLIMNDLLNATTVNKLRPLRTEQIRKFLRVMAQSAEAQQPLNVTEELLKWTNSTISMMMLGEAEEIRDIAREVLKIFGEYSVTNFIWPLMYLKVGKYEKRIDDIFNKFDPVIERVIKKRREIVRRRKNGEVVEGEASGVFLDTLLEFAEDETMEIKITKEQIKGLVVDFFSAGTDSTAVATEWALAELINNPRVLQKARDEVYSVVGKDRLVDEVDTQNLPYIRAIVKETFRMHPPLPVVKRKCVEECEVNGFVIPEGALILFNVWAVGRDPKYWDRPLEFRPERFLESGAEGEVGPIDLRGQHFQLLPFGSGRRMCPGVNLATSGMATLLASLIQCFDLQVVGPKGEILKGNDAKVSMEESAGLTVPRAHNLRCVPLARTSVAAKLLS

SEQ ID NO: 14146 - protein, 354 aa, Homo sapiens
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKADAKMVCDVVSRMEDTEPFSAELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLKLFDSICNNKWFTDTSIILFLNKKDIFEEKIKKSPLTICFPEYTGPSAFTEAVAYIQAQYESKNKSAHKEIYTHVTCATDTNNIQFVFDAVTDVIIAKNLRGCGLY

SEQ ID NO: 14147 - protein, 381 aa, Homo sapiens [sequence omitted]

SEQ ID NO: 14148 - protein, 379 aa, Nicotiana sylvestris
MTIDCMITNVKSPMLRILEDEKRPLIFDASQMKREYNIPTQFIWPDDEKPRATARELPVPLIDLGGFLSGDPVAAQQASRLVGEACRNHGFFLVVNHGVNANLICNAHRFMDMFFDLPLSEKQKAQRKLGEHCGYASSFTGRFSSKLPWKETLSFRYSAQEDSSRIVKEYFQNTMGESFSHLGNVYQEYCNSMSILSLGIMELLGMSLGVGREHFKEFFEENESIMRLNYYPPCQKPDLTLGTGPHCDPTSLTILHQDCVGGLQVFVDNEWRSISPNFNAFVVNIGDTFMALSNGRYKSCLHRAVVNNKTPRKSLAFFLCPKKDKVVSPPTELVDSNNPRIYPNFTWPTLLEFTQKHYRADMNTLQSFSNWLQQTTAQV

SEQ ID NO: 14149 - protein, 377 aa, Nicotiana sylvestris
MTVDCMITRNKFTMQRTSKEPLIFDASVMKNESNIPSQFIWPDNEKPCANARELHVPHIDLGGVLSGDPFATKQAATLVNEACQKHGFFLVINHGIDTNLISNAHRYMDLFFELPLNEKQKAQRKIGEHCGYASSFTGRFSSKLPWKETLSFQYSAEEGSSHIVEDYFQRTMGENFCHLGKVYQDYSIAMSTLSLGIMELLGLSLGVSRNHFKEFFQENESIMRLNYYPPCQKPELTFGTGPHCDPTSFTILHQDSVGGLQVFVDNEWRSITPNFNAFVVNIGDTFMALSNGRYKSGLHRAVVNTKIPRKSLAFFLCPKKDKVVSPPIELVDSNNPRIYPEFTWPALLEFTQKQYRVDMNTLQTFSNWVQQTTTQAL

SEQ ID NO: 14150 - protein, 360 aa, Nicotiana sylvestris
  unsure (1)..(360): unsure at all Xaa locations
MPSRISDDVHQKQLDLYTIKELPESHAWRSSLDHDYQCNDSLESIPVIDLNDEKFAIENIGHACKTWGAFQIINHNISQRLLDNMEEAGKRLFSLPMQQKLKAARSADGIAGYGVARISSFFSKLMWSEGFTIVGSPFDHARQLWPHDYKKFCDVIEEYEKEMEKLAGRLMWLMLGSLGISKDDMKWACCGPRXECSALQLNSYPACPDPDRAMGLAAHTDSTILTILHQNNTSGLQVFKEGNGWVTVPPLSGALVINVGDLLHILSNGLYPSVLHRAVVNRTRHRLSVAYLYGPPSGVKISPLSKLVDQGHPPLYRSVTWSEYLGTKAKHFDKALSSFQLCAPRIGFANPKDRNSVQVG

SEQ ID NO: 14151 - protein, 370 aa, Nicotiana sylvestris
MPFRISDSFRTHSQKHLDLNSIKELPESHAWTSSNDYPSENSCNFESIPVIDLNNNNHNNINVLEHIGQACKKWGAFQIINHNISERLLQDIELAGKNLFSLPMQQKLKAARSPDGVTGYGVARISSFFSKLMWSEGFTIVGSPLEHARQIWPQDYKKFCDAIEEYEREMEKLAGRLMWLMLGSLGITKEDVNWAVGPKGESKGGSAALQLNSYPACPDPDRAMGLAAHTDSTILTILHQNNTSGLQVFKEGSGWVTVPPFLGALVVNVGDLLHILSNGSYPSVLHRAVVNRTRHRLSVAYLYGPPSGVKISPLAKLVDQRHPPLYRAITWSEYLGTKAKHFDKALSSVRLCAPLTGFADAKDHNGVQVG

SEQ ID NO: 14152 - protein, 788 aa, Mus musculus
MSEEQWVSLSSEEFDQLQKYSEYSSKKIKDVLAEFNEGGSLRQYDPHKPISYDVFKLFMRAYLEVDLPQPLSTHLFLAFSQKPRQETPDHPKEGASSSEPNVSDYNSDNAAKADEACAPDTESKTTKTQAPSKELEAAAPWEDPGALASSSDAPVVYLKDVVCYLSLMETGRPQDKLEFMFRLYDSDENGLLDQAEMDQIVSQMLHVAQYLEWDPTELRPILKEMLQGMDYDKDGFVSLQEWINGGMTTIPLLVLLGMDDSGSKGDGRHAWTLKHFKKPTYCNFCRAMLMGVGKQGLCCIYCKYTVHQRCVSKTIHGCVKTNSKAKRSGEVMQHAWVEGNSSVKCDRCHKSIKCYQSVTARHCVWCRMTFHRKCELSTVCDGGELKDHILLPTSICPVSGDRQGGKSDGSVAAKGELVTQYKIIPSPGTHPLLVLVNPKSGGRQGERILRKFHYLLNPEQVFNLDNGGPTPGLNFFHDTPDFRVLACGGDGTVGWILDCIDKANFTKHPPVAVLPLGTGNDLARCLRWGGGYEGGSLTKILKEIEQSPLVMLDRWYLEVMPREEVENGDQVPYNIMNNYFSIGVDASIAHRFHMMREKHPEKFNSRMKNKLWYFEFGTSETFAATCKKLHDHIELECDGVEVDLSNIFLEGIAILNIPSMYGGTNLWGETKKNRAVIRESRKSVTDPKELKCCVQDLSDQLLEVVGLEGAMEMGQIYTGLKSAGRRLAQCSSVTIRTNKLLPMQVDGEPWMQPQCTIKITHKNQAPMMMGPPQKSSFFSLRRKSRSKD

SEQ ID NO: 14153 - protein, 257 aa, Pseudomonas fluorescens
MTDAVSDALHTRHDSAPSAVKGTIIVSGGSQGLGLTTVRCFLEAGYNVATFSRRESPAVTELSERADFHWQALDCTDYSALTAFVQQVEKRFGGLDGLVNNAATGVEGILSTMRVADIDSALDINLKGQLYLTKLVTAKLLKRGAGSVVNVSSINALRGHSGLTVYSATKAAMDGLTRSLAKELGPRGIRVNSVSPGYFSSDMVKDLSPQTLSRIERRTPLGRLGTQQEVADLILYLVDRGTFVTGQNIAVDGGFTC

SEQ ID NO: 14154 - protein, 294 aa, Homo sapiens
TVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSSAWSHPQFEK

SEQ ID NO: 14155 - protein, 277 aa, Homo sapiens
TVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPF

SEQ ID NO: 14156 - protein, 337 aa, Homo sapiens
MSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSS

SEQ ID NO: 14157 - protein, 405 aa, Gallus gallus
LENGLARTPPMGWLAWERFRCNVNCREDPRQCISEMLFMEMADRIAEDGWRELGYKYINIDDCWAAKQRDAEGRLVPDPERFPRGIKALADYVHARGLKLGIYGDLGRLTCGGYPGTTLDRVEQDAQTFAEWGVDMLKLDGCYSSGKEQAQGYPQMARALNATGRPIVYSCSWPAYQGGLPPKVNYTLLGEICNLWRNYDDIQDSWDSVLSIVDWFFTNQDVLQPFAGPGHWNDPDMLIIGNFGLSYEQSRSQMALWTIMAAPLLMSTDLRTISPSAKKILQNRLMIQINQDPLGIQGRRIIKEGSHIEVFLRPLSQAASALVFFSRRTDMPFRYTTSLAKLGFPMGAAYEVQDVYSGKIISGLKTGDNFTVIINPSGVVMWYLCPKALLIQQQAPGGPSRLPLL

SEQ ID NO: 14158 - protein, 241 aa, Thermus aquaticus
TSDPVRQYLHEIGQVPLLTLEEEIDLARKVEEGMEAIKKLSEATGLDQELIREVVRAKILGTARIQKIPGLKEKPDPKTVEEVDGKLKSLPKELKRYLHIAREGEAARQHLIEANLRLVVSIAKKYTGRGLSFLDLIQEGNQGLIRAVEKFEYKRRFKFSTYATWWIRQAINRAIADQARTIRIPVHMVETINKLSRTARQLQQELGREPSYEEIAEAMGPGWDAKRVEETLKIAQEPVSL

SEQ ID NO: 14159 - protein, 243 aa, Geobacillus stearothermophilus
GSHMQGQSPIKDQEMKELIRRSQEGDQEARDEIIEKNMRLVWSVVQRFLNRGYEADDLFQIGCIGLLKSVDKFDLSYDVKFSTYAVPMIIGEIQRFLRDDGTVKVSRSLKEMGNKIRKAKDELSKTRGRAPTVTEIADHLGISPEDVVLAQEAVRLPTSIHETVYENDGDPITLLDQIADADEASWFDKIALKKAIEELDERERLIVYLRYYKDQTQSEVASRLGISQVQMSRLEKKILQHIK

SEQ ID NO: 14160 - protein, 436 aa, Saccharomyces cerevisiae
AVSKVYARSVYDSRGNPTVEVELTTEKGVFRSIVPSGAATGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 14161 - protein, 557 aa, Drosophila melanogaster
MFRATEIGSEKTLPALAELSQVGYERDARDVEWVAWRGERAQLKLAHRSSLPNYGFAPPTIRMKYRYPRAVFFVLATKFFEAFAANGIRTVLALYLRDDLNFTESFSTVVLHIFNFFGQFCPIIGAILADSYIGNVRTISGFSFIYAFGWLLLTLKSLPAMGLPMVLLVSIALLFIAVGNGSIRACITSLGALQFKLPEQSVHLAEYFSFYYFVYYFGIFLSKILPPLVRANTQCFDKAECYPAVFGTLGAAFMMAWFIFLVGKWFYKSEKLSDDNILFKFCGCIKTALVEKWRRRKSTKRSNYWLHNAVVAYDMGFVNDVSRVLRISKLFIPLPFYFALLAQQDSSWTFQATQMNTTLMGVTIQPDQAKAVGPIFLFMLIPLWQYITVPLLRRYFNWELQPLHSVTVGGIFSAGAFFCAGALQERIKNSPPQTVNIAWQLPQFLLLMMGELLLSIPGLQFAFTQAPTSMKSVVTAAWFLNNAFGNLIVVLVTELGMLSSQMAEYFFYAVVMLVCIILYALLAFDYTLQERKAGMYVRMDSEAEDRDVPSTSRSGSI

SEQ ID NO: 14162 - protein, 860 aa, Drosophila melanogaster
MTLETQPVGGVSDGKIAGLYDLEETLGSGHFAVVKLARHVFTGAKVAVKVVDKTKLDDVSKAHLFQEVRCMKLVQHPNVVRLYEVIDTQTKLYLVLELGDGGDLYDYIMKHDSGLSEELARKYFRQILRAITYCHQLHVVHRDLKPENVVFFEKLGLVKLTDFGFSNKFLPGQKLETFCGSLAYSAPEILLGDSYDAPAVDIWSLGVILYMLVCGQAPFEKANDSETLTMIMDCKYTVPSHVSTDCRDLIASMLVRDPKKRATVEEIASSAWLKPIDEPDSTTSTSEHFLPLVSREQLGEEDHAFIIQKMINGNIASKEEILQALDKNKYNHITATYFLLAELRLRRRREELAQKQRLLNDASMKVGDASRKLVPEKPSPTEAQKGGVPISINVTPAAQFANDGGKPDKRSRKCSIVREEDEEESATECTAVGNELKVTSSSRREAFSDSPFSRSIHERSSSEPGNQTKGEQIANSGVPSHSRTKIVVSVDATLAHKLKQMEKSAKIDEDTLSGLKELEIGKLKPLPSSSKNPVLTHRRTKLNKIRTPSCSSSEASDDDTKTRNKKKINKFVGDTPVRFRMHRRDSHDDSSDSQDQLYPPPGSASNAGNFISKSGSVSGKKEGQSQYKEPNNKSDENRKSHSQKNRKQHNKDHVDKHSHAERQLADSSTATTGNSTNRRRRIRESQSLDRITEAQEYEMRHRCYAESEAASSSSSSTQHIDQRYSLLSLNTSTFSVAETKEEYDEEADATNATDQIMNTLNAAKATLQQEQYFNNNTNLSRNFNHNHNQSIIHISSQKANGKKSNETPKDIYNLNSIEHIDLILEDKSLTKAIHVTGFKCFVTMKKIRRLGKYFPVMNFS

SEQ ID NO: 14163 - protein, 168 aa, Rumex obtusifolius
MDAEVEYRCFVGGLAWATDDQSLERAFSNYGQVLESKIINDRETGRSRGFGFVTFSSEQAMRDAIEGMNGQDLDGRNITVNEAQSRGSGGGGGGYRGGGGGGYGGRREGGYNRGGGGGYGGGGGGYGGGGGGYGGGGGGYGGGRREGGYGGGGGDRYARGNSDSDWRN

SEQ ID NO: 14164 - protein, 522 aa, Triticum aestivum
MARGGGNGEVELSVGVGGGGAGAGGADAPAVDISLGRLILAGMVAGGVQYGWALQLSLLTPYVQTLGLSHALTSFMWLCGPIAGLVVQPCVGLYSDKCTSRWGRRRPFILTGCILICIAVVVVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDLHGYIQHAITASKEIKIVSLALFAFLGIPLAILYSVPFAVTAQLAANRGGGQGLCTGVLNIAIVIPQVIIAVGAGPWDELFGKGNIPAFGVASAFALIGGIVGIFLLPKISRRQFRAVSGGGH

SEQ ID NO: 14165 - protein, 522 aa, Triticum aestivum; identical to SEQ ID NO: 4994

SEQ ID NO: 14166 - protein, 194 aa, Hordeum vulgare subsp. vulgare
MMLSSAYSTPAADELGGPPPLPPPPGADVSVIVGALTGVLLGLFLFLIYAKHCRQRGRGGARGAAGGLGLGFRASSTCDRCRSGVSLSVVDALPVVRFGDMGGAAAAAQPECAVCLGTFDPAADELLRVLPKCRHAFHADCVDTWLEAHSTCPVCRRRVGKEDAFAVIPELEAADADWYPAREAEMQIVVRRPA

SEQ ID NO: 14167 - protein, 416 aa, Gibberella zeae
MGDLQGRKVFKVFNQDFVVDERYTVTKELGQGAYGIVCAAVNNQTNEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYVRNLPFMPKKPFPSLFPQANPDALDLLDKMLAFDPSSRISVEQALEHPYLQIWHDASDEPDCPTTFNFDFEVVEDVGQMRGMILDEVQRFRQNVRTVPGQSGGGLQGQGVPVPLPQGNGQWTAEDPRPQEYAGHGNTGLEQDLQGGLDASRR

SEQ ID NO: 14168 - protein, 59 aa, Deschampsia antarctica
DLEREQTLESETIETTAQAVGTGNGSLNGNAATPTNGAVIKPSQEPESTPSEKSGQQSQ

SEQ ID NO: 14169 - protein, 651 aa, Oryza sativa (japonica cultivar-group)
MQQDQRKKVGFGFGSGDLSLLVSSVLCFGVNWFRALPLALPFLCEQLRFASSSTEADFFTEYGDASRYKIQEVIGKGSYGVVCSAIDVHTGEKVAIKKIHDIFEHISDAARILREIKLLRLLRHPDIVEIKHIMLPPSRRDFKDIYVVFELMESDLHQVIKANDDLTKEHYQFFLYQLLRALKYIHTANVYHRDLKPKNILANSNCKLKICDFGLARVAFNDTPTTIFWTDYVATRWYRAPELCGSFFSKYTPAIDIWSIGCIFAEVLTGKPLFPGKNVVHQLDLMTDLLGTPSMDTISRVRNDKARRYLSSMRKKEPILFSQKFPSADPLALDLLQKLLAFDPKDRPTAEEALAHPYFKGLAKVEREPSCQPITKMEFEFERRRVTKEDIRELIFREILEYHPQLLKDYINGTERTTFLYPSAVDQFRKQFAHLEENGGNGPISTVLSLTFRSTIVHSTPIPAKEQPRIGPSRDKPSDEPYSNPREFDRFSGNAPRTSQAPQRVPTARPGRVVGPVLPYENGATKDSYDARRLAMNSGYPPQQQIPQAYGYYQIPGKSACSELSQAERYTLHQQAYTCANSATVTDVALDMRAPPFHLSGGPKSDSSERLAAETNLYTRSLNGLAATAAGVAASAHRKVGVVPYGMSRMY

SEQ ID NO: 14170 - protein, 586 aa, Oryza sativa (japonica cultivar-group)
MSCSWMIPVFAILAFVASAAQADVVEHTFNVATLSLPRICQPGNTSVTAVNGRVPGPQVEAREGDTVVIHVINDSPYNVTVHWYMYLTYSSPPDRGTPWADGPAMVTQCPIRPGHRYTYRFAVAGQEGTLWWHAHSSYMRATVYGALVIRPRRAGGYPFPTPYEEKTVLLGEWWNGDPVALESQSFSTGIPAPNADAYTINGMPGDSYLCPETTNRIAKFEVRRDKTYLLRIINAALNTAFFFKVAGHTFTVVAADASYTEPYATDVIVIAPGQTVDALMAADASPGCYHMAISSYQSAIPFPPRPAGFNGNTSTAIVEYVDATATTDAGSPVLPVMPKPNDTYTANQFYTSLTALIRPGRRTVPLTVDTRMLVTVGLGFSSCQPEQTQCNRSAPVVLANMNNVSFALPNTVSMLEALYRNTADGVYTRDFPDQPPVAFDYTSRGLLGNSPLASTGSPSTKVKTLRYNATVEMVLQNTALVGLESHPMHLHGFNFFVVAQGFGNNDGEAAGAGEFNLVNPQERNTVAVPTGGWAVIRFVADNPGMWAMHCHIDSHFAIGLAMVFEVESGPTPGTTLPPPPPDLPQC

SEQ ID NO: 14171 - protein, 520 aa, Oryza sativa (japonica cultivar-group)
MRVSRLCNSTDIIAVNGLLPGPMIEVNEGDAVAVEVINGSPYNLTIHWHGILQLLTPWADGPSMVTQCPIQPNSSYTYRFNVTGQEGTLWWHAHSSFLRATVYGALIIRPRNGSAYPFPAPDQEVPIVLGEWWSRNVVDIESDAVSSGQLPRESDAFTVNGVTGELYQCANDTFTVDVQPNTTVLLRVINAGLNTHLFFKVAGHAFTVVAVDACYTANYTTDTLVLAPGHTVDALMVTNASAGSYYMAVQAYDSLSPTTMAVTDDTTATAIVHYNTTSTKKNATPVMPTMPQSSDSATANAFYFGLRGPPSPSAPAVPTKVDVNMTIELGLGQLPCDSTQSSCSGKSVAAAMNGVSFRLPSQMSLLEAQFNRTPGVYTADFPDAPQPSGTPMVEGTKVRRLKYNSTVEIVLQNPTAFPSENHPIHLHGFNFFVLAQGLGNFTPGNVSGYNLVDPVSRNTLAVPTGGWAVIRFVANNPGMWFFHCHLDAHVPMGLGMVFAVDNGTTPDSFLPPPPADLPKC

SEQ ID NO: 14172 - protein, 192 aa, Oryza sativa (japonica cultivar-group)
MTPVSHQLVPPALAAAFGIDLAAVGVLLPSPSVDSPVSHLFFPVDEDDDEDEEGEGEGGNDDAPAAAAAGGGGGRCGKKARMVWTPELHHRFVEAVAHLGEKGAVPKAIVRLMNVDGLTRENVASHLQKYRLYLKRTRVAATPPPSPPPPPPPPPPLPPAMYVPCFAAKPPLDAANRSDSPPSRTSDATTKQ

SEQ ID NO: 14173 - protein, 522 aa, Oryza sativa (japonica cultivar-group)
MANRRKFSQAGGGGGGGVFDPFGTKQAVSSLRKGGRLPVYVAGVFFVIFVIIMYGEDIRSLTLDPIARAGTTPARIVEPVVTEERHVARVNPPRREVSSAEKAAALPLDVDERPKLATPTPTEAAKEVPKVEKIRKPKKPKTTKKKPRKPRPAKKTVAAAAGGLLGVPETCDLSKGEWVFDNTSYPLYREEQCEFLTSQVTCMRNGRRDDTYQKWRWQPKDCSMPRFDAKLFMERLRGKRFMFVGDSLNRNQWESMVCLVQSAMSPGKKYVTWEDQRVVFHAVEYNATVEFYWAPFLVESNSDDPKIHSIQHRIIKADAIAAHAQNWRGVDYLVFNTYIWWMNTLNMKIMRPGGQSWEEHDEVVRIEAYRKVLTTWASWVNDNIDPARTSVFFMSISPLHISPEVWGNPGGIRCAKETMPLLNWHGPIWLGTDWDMFHAAANVSRTAATRVPITFVDVTTMSERRKDGHTSVHTIRQGKVLTPEQQADPGTYADCIHWCLPGVPDIWNLILYTRIMSRPQLV

SEQ ID NO: 14174 - protein, 438 aa, Oryza sativa (japonica cultivar-group)
MAYCIRHSPGRCQCYPSPPTTLQRGESAAAVVPCSICLDAVVAGGGDRSTARLQCGHEFHLDCIGSAFNAKGVMQCPNCRQIERGNWLYANGSRPSQDVSNDDWGHDEDFYDANQPETSRSVFLPFRFQWCPIGRLAQLPSVFDEGESAPPVTFHDFMGQNFTSEHLPVSAPGATPPGPYIAYFQPLQSSASSSSSHVTERTMDGTTYHDHWNPLPGPSDGRPLATVHPIDFHHNHWTHLPNSYSQPNSNNGVAEQMAIPVVPMRVGGLDSDSQQRGSLPSVYGNGSGSRSRIPSVPPMAPQFMRPHGNINEQYQQNSSSLYAAPQRRTAVQAVQDSMNFTLFPQAPTGPNSMETEDAGGNQFYAWERDRFAPYPLMPVDSEANWWGSTPQSHGVTDHSAAPGRRLFGQWIGAGRSPPPPPPPPADNSSYRQMHIPRM

SEQ ID NO: 14175 - protein, 95 aa, Oryza sativa (japonica cultivar-group)
MAARTYLAVFAFCAILMLSAVARSASARALRERAPEEAAVVAGRAGVAGMMKVPAAAAGEAAGRRSGGGAVVVVGGAAAHESKRLSPGGPDPQHH

SEQ ID NO: 14176 - protein, 208 aa, Oryza sativa (japonica cultivar-group)
MAHGRVQRMQCWVVVACVVASVSTTASAFVFKAGGTGEWRVPDQQASGNVSAYNQWAEHTRFRVGDAIAFSYQPGNDSVLLVDKSSYDACNTNTPIDTFADGNTVFTFTRSGPYYFISGNKDNCNRNEKLIVVVMGERAANGTAPAPALAPSAGTTSPNSPPSPPPPPSGIEISPTPEQSINAAARPRAAGIAGAAGLAIGTLFYALV

SEQ ID NO: 14177 - protein, 329 aa, Oryza sativa (japonica cultivar-group)
MGRGGDVDGAAGALRRFVREAGGCAVVDGGLATELEAHGADLHDELWSASCLVSAPHLIRKQVHLDYLDAGANIITSASYQATIQGFQARGLSRERSEALLRRSVHIAQEARAIFAEGWSKGPYANHRSSPRRPVLVAASIGSYGAYLADGSEYTGDYGISVTKETLKSFHRRRLQVLADAGPDLIAFETIPNKLEAQASGDPITECAAVADACARVGAVGVNCTAPRLVHGLILSIRKVTSKPVVVYPNSGETYVAETKEWVESEGGASETDFVSCVGKWRQAGAALVGGCCRTSPATVRAISWALRESDDAVGGDGDRDDFPAVAVL

SEQ ID NO: 14178 - protein, 352 aa, Oryza sativa (japonica cultivar-group)
MGNRSFDLSCSLRKEEENGTNLSPFVRKLFKEVLPGEHNFVATLIEGRDQKKRPTQFGMNQVLQPFDSVKFNFTKVSPEEVIFTFKESQNDSVKYFDNVPHAVAASPTAILINVSPIGYCHVLLIPRIQDCLPQRVDKESFLLAMYVASEAKDPFFRVGYNSLGGFATINHLHFQAYYLKVQYPVEKALTEKLTTLGNGVSIIQLVQYPVSGFVFEGGACLEDLSDVVSKVCIFLQENNKPFNALISESGKRVFLLPQQWITNILSPSDSIDQCYAEKQALGRVSQEFLDMRINPAVWELSGHLVLKRRKDYDEASEATICRFLVEASLSESEFQELKSCILEFLSSAAPEE

SEQ ID NO: 14179 - protein, 809 aa, Oryza sativa (japonica cultivar-group)
MEGSRVDAVAGGRRWGEGEEGGRRGGGGGGGGGGGGTGGGGGGGGRRGGEDGGEVSLREWLDRPGRAVEAPECLHVFRQVAESVAIAHAQGVAVGSARPSCFVVSPPFARVAFIESASGSDVSGSCSGSDGSEEADPEPSPPRRRRDGASGGEDRGGKTFPLRSVLAMELTWYTSPEEADDRGGATFASDVYRLGVLLFELFCTFETMEEKMRAMANLRHRVLPPQLLLKWPKEASFCQLLMHPVPETRPKMSDVLQSEFLNRSRNSLEEREAALRLREEIEEQELLLDFLLQLQRRKQDIADNLQDTVAFLSSDINEAHQQSALGQCGNFSFELDKEVCSETVEDQSDCGSRKRFRPELPAVDMEEQNRSLEECSGTVPSSVLIQESVLSKSSRLMKNFKKLETAYFLTRSKLAKQVGNPVSSCHQVVKRTTGSPVVTEGSSIDDFALEGHYGTRQRGWMNSFLEGLCSYLSFSKLKVKAELKQCDLLNSSNLVCSVGFDRDKEFFATAGVNKKIKVFEYNMIVNEHCDIHYPVVEMSNRSKLSCICWNSYMKSHIASSDFEGIVQVWDVTRSQVFVEMREHERRVWSVDFSLADPTKLVSGSDDGSVKLWNMNQAILFLHLAGSVGTIRTRANVCSVQFQPDSARSIAIGSADHKIYCYDLRNIRAPYCTLVGHTKTVSYVKYVDASTIVSASTDNSLKLWDLSMSQARIIDSPLRTFTGHTNTKNFVGLSISDGYIATGSETNEVFVYHKAFPMPVLAYKFSVTDPISGQEIDDPSQFISCVCWRGQSSTLLSANSSGNIKILEMD

SEQ ID NO: 14180 - protein, 205 aa, Oryza sativa (japonica cultivar-group)
MAPAAGGFKLFGKVIMQCGVSEGTQDKAQGFVVAREKVEPEEEEEEEQRVPAAATSGQRASIKREAADRDEEQRQGGGDAAGQPTQRRLQDSAEARAAAAAPLPCPRCRSRDTKFCYFNNYNVNQPRHFCKACHRYWTAGGALRNVPVGAGRRKNRPLGPLAVAHHNHHHRAAAGFVLGFPNPSSPTSPSPVYTDRWPVTPDRPF

SEQ ID NO: 14181 - protein, 789 aa, Oryza sativa (japonica cultivar-group)
MAFVCGGGQVMDSVSLSLLDSISNFRVLSSSNASKTELVKKYCQTMDGILDHLEVALNRAFPQITPDGELSKVIQADSIIAKMQIYVFELCQIVNSLMQIESMHLEDLEHDSCGKISDVIREASRALAGEVMPNSEEFGKIQTTLSLSTNQELLMEYVALVKVKTKGNHEDNKEMDDINDIVELVNHMLDKHVEEKQTRSINGVTIPADFCCPLSLELMSDPVIVASGQTYEHVFIRKWFDLGYNICPKTRQILGHTKLIPNFTVKQLIENWCEVHGIMLPDPVKLLSLCFPVSLNITDGSASADKSGSPEHCQLVAALHPKAQCASDDSHHYNLIHENSDSDDRVSSFGDTDDSEPDSLRLSTETTAANKSLLDEKTDRSDGLKQLRDNGFQVSDEEQYLERNGKSHISSHHQLEVDGENVRVQASSDINASEVMQDDPVTTCSKVSDNPPRLGGVRSRNQPNWWRQSNKTIPRIGLSSSTDSKPDFSGNDAKVRNLIEELKSDSAEVQRSATGELRILSRHSLENRIAIANCGAIPFLVSLLHSTDPSTQENAVTILLNLSLDDNNKIAIASAEAIEPLIFVLQVGNPEAKANSAATLFSLSVIEENKIKIGRSGAIEPLVDLLGEGTPQGKKDAATALFNLSIFHEHKTRIVQAGAVNHLVELMDPAAGMVDKAVAVLANLATVHDGRNAIAQAGGIRVLVEVVELGSARSKENAAAALLQLCTNSNRFCTLVLQEGVVPPLVALSQSGTARAREKAQVLLSYFRNQRHVRVGRGLSLLLELKRTT

SEQ ID NO: 14182 - protein, 501 aa, Oryza sativa (japonica cultivar-group)
MEQEVKGMRLSHFLAQTPNNTTTEPVRIFVATWNVGGKAPTAELNLDDFLPPDDHSDIYVLGFQEIVPLNAGNVLVIEDNEPAARWLVLINQALNRPAETNANVFQNEPSPSVDSSVSRASSSLDTSFSDLAKTSSSSTIFQKSNLKSIRKSFMPVHRKRLKACNCPVEMAKSSYRDACFGCPKAYAYEIDSSEEDEREEKKGQSRDSNGSVRSEVISPPTARDELKYNLIACKQMVGIFVMVWVKKELVQHIGHLRTSCIGRGILGCLGNKGCISVSMTLHQTSFCFICSHLASGQKEGDEFRRNSDVLEILRLTLFSRICRRGVRKIPEKILEHDKVIWFGDLNYRIALSYADTKNFLMENNWDVLFERDQLKIERDAGRVFKGWNEGKIFFAPTYKYSYNSDAYASETATSNKKRRTPAWCDRILWRGDGILQLSYYRGESRFSDHRPVCGTFIVEVEVLNRKAKMRPSNANMKIGAEELLPQGNNKGKGTTLLAHMP

SEQ ID NO: 14183 - protein, 701 aa, Oryza sativa (japonica cultivar-group)
MAEHLASIFGTEKDKVNCPFYFKIGACRHGDRCSCLHNRPTISPTVVFANMYQRPDMITPGVDAQGQPIDPRQMQEHFEDFYEDIFEELSKFGEIENLNVCDNLADHMIGNVYVQFREEDQAAAAHTALQGRFYSGRPIIVDFSPVTDFREATCRQYEENSCNRESHNEAGAAAQAQAHAIGGSDMIVMTIEDVTITLVVVEGGVEAADMKGMMMEEGVGTVVALQGVRGVQSGRAARSAGPRSNSGIVKGTKSRGDRLCPSLARACDRTAMRRLTKRLLPSFRGAGRACHRRMARYRQAGTGTPGGGGGFLLICSTGDALFDETEFTFGKVEIFNTMHSCFKFSNDLGNQLKTIFFKKENKGGMQGKSKSMYNPCMSTTSMNQYVSHTQSFGLPSNQVVLGSMDEESAQHGNYAFPTSHISQCFQPTSNTWISQSANGIADGIPQWEYVNGMNNAPGMTETVNGSFREYQNGPSTLCRGPLPYFHQHAGMHAHNLLDHTQVQAPYQQCHNNPVLHGVNHSGNRFHLGPRIPVLFSNSERTFGPPHHPLLANPVNHRNIRILPPEHATIMDFSRLYEVSNVVDEHRDMRLDIDSMTYEELLALEEQIGDVNTGLAKSYIVEKLKTSLFVPGSSCMSNKSSESSMENDACIICQEEYQVKECIGTLDCGHRYHEDCIKQWLMVKNLCPICKTTALSTGRRSG

SEQ ID NO: 14184 - protein, 417 aa, Oryza sativa (japonica cultivar-group)
MEHLPVEVIGNILAHLSAARDVMVASGVCRKWRTACRKHLHSLSFNSDDFPRDMTTRQLEIVITQTIFQTMGLQCLSIHIDRTHEFSAAPVIAWLMYTRETLRSLSYNVRTNPNVNILEKCGRQKLEVLDLDHNTITGVEPSYQRFTCLKSLSLRHVSISALDLSLLVAACPKIESLALDFLEVVTSDPQSTMELTSHTLKSLFAKSVGVDKIILDTDNLEVLNLNALNLDLFELIGKGTLKHLKIDDVSVTHMDIGESTDHLEVVDVSNFTIVRPKLYSMISRASNLRMLRFWGVVFDDEDEIVDSETIAVSFPLLRHLSLSYELRDGLLHYSLQGSSPLDNVSVLELGWTVISEHFGPWVFGMIERCPNLKKLVIHGVLSEAKTREERQMLASFTSFIVCLMRKYVHVDVQFEYE

SEQ ID NO: 14185 - protein, 562 aa, Oryza sativa (japonica cultivar-group)
MASAASSLPLLVSSLLLALFALGAHADVKRYQFDIVMSNVSRLCHEKAMVTVNGSYPGPTIYAREGDRVIVNVTNHVKHNMTIHWHGLKQRRNGWADGPAYVTQCPIGSGGSYVYDFNVTRQRGTLWWHAHIAWMRATVHGAIVILPAAGVPYPFPKPDDEAEIVLGEWWHADVETVERQGSMLGMAPNMSDAHTINGKPGPLVPFCSEKHTYALQVQSGKTYLLRIINAAVNDELFFSIAGHNMTVVEIDATYTKPFAASTVQLSPGQTMNVLVSADQSPGRYFMVAKPFNDVPIPADNKTATAILQYAGVPTSVVPALPQTMPATNSTGSVAAFHDKLRSLNSPRYPADVPLAVDRHLLYTIGLNIDPCETCLNRSRLAASLNNITFVMPRTALLQAHYYGQKGVFAADFPDRPPARFNYTGVPLTAGLGTSLGTRLSKIAYNATVELVLQDTNLLSVESHPFHLHGYNFFVVGRGVGNFDPAKDPAKYNLVDPPERNTVGVPAGGWTAIRFRADNPGVWFLHCHLEVHTSWGLKMAFLVEDGSGPDESVLPPPKDLPKC

SEQ ID NO: 14186 - protein, 1023 aa, Oryza sativa (japonica cultivar-group)
MDEMSCGGGGGGARWKRARVAGMGEGKAGGGGGAAFLGLERVGMVVRMLPVPEKVSARARVVRGSLVAHFRGWRVVRETWWWVLLLWILAGSLGSFYLFLFMNAQSLDKRRDSLASMCDERARMLQDQFNVSMNHLQALAILVSTFHHSKTPSAIDQMTFARYAERTAFERPLTSGVAYAVRVTHGEREQFERQQGWAIKKMYSSSNKKQSSPGPGPGDAAVAEIREPAEEYAPVIFAQDAYKHVISFDMLSGNEDRDNILRARKSGKGVLTAPFKLLNNRLGVILTYTVYKYELPAYARPHERIQAAIGYLGGIFDIQALVEKLLKQLASQESIMVNVYDTTNESPISMYGDDTGSGMCHVSVLNFGDPSRKHEMHCRFEKKPPWPWLAITSSFGTLVIALLTGHIFQATVHRIAKVEDDFHKMSELKKRAEDADVAKSQFLATVSHEIRTPMNGVLGMLQMLMDTDLDTTQQDYVRTAQASGKALVSLINEVLDQAKIESGKLELETVPFDLRTVCDDILSLFCGKAQEKGLELAVYVSDQVPQILIGDPGRIRQIITNLVGNSIKFTERGHIYLTVHVVEEVMSCLEVETGIQNTNTLSGYPVANRRCSWESIRLFNRELHSSEKSFAPIASDSISLVISVEDTGVGIPFEAQSRVFTPFMQVGPSIARIHGGTGIGLSISKCLVGLMKGEIGFASKPHVGSTFTFTAVLMRAHCKGNDIKSSEFKGINALVVDHRPVRAKVTKYHLQRLGVKTELTAELNQFISKLNSGSLTAKLVLIDKETWLKESHCTPLLVNKLRNNDKPDSPKLFLLGSSASSPKGGSDTSREHNLNVIMKPLRASMLQVSLRRALGGVDKVHCRNGVVGNSTLGSLLHKKQIIVVDDNIVNLKVAAGALKKYGAEVTCADSGKKAITLLKPPHNFDACFMDIQMPEMDGFEATRRIRVMERDLNERIERGEAPPECASIQRWRTPILAMTADVIQATHEECLKSEMDGYVSKPFEGEQLYSEVARFFQNHDQVE

SEQ ID NO: 14187 - protein, 519 aa, Danio rerio
MALTILPILGPISVSESLVAIITICLVYLLMRLNRTKIPDGLQKLPGPKPLPIIGNVLEIGNNPHLSLTAMSKCYGPVFQIQIGMRPVVVLSGNDVIRQALLKQGEEFSGRPELYSTKFISDGKSLAFSTDQVGVWRARRKLALNALRTFSTVQGKSPKYSCALEEHISNEGLYLVQRLHSVMKADGSFDPFRHIVVSVANVICGICFGRRHSHDDDELVRLVNMSDEFGKIVGSGNPADFIPFLRILPSTTMKKFLDINERFSKFMKRLVMEHYDTFDKDNIRDITDSLINHCEDRKLDENSNLQVSDEKIVGIVNDLFGAGFDTISTALSWAVVYLVHYPEVQERLQRELDEKIGKDRTPLLSDRANLPLLESFILEIFRHSSFLPFTIPHCTSKDTSLNGYFIPKDTCVFVNQWQVNHDPELWKDPSSFIPDRFLTADGTELNKLEGEKVLVFGLGKRRCIGESIGRAEVFLFLAILLQRLKFTGMPGEMLDMTPEYGLTMKHKRCLLRVTPQPGF

SEQ ID NO: 14188 - protein, 157 aa, Drosophila melanogaster
MHATVSILSSTPTKTPYPRIVRPNCTIIKSLQTKLQILLQNTAVVDDSQTAYQDAFDISKGKMQPTHPIRLGLALNFSVFYYEILNSPDKACQLAKQVNNTLRLGSINRNVWQASKKGTQNPNPSILKNFFVYSQMVFLTFGFYFLLFYITKSCVNR

SEQ ID NO: 14189 - protein, 529 aa, Mus musculus
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKKRKSSSSVHLMPQSNNKNSLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 14190 - protein, 478 aa, Homo sapiens [sequence omitted]

SEQ ID NO: 14191 - protein, 263 aa, Escherichia coli O157:H7
MGKLTGKTALITGALQGIGEGIARTFARHGANLILLDISPEIEKLADELCGRGHRCTAVVADVRDPASVAAAIKRAKEKEGRIDILVNNAGVCRLGSFLDMSDDDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPEDPESVLTEMAKAIPLRRLADPLEVGELAAFLASDESSYLTGTQNVIDGGSTLPETVSVGI

SEQ ID NO: 14192 - protein, 552 aa, Homo sapiens
MAEKQKHDGRVKIGHYVLGDTLGVGTFGKVKIGEHQLTGHKVAVKILNRQKIRSLDVVGKIKREIQNLKLFRHPHIIKLYQVISTPTDFFMVMEYVSGGELFDYICKHGRVEEMEARRLFQQILSAVDYCHRHMVVHRDLKPENVLLDAHMNAKIADFGLSNMMSDGEFLRTSCGSPNYAAPEVISGRLYAGPEVDIWSCGVILYALLCGTLPFDDEHVPTLFKKIRGGVFYIPEYLNRSVATLLMHMLQVDPLKRATIKDIREHEWFKQDLPSYLFPEDPSYDANVIDDEAVKEVCEKFECTESEVMNSLYSGDPQDQLAVAYHLIIDNRRIMNQASEFYLASSPPSGSFMDDSAMHIPPGLKPHPERMPPLIADSPKARCPLDALNTTKPKSLAVKKAKWHLGIRSQSKPYDIMAEVYRAMKQLDFEWKVVNAYHLRVRRKNPVTGNYVKMSLQLYLVDNRSYLLDFKSIDDEVVEQRSGSSTPQRSCSAAGLHRPRSSFDSTTAESHSLSGSLTGSLTGSTLSSVSPRLGSHTMDFFEMCASLITTLAR

SEQ ID NO: 14193 - protein, 472 aa, Homo sapiens [sequence omitted]

SEQ ID NO: 14194 - protein, 472 aa, Homo sapiens
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLEPQTTVVHNATDGIKGSTESCNTTTEDEDLKARSPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNP

SEQ ID NO: 14195 - protein, 480 aa, Homo sapiens
MIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 14196 - protein, 497 aa, Homo sapiens
MSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 14197 - protein, 192 aa, Cowpox virus
MVIIDNECANIQSSAENATDTGHHQDSKINIEVEDDDDDDDDDDDDDDDDDDDDDDDDDDDDVIDDDDYNPKPTPIPEPHPRPPFPRHEYHKRPKVLPVEEPDPVKKDADRIRLDNHILNTLDHNLNSIGHYCCDTAAVDRLEHHIETLGQYAVILARKINMQTLLFPWPLPTVHPHAIDGSIPPHGRSTIL

SEQ ID NO: 14198 - protein, 266 aa, Mus musculus
MTLELLQSTRIGMSVNALRKQSTDEEVTSLAKSLIKSWKKLLDGPSTDKDPEEKKKEPAISSQNSPEAREESSSSSNVSSRKDETNARDTYVSSFPRAPSTSDSVRLKCREMLAAALRTGDDYVAIGADEEELGSQIEEAIYQEIRNTDMKYKNRVRSRISNLKDAKNPNLRKNVLCGNIPPDLFARMTAEEMASDELKEMRKNLTKEAIREHQMAKTGGTQTDLFTCGKCKKKNCTYTQVQTRSADEPMTTFVVCNECGNRWKFC

SEQ ID NO: 14199 - protein, 384 aa, Equisetum arvense
LLSGSLSDSTGPGSGAAARSLEDLFQGYGVRAATIAKVAEMGFTVSTLVNMTEPEIDDLVQALLDDGFRHPPDNLLVGEKYGLKSAIRAQKRCLEEDMNRQRLQILLKAGKKRASSADAADDRKTSNGAGAGVSLAGGERVSREHQGDDGMGFADVVASVGPLNLNSKEHVLLEQNRLNFGTPGLLSFPEPSSDNEGRKGGRKKKSRLLSQENGEDVDDRQREHPFIVTEPGELARGKKNGLDYLFSLYEQCAKFLEEVQQMSKERGEKCPTKVTNQVFRHAKLKGASYINKPKMRHYVHCYALHCLDVEQSNHFRKLYKERGENVGAWRQACYYPLVEMARRNGWDIEGVFNRNEKLRIWYVPMKLRQLCHVEKSKDSDSCSY

SEQ ID NO: 14200 - protein, 317 aa, Arabidopsis thaliana
MNGDELPFESGFEVYAKGTHKSEFDSNLLDPRSDPIWDAIREEAKLEAEKEPILSSFLYAGILAHDCLEQALGFVLANRLQNPTLLATQLLDIFYGVMMHDKGIQSSIRHDLQAFKDRDPACLSYSSAILHLKGYHALQAYRVAHKLWNEGRKLLALALQSRISEVFGIDIHPAARIGEGILLDHGTGVVIGETAVIGNGVSILHGVTLGGTGKETGDRHPKIGEGALLGACVTILGNISIGAGAMVAAGSLVLKDVPSHSVVAGNPAKLIRVMEEQDPSLAMKHGEFADSYILLALCICLARDLVVTVLERICRCY

SEQ ID NO: 14201 - protein, 469 aa, Pseudomonas aeruginosa
MKSGTPLYGMLGTLELLGRTELSRQQAGYLKAIQHSSSTLLQLISDVLDVSKIEAGQLDLECVEFSPLELTEEVVQSFTGAAQAKGLQLYTCLSAELPLRMRGAAASIRQILNNLLSNAVKFTDNGYVNVHLKASVVDAECVMLTWQVNDTGMGINVEDQPRLFEPFYQIRRSEHPVAGTGLGLSISQRLAQLMNGSLKLVSELGLGSSFSLRLPLERIAMQAEPQDLAGCAVQVLAPVRDLTECLCGWISRWGGRAMVATPRSLDEADATSLLVEVLLLEGAPMFEAWPGCRVELSPQGDMEPQAQGRDWLLGLNNLDGLHRALGLAHGRLADPSTPPIRLAPLRNLGLRVLVVEDNAINQLILRDQMEALGCSVELLFDGREALLHCQTACFDVVLTDINMPNMNGYELTAELRRQGFRQPIIGATANAMREERERCMSAGMNDCLVKPVDLNALQNCLINILKVDR

SEQ ID NO: 14202 - protein, 664 aa, Pseudomonas aeruginosa
MMDVIREHEVFLGRIARKSDKTTQKYDYDVVPLQRHLLAKENGLAVYEGREFSFAMPFLLATKHALSADSSGDPFSLGVLLANFYGSFWSVSAYPAPQLLIFDLSGSTRLAVPSIPSTAQRDRLSGSYPMIVERILARLRTRPVGEDAQRVHWIRADRYRDSALEMLGVARVDLPETLWWHDEPNHLIIAASLLDLRRINDFEQLVERPAFDSYSLVSPDGEVLLGAAPATGLRDGLNLTRQGVAVQLRSQPENGWLAVYRTDYGNFFRHSRWLVAGLLLTPALLLAGWLGMRWYTSSVVNPVHRAHRQLVESDTFSRTLIQTAPVALVVLTQDDQQLVTCNHLAAQWLGGPTEILGLTSNWKLFDARGQVPGDICIQVGGRYLQTAFAATRYAGTEAVLCVFNDITVHCEAETALSNAKRAADAASQAKTLFLARMSHEIRTPLYGVLGTLELLDLTTLNERQRAYLRTIQSSSATLMQLISDVLDVSKIEAGQMALTLAAFNPLDLVREVLGNFAASAMAKDLQVDPLDTLALEAQVAHGFEESVLFEVAGGSVGHFEEGVVGVVEQRLQRLFQLQRRLVAHLHEDDRQAPRSGVRRRLGSDPGQVHHIGIVLHRDSPATLAAAHGMAKIGHRGSIGVVRNVNFQASKTSIYIHYRDTFKSR

SEQ ID NO: 14203 - protein, 303 aa, Caenorhabditis elegans
MRIIHGQGYSEEDKRAHIRLVYQNVFMAIQSMIRAMDTLDIKFGNESEELQEKAAVVREVDFESVTSFEEPYVSYIKELWEDSGIQECYDRRREYQLTDSAKYYLSDLRRLAVPDYLPTEQDILRVRVPTTGIIEYPFDLEQIIFRMVDVGGQRSERRKWIHCFENVTSIMFLVALSEYDQVLVECDNENRMEESKALFRTIITYPWFTNSSVILFLNKKDLLEEKILYSHLADYFPEYDGPPRDPIAAREFILKMFVDLNPDADKIIYSHFTCATDTENIRFVFAAVKDTILQHNLKEYNLV

SEQ ID NO: 14204 - protein, 3432 aa, Dictyostelium discoideum
MNYSWIHEYYLGTCIQEEKVFSIYSASTSNNSFSFPSIPTTTTHFSNSVLNQTTTTTTTTTTTTTTTNTPPPPPQSQLQAQLQSQSQQNNQHHRPLSPNGGFFSITNSSSISDQDLRSRLKLYDDQPQQQQQQQASNKSKLSQKQTSQLNISGNNSGNSTPPLPTISNSNNSINFIHSPPPTPPLLKTPILSSHNHNNNNNNNNNNNNNNNNNNNNNNNNNNNNNNNNNNNNNNNNHNINTIDIDLVSPPPPLLLPSGSLSPLSFKHGYNSGLGGNFCSNSIANGIHLGKKPSEFQSHNNNVLLKILNYKYPPIEISTIFQREYFILSYLNDLDGTLKLIKTQSEYGNIVALIFEENGYKSLTSYYNVLSLLNGVGGCASFTNYNLNYNINNSLNNLNNNNNNNNNSYNNNYNNNNNNNGQVTSPILNNTELSQSSASAFKPFQLNSSTNSTGSPLIITSQPMPFQLNSNSNTTASSSSPITHSNLNTAITSTTTSNSNSNNNSNNNNSGGGGGGGGGGGGGGGTKINNKRRASLTPTSTPLSASPLLFNTKKYADIDINTFLSIAIQLTTILESIHGKGCIHRDIRPNNIYINSECKVKLANFQFSIFKKTSSFLKKSKFQQQHQQSENNNNNTLDSDITMIDNIDLTNSYNNNNNSSTNNIFFNFNNDYDEESINELFKSYPDLSRFSTSTYYYISPEDTGRTIHPVDEKSDLYSLGVTFFELLTGRLPFQSSDLSELIHSHLAKKPPLVIDLNQNVPLILSNIVNKLLQKSPDDRYQSAYGLKKDLEMFKLQLSIINNNNNNNNNNNNNNNNNLSNQQITDFKLGAYDVLNRPYISNELYSRKKELNSILTTIKRVSKGGKEFIIVSGLSGVGKTSLINQACKKSNTKVRFICGKFDQFNKSPYSAIIEALSQLVNLILSLSPLELEFYKDRLLRTLGSNISVITEVIPKLCLIVGTHYKVLPLPSSESQNRFDLAFKDFLRVFAEEGNPLVLFLDDFQRADPSSYRLIKLLMESNNSTSNNSTFLNCNGNNNNNNNNFSINNNNNNNNGCNNNNNNNNNNINNNNNNNNNNNINNSGGSLNYLLVIGAFRENEPNFELDFGDLSNFITMKIVLKNLDLKYVNLMVSTTLHASPQETLSLSQVVLSKTHGNAFFVILFLRTLFDESLVYFSTTTDKWCWNIEKIQKREFTDNVVEFMVENLKQLDKQAQRVLHLASCIGNSFDLDMLAFVAELSPEQCLKIMAEIISRDLIVITQQPTTTTNNNTTNNTNNNNTNNNNNNTNGNNSDINQTNLIRYHFVHDRIQQAAFNLVLLKDEKKQIHLNIGRILYKKNYVQSNNNSSNNNNNNNNNNNINIFEILNQYNFGIELIKDQDERLNLSKLNFEAGCKANSSTAFNYGNQYFQIALNLLFGESEQGEDDDLVWNEHYQMLFNIYLEKSQSEFMVGNCQESDRLLEKALQRAKKDEHIGEVTARRVKQYTLQLRFDDCIEMSIEFLKRQGIFLDINLSMDTLTKDYQKFKNRLNGQPISTIMNKLVGGGGGGSGSSNNSNNGSVVSPLVDCCLRVMVIMMPSLYLNNLNVLTLLLMKFVEYTLENGISSWSSTAFAMFGMVVSIGHFCDYSVGYQFGQYAMSLKEKYSEQPGTKGMVTLLYSGYIHHLGNHLSTSIPIVKQAFLESIEYGDFGCACYASVNLILHRILLGLPLDETYQLSKQYSNYIEQYYFKPMYQIVVSLQNFILELTGTDLLPEQQQPQQQTPNNSNSSCGSNCSSGGNSNNSNLNCSSGSSFASGSNYNNININNNNNNNNNNNNNNNNNNYNAEWDIEEFENDLLSTPDVHCPIAYHFISKCQTCYLFGDFESAWQAVLRGENSIIGIFAHTHLFSVLYLFKSLIIMKNLGNQHNNNNNNNSNHIYKTYGIENENNNDSNNNNYNFKIYSLEEEIKMAKDCIEKLESYSEQSYENFSSQLMLAKAEFERINGNFEQAMEYFSEAISLAQQFKYQQYEALANELSSRMYIQIKKFAVAKAYLIESHQCYKSWGALRKANQLELEFPNLLNFNRLNVQTKRSKRFEYSNNNNNNNSNNNNNNANQSQASISLSSSTSFNSKIIGNSSNSSNNNFNNNNNNNNNNNNLMAISSSSSICSSGSGSYGSSNGISGTTQLNSNYNSNFFEPSLSIRRRSQDGTVSTKNLSRYPVDAVDLCSVIKVSHSLAEEIYFDRLLKRLMKVVIKNAGASRGFLLLIEDKITKELFINPTSKTNITLLGDLSVAASALVNNEKVIVEVFINNNINNNNININSSGYNNTNKNDNNNNNNYSPAYNNNNNNNNNNNNNNNNNNNNNNNNNNNNNNKKQINEIIKNDSFNEEDGTWNMCLSMINYVKRTLTPLLITNAIQDNTFSEDPYVKKRNPKSILVLPIVYQGNLVSILYLENNFSTGIFSNEKLEILNLISSQIAISFSNARLFIKVNQLANQAFLAKEEAEKANKAKSDFISNMSHEMRTPLNHIIGSIELLKSYNHLFNSDQKELLDISAKSSESLLFMVNNILDLSKVEQGKTKLNLTNFNLVSFLEDSICAISPNAHLKGVYIALFINPCLSKIPVIGDINILRQVIVNLLTNAIKFTESGQVYIKLNLSINNNPTTTNNKKQLNTDNDGDDDDDDDNENLDENNEDTSIDLDDNGKVIYQKNPKSNQCYIVNIEVVDSGIGIKNEDFGKLFQRFSQIECGSNRAYDGTGLGLSIVKDLVCNLMKGDIGVKSKVGVGSTFHFCVELGKSFDESMSNKYHLPLELLNNNNNNNNNNNNNNNNNNNNNNNNNNNNNNINCSNGGSVNINSSGNSVFSCSSSNSGTRVTILEENKIICDQLSMLCVSNGLNDLTVLNDIFSLELLADCLDCYKPPIQSPRFGSTSSSLVLLSPRSTLNLSPKIISPRPYPNNQNNFLSSSPQMLSPLPNSPLSSSQQHQNNNNINNNNINNNNNNNNNNNNNNNNNNNNNNNNNNNNNNNNNNNNNNNGVGLSINLSNLNNHNHNNSHNNNSQQIQYQNSKEIFIIGLPFSYNEDKILTLVENIKSLTYSASFNKRGNISISSNVNKVEFILVTHILLSANSREILNNSNIYIVNRPIKMKTLHKTFLKIFENNNNNNINNINNNNNKSNSPIPEDSKHSQYKYQKQLSESNICYTKKPISPSPSSATVILEQQQDHNLQSPTAITTNLISEEYDHFDSNSTPPPNTATTTTTTTTLANSALANSTLANSISTTSHSSTSTSSSSSSSSSSSSSLSSTTTITTTTTTTSNLDKMLIDKKITSTQELKILIVEDNEMNANIMFKMLAKLGIQCEPHLALNGLEGVKKAKNEEYDLIIMDIQMPVMCGLTATSLIRKHEGTKKRTPIVAITASAMNGEMSKALAAGCDDYLSKPLQLKDLRYVINRYGPITLEYNS

SEQ ID NO: 14205 - protein, 1699 aa, Dictyostelium discoideum
MDKLKINNNLSPPSSPSSSTTTPNLSSTNLENNLNSNINNNINNFNLNNSTNTFNNSNNIIINNNNNNNNNNNNNNNNNNNNSNNNNNNINNNNPNVNSPNEVILNNNFLKQNKKGFFKRNKKMIEIFLPPKFKSPIYRRCCILLGECGVYVFIYMFFLIFLRSFYPIFICGIVSMIVLYIVSTKTTKYKLVALIYIFVQSILNFTFFLQITNNFNNNTVNINNTDDYSNEVIEFSKLNFLFIMNLILSLISIQIFFPKFTFSITLTCSLNIFNIIIHLISIYSLNTKKLIVFQNLIVPITVSFLLSFYSYILSIDNQEIEAKEKRFRNIFDTSSEALVIHKNGLIIDVNSTFEKIFQIKQSDLINGTIWEYLPELESFFQNTNGNSKYTNQSLQQQLQQQQQQQQQLYNTITNGGNNKQTSTTSANSTPRYNNYNNNNINSNNLNNLNVFNNLNNLNNLNNNNNNHHIHKVSRSNTGLSDSSSIFDDSDSVDFFSMKNINKCPIVLDTVGITPCGSEFCAQVKIERKKDMLIGSGTSSFNLLNNNNNNNNNNNNNNNNNNNNNNNNNNSNNNNNNNSNNNNNNNNINNNISNNIINNNNNNNNSGIITNLSQQSNNLSTTNLNTSSKIINHKHKNSKQDFDVMSIVDISAKKKLMIADQALRRTEELNQAKINFLTTVSHEVRTPINGILASVEILDGSQLDVTQRDFLSCIKQSADYLLDLITDILDFSKIEAGKFELDRVEFNLITMLEESINIVYRTAQERGIEVLTFIDPDVPIILIGDPYRVKQCVLNFLSNAIKFPHKGQVMVKVTIVDPINNNNNNNNNNNNNNNNNNNNNNNNNNNNNNKIVGFSNNNNNNNNNNNNGNNGILNFKLSFSVEDSGVGIKEEVLDCLFTPFHQLGGSPRKYLGTGLGLSISKKLTTLMGGEIGVKSVYGVGSAFSFTSILSTTSTTPISLQSLGSSLSIALNNLSPTIPKISGFIYDDNIHTSNSLFNFLKLMNINLKIINPIINNNNNNNNNNNNNNNNNNNNNNNNNNNNNDNNNNNNNNNDNNIDQQQLKFEFENEIDKYCNVEDDNNNVILIITNQLSNDNLNYFKDKINQLNNSIYWFVLCDNGLKAIDPFYYGIVKKPNNLLNLVDTVFKVYNCQLPQDLYQLLTNGSKDDYKNYLKYRNVVIKKITEDNEKKQQQQQQQQQQMGDTLSSTKSPQYTNLPPLDISSSSNGSLNKSNRSNLLRKSSSVYSDHVAITRGMVQVNRSPRPSTPPPLFNLKGNNSNPNSTELNSTNSVNGNPNNDSTLETIEPLNISETVGDLCSSGSVINNSNFIINNNFLTSSPYGSCLTPNSGTTSPSIPININNNDNNNNNNNNNNNNNNNNNNNNNNNNNNNNNNNNSFKKLEPDNFSPPPSILINDNNIIPALNVTTPITISTSTSSSSSLLINNEINNKSTTSKRPSFIPPLDIQSKKLIINTADENHKNNCIIDFEQIFGQDGKQQPQQQQQQQQQQQQQQQQQQQQQQQQQQQQQQQQQQQQQQQKLNIGNQQQQQILSSPRLQSQLLSNCDSLGNTPPVTPHRRNALIVDDTELNRKVLAQLLRRMDWSVSFAENGIEALKEITSERCFDIIFMDCQMPILDGFETTKLLRLRELENNWKPLNIVALSADSSSSFGQVCFDCGMNGYLGKPITLITLKDTLLKWGGYRD

SEQ ID NO: 14206 - protein, 2062 aa, Dictyostelium discoideum
MDLELDGLLTQCIHCCPHCKNKISISQLSACNLIKNRFYELNNKYNNFKNNNIYDIDCNNNSNLNNTNNNNNNNNNNDNNNSNNSFRNILNKDKDITNNNSHFNISDSFINFNNKIKNKSNKIKNGGNNNNNNNNNNNNNNNNNNNNNNNNNNNNNNNNNNNGESYNLFLDSLLKSLETVKGGDFKSRVKSNEQLFTEKENKIISTYNEILNFQDSTVTEFKRIEKQVGKEGNVMSRAFLPNAVGSWEFCIEFVNNLIGDMIQPTEEVIKVITSVARGDLSQTINLELGQGRKLTGEFLRIAKVVNTMVSQLNSFSSEVTRVAREVGTDGKLGGQAVVTGVDGIWKDLTDNVNTMAANLTGQVREIALVTTAVATGDLSKKITLDVKGEIQELKLTINTMVDQLKSFSSEVTRVSREVGTEGILGGQAQVKGVDGVWKDLTDNVNTMAANLTGQVRSIAEVTTAVAEGDLSKNITIDAQGEILQLKNTINTMVQQLKGFSSEVTRVAREVGTKGILGGQAEVTGVGGVWKGLTDNVNTMAANLTGQVRSIAEVTTAVAKGDLSKNITIDAQGEILQLKNTINTMVDQLKSFSSEVTRVSREVGTEGILGGQAEVTGVDGVWKGLTDNVNTMAANLTGQVRSIAEVTTAVAKGDLSKNITIDAQGEILQLKNTINTMVQQLKSFSSEVTRVSREVGTEGILGGQAQVEGVGGVWKDLTDNVNTMAANLTGQVRSIAEVTTAVACGDLSKNITIDAEGEILQLKNTINTMVDQLKSFSSEVTRVAREVGTEGILGGQAQVEGLGVGGVWKDLTDNVNTMAANLTGQVRSIAEVTTAVAEGDLSKQVSINAQGEILQLKNTINTMVDQLKSFSSEVTRVSREVGTEGILGGQAQVKGVGGVWKDLTENVNTMAANLTGQVRSIAEVTTAVACGDLSKNITIDAKGEILQLKNTINTMVQQLKGFSSEVTRVSREVGTEGILGGQAQVEGVGGVWKDLTDNVNTMAANLTGQVRSIAEVTTAVACGDLSKKISIDAQGEICELKNTINTMVDQLKSFSSEVTRVAREVGTEGILGGQAEVKDVGGVWKGLTDNVNTMAANLTGQVRSIAEVTTAVACGDLSKKISIDVRGEFLELKITINTMVDLLNSFSSEVTRVALEVGTEGILGGQAQVEGVDGVWKYLTQNVNTMAAKFTSQVREIANVTTAVANGDLSKKVNLDVRGEILQLKITINTMVDQLNSFSSEVTRVAREVGTEGMLGGQAQVEGVGGVWKDLTDNVNTMAANLTTQVRSIAEIAKAVTKGDFTRVISVDAKGEVNLLKLIINEMIHNLKETPLKNTLAKETAEAASRAKSDFMANMSHEIRTPMNGIIGMTDLTLDTELTAEQREYLSMVQSSAGSLLTIINDILDFSKIEAGRLELDQAEFSLRAHLYDALKTLSWRAHQKCIELVCDIASDVPDSLIGDPGRLRQIVNNLVGNAIKFTSQGEVDLVVKVEKSLSCGEVVLKFSVIDTGIGIPKDKLHLIFEAFSQADGSITRRYGGTGLGLTISTRLVELMKGKLSVVSKSGKGSTFEFTAQFPTSPNQLPLTEKLNDVHTLIVDDNKSTLKVLKQILSEFGITSEVSNNTQDAFNMIVKATKTTKPFEFIFVDAQLGTSLIDMMVEKNMNHCKTKIIMLISGGGQRGYPDSSSNFITGYLSKPVSPSEIFDILTRQGITRQIPKQLCKKIQLTSEIFGDILLAEDNAVNQRLAIRLLEKFGHRVQLAENGLQAVASSQLRKFDLILMDVQMPHCGGFEATAQIRKREHEQGIHTPIIAMTAHALARDRVKCLEAGMDDYISKPINPDQLKAMIEKYLFISKSCNSYEQFQQLQAQKSANYINSTSYYGQLTPTTTTTTTTTTALPSPQKILSIEDDKNLNSNDNNEKDNNNQNNNNNQNDNNKNDNNQNDFDQIKTISNNKESGVGENKKTTRNTSDNERIPKKSDMFDGDFVVQPQLVNRSSSNNKKSNDINGKPQQSQQQPHQQEQQQDIYFSKHQQQSNSPPLANTKRKENDLSNSSIPASKKNNTKQ

SEQ ID NO: 14207 - protein, 116 aa, Pinus pinaster
TVFTVILYGSPLSVIRLVIHTKSVEFMPSFYFSLFAFLGSVLWMVYGALSGDILIMAPNFVGIPLGLSQMALYCIYWNNSPVRVEATKLEAGGELKSIEQNIKEDIELYTEDIEKA

SEQ ID NO: 14208 - protein, 181 aa, Pinus pinaster
YVVELARALSMMPGVYRVDLLTRQISSPDVDWSYGEPTEMLCSGSYDVDGHGGGESSGAYIIRIPCGPRDKYIPKELLWPYIQEFVDGALGHILNMSKVLGDQAGKGDPVWPYVIHGHYADAGDSAALLSGALNVPMVLTGHSLGRNKLEQLLKQGRQSKEDINATYKIMRRIEAEELSLD

SEQ ID NO: 14209 - protein, 605 aa, Mucor racemosus
MADFTDSLIKNIGVHSSSPVMTSVNMGQLGEKLRQARTTTLASLSQALSKKPEAAAAAATAPNAVNESTTTPTTMQLPASEKATSQLEINVVEARNLTIADARKADTYCIVHYEGNTTSTLDKVDDGILPSTPLVIKSQVASGAFKAFEIMMSASSPKWMHRVNFDVTAGNKEITVFVYDRGNKLPNGEDRFLGMSSIVPNLVNKKTVELIFPLHGRPDDDQEVTGDVRLQVTFIDPKKANLKPEDFRIVRMIGQGSVGKVYEVIKRDSGRTYAMKVLSKRLLLAENEVDTAFNERNVLVQSLSSPFIANLKYSFQTTNHLFLVMDYFPGGELFDFLERERCLSEKRCQFFAAEIVCAFDNIHARNIVYRNLKPESILLDAHGHIALTDFGLCKQLKNKMDLIQGVPQVITQEYLAPEMVMQKPYGMAADWWSLGVLMFELLTGSPPFHSVEQGELFRQILEAPIKFPAGGCITEEAKDFICQLLERDPAKRLGSHGDVAQVKAHPFFKDLNWDVVYKKQMQLPFVPEVEEQLREEAIAAAAAISIPVTNSKTESTNANVMPVADQSKFKGFSYIREDVMAKKGEHRLGVNPEDEDPEVDFWFRQ

SEQ ID NO: 14210 - protein, 244 aa, Lycopersicon esculentum
MGRGKVELRKIENKINRQVTFSKRRGGLVKKAHEISVLCDAEVALIVFSQKGKIFEYSSDSCMEQILERYERYSYAERRLLANNSESPVQENWSLEYTKLKARIDLLQRNHKHYMGEDLDSMSLKDLQNLEQQLDSALKLIRSRKNQLMHESISELQKKERAILEENNMLTKKIKEKDKIVEQQGEWHQQTNQVSTSTSFLLQPHQCLNMGGNYQDEVAEARRNNELDLNLDSLYPLYNMNKHL

SEQ ID NO: 14211 - protein, 242 aa, Lycopersicon esculentum
MGRGKVELKRIENKINRQVTFAKRRNGLLKKAYELSILCDAEIALIIFSSRGKLYEFCSNSSMSKTLERYHRYNYGTLEGTQTSSDSQNNYQEYLKLKTRVEMLQQSQRHLLGEDLGQLGTKDLEQLERQLDSSLRQIRSTKTQHILDQLAELQQKEQSLTEMNKSLRIKLEELGVTFQTSWHCGEQSVQYRHEQPSHHEGFFQHVNCNNTLPISYGYDNVQPENAAPSTHDATGVVPGWML

SEQ ID NO: 14212 - protein, 397 aa, Lycopersicon esculentum
MGRGKVELKRIENKINRQVTFAKRRNGLLKKAYELSILCDAEIALIIFSSRGKLYEFCSNSSMSKTLERYHRYNYGTLEGTQTSSDSQNNYQEYLKLKTRVEMLQQSQRHLLGEDLGQLGTKDLEQLERQLDSSLRQIRSTKTQHILDQLAELQQKEQSLTEMNKSLRIKLEELGVTFQTSWHCGEQSVQYRHEQPSHHEGFFQHVNCNNTLPISMEQILERYERYSYAERRLLANNSESPVQENWSLEYTKLKARIDLLQRNHKHYMGEDLDSMSLKDLQNLEQQLDSALKLIRSRKNQLMHESISELQKKERAILEENNMLTKKIKEKDKIVEQQGEWHQQTNQVSTSTSFLLQPHQCLNMGGNYQDEVAEARRNNELDLNLDSLYPLYNMNKHL

SEQ ID NO: 14213 - protein, 351 aa, Zinnia elegans
MPPPLLGVEGDGLGNVSLMTSASTMESIFQKNAELTERNYLGLSDCSSFDSTAVSGISEVKRNNLNLKATELRLGLPGSQSPERDVDVDLVNSESLDEKPLFPLLPSKDGICSNSQKVFVSGNKRGFSDAIDEGKWMFGSSGTDSETSNMNGKISSGAQPVMIKDATSKVVTQEQTHATFGTNLNIVNTSNPPAAKAQVVGWPPVRSFRKNILATNSKTNDEVDGKPGPGALFVKVSMDGAPYLRKVDLRSYSTYQQLSSAIEKMFSCFTIGQCGSQGAPGRESLSESKLRDLLHGSEYVLTYEDKDGDWMLVGDVPWDMFIGSCKRLKIMKGSDAIGLAPRAMEKSKNRN

SEQ ID NO: 14214 - protein, 540 aa, Dubautia arborea
MKRSRERKKEAKTTSSVPDSGGMDELLEVLGYKVKSTDMADVAQKLEQLEMVMGEDGVLQLSDTVHYNPSDLSGWVQSMLSVLNENNNTPPSDHIVLSGDSSTTMIDFSNSSEIVVHGKQGSKMHEDDPYDLRAIAGGAIYGGESESSVRGNGNGNGIKRMKSTAVGSVDVQPESPRRVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLNIRASETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 14215 - protein, 538 aa, Dubautia arborea
MKRSRERKKEAKTTSSVPDSGGMDELLEVLGYKVKSTDMADVAQKLEQLEMVMGEDGVLQLSDTVHYNPSDLSGWVQSMLSVLNENTPPSDHIVLSGDSSTTMIDFSNSSEIVVHGKQGSKMHEDDPYDLRAIAGGAIYGGESESSVRGNGNGNGIKRMKSTAVGSVDVQPESPRRVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLNIRASETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 14216 - protein, 536 aa, Dubautia ciliolata subsp. glutinosa
MKRSRERKKEAKTTSSVPDSGGMDELLEVLGYKVKSTDMADVAQKLEQLEMVMGEDGVLQLSDTVHYNPSDLSGWVQSMLSVLNDNTPPSDHMVLSGDSSTTMIDFSNSSKIVVHGKQGSKMHEDDPYDLRAIAGGAIYGGESESSVRGNGNGHKRMKSTAVGSVDVQPESPRPVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLNIRASETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 14217 - protein, 536 aa, Dubautia ciliolata subsp. glutinosa
MKRSRERKKEAKTTSSVPDSGGMDELLEVLGYKVKSTDMADVAQKLEQLEMVMGEDGVLQLSDTVHYNPSDLSGWVQSMLSVLNDNTPPSDHMVLSGDSSTTMIDFSNSSEIVVHGKQGSKMHEDDPYDLRAIAGGAIYGGESESSVRGNGNGHKRMKSTAVGSVDVQPESPRPVVLVDSQEAGIRLVHTLMACAEAIQHNDLKLADALVKLVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLNIRASETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 14218 - protein, 536 aa, Dubautia menziesii
MKRSRERKKEAKTTSSVPDSGGMDELLEVLGYKVKSTDMADVAQKLEQLEMVMGEDGVLQLSDTVHYNPSDLSGWVQSMLSVLNDNTPPSDHIVLSGDSSTTMIDFSNSSEIVVHGKQGSKMHEDDPYDLRAIAGGAIYGGESESSVRGNGNGIKRMKSTAVGSVDVQPESPRPVVLVDSQEAGIRLVHTLMACAEAIQHNDLKLADALVKLVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLDIRASETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 14219 - protein, 538 aa, Dubautia raillardioides
MKRSRERKKEAKITSSVPDSGGMDELLEVLGYKVKSTDMADVAQKLEQLEMVMGEDGVLQLSDTVHYNPSDLSGWVQSMLSVLNDYNNTPPSDHIVLSGDSSTTMIDFSNSSEIVVHGKQGSKMHEDDPYDLRAIAGGAIYGGESESSVRGNGNGIKRMKSTAVGSVDVQPESPRPVVLVDSQEAGIRLVHTLMACAEAIQHNDLKLADALVKHVVILVASQAGAMAKVSTYFAGALAQRIYNIYPQNALETSCYEILQMHFYETCPYLKFAHFTANQAILEAFAGATRVHVIDFSLKQGMQWPALMQALALRYDGPPAFRLTGIGPPQPDNSDALQQVGWKLAQLADTIGVEFEFRGFVANSIADIDADMLDIRASETEVVTVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 14220 - protein, 538 aa, Wilkesia gymnoxiphium
MKRSRERKKEAKTTSSVPDSGGMDELLEVLGYKVKSTDMADVAQKLEQLEMVMGEDGVLQLSDTVHYNPSDLSGWVQSMLSVLNDNNNTPPSDHIVLSGDSSTTMIDFSNSSEIVVHGKQGSKMHEDDPYDLRAIAGGAIYGGESESLVRGNGNGIKRMKSTAVGSVDVQPESPRPVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNTDALQQVGWKLAQLADTISVEFEFRGFVANSIADIDANMLDIRPSETEVVAVNSVFEVHRFLARPGDVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 14221 - protein, 538 aa, Argyroxiphium kauense
MKRSRERKKEAKTTSSVPDSGGMDELLEVLGYKVKSTDMADVAQKLEQLEMVMGEDGVLQLSDTVHYNPSDLSGWVQSMLSVLNDNNNTPPSDHIVLSGDSSTTMIDFSNSSEIVVHGKQGSKMHEDDPYDLRAIAGGAIYGGESESSVRGNGNGIKRVKSTAVGSVDVQPESPRPVVLVDSQEAGIRLVHTLMACAEAVQHNDLKLADALVKHVGILVALQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANILDIRAPETEVVAVNSVFEVHRLLARPGAVEKVLSGITKMKPKIVTLVEQESNHNSAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 14222 - protein, 538 aa, Argyroxiphium sandwicense subsp. macrocephalum
MKRSRERKKEAKTTSSVPDSGGMDELLEVLGYKVKSTDMADVAQKLEQLEMVMGEDGVLQLSDTVHYNPSDLSGWVQSMLSVLNDNNNTPPSDHIVLSGDSSTTMIDFSNSSEIVVHGKQGSKMHEDDPYDLRAIAGGAIYGGESESSVRGNGNGIKRMKSTAVGSVDVQPESPRPVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLDIRPSETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 14223 - protein, 537 aa, Argyroxiphium sandwicense subsp. macrocephalum
MKRSRERKKEAKTTSSVPDSGGMDELLEVLGYKVKSTDMADVAQKLEQLEMVMGEDGVLQLSDTVHYNPSDLSGWVQSMLSVLNDNNTPPSDHIVLSGDSSTTMIDFSNSSEIVVHGKQGSKMHEDDPYDLRAIAGGAIYGGESESSVRGNGNGIKRMKSTAVGSVDVQPESPRPVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLKQGMQWPALMQALALRSGGPPAFRLTGIGPPQPDNSDALQQVGWKLAQLADTIGVEFEFRGFVANSIADIDANMLDIRPSETEVVAVNSVFEVHRLLARPGAVEKVLSGITKMKPKIVTLVEQESNHNGAVFMERFNEALHYYSTMFDSLESSALTLPNSQDDLVMSEVYLGRQICNVVACEGADRVERHETLTQWRVRMNSAGFEPVHLGSNAFKQASMLLALFAGGDGYRVEENDGCLM

SEQ ID NO: 14224 - protein, 535 aa, Madia sativa
ERKKEAKTTSSVPDSGGMDELLEVLGYKVKSTDMADVAQKLEQLEMVMGEDGVLQLSDTVHYNPSDLSGWVQSMLLVLNEDNNNTLDDDVSDHILLPGNSSTTMIDFSSSRTETVNRKHGSKMLEDDPYDLRAIAGGAIYRPESEGIGNGMKRMKTTAAGSEVVDVQPESPRPVVLVDSQEAGIRLVHTLMACAEAIQHNDLKLADALVKHVGILVASQAGAMAKVATYFAGALAQRIYNIYPQNALETSCNENLQMHFYETCPYLKFAHFTANQAILEAFAGATRVHVIDFSLNQGMQWPALMQALALRSGGPPAFRLTGIGPPQPDNSDALQQVGWKLAQLADTIGVEFEFRGFVANSIADIDANMLDIRASETEVVAVNSVFEVHRLLARPGSVEKVLSSITGMKPKIVTLVEQESNHNGAVFMERFNEALHYYSTMFDSLESSALTLPNSQDDLVMSEVYLGRQICNVVACEGTDRVERHETLTQWRVRMNSAGFEPVHLGSNAFKQASMLLALFSGGDGYRVEENDGCLM

SEQ ID NO: 14225 - protein, 548 aa, Carlquistia muirii
MKRSREHKKEAKSTSSVPDSGGMDELLEVLGYKVKSTDMADVAQKLEQLEMVMGEDGVLQLSDTVHYNPSDLSGWVQSMLLVLNDDNNNNNTADDSDHIFLPGNSLTTMIDFSNSTETVVHGKQRSKLHEDDPYDLRAIAGGAIYRSESESSMRGNGNPNGNGMKRMKTTAAGSEVVDVQPESPRPVVLVDSQEAGIRLVHTLMACAEAIQHNDLKLADALVKHVGILVASQAGAMAKVATYFAGALAQRIYNIYPQNAIETSCYEILQMHFYETCPYLKFAHFTANQAILEAFAGATRVHVIDFSLNQGMQWPALMQALALRSGGPPAFRLTGIGPPQPDNSDVLQQVGWKLAQLADTIGVEFEFRGFVANSIADIDVSMLDIRAPDTEVVAVNSVFEVHRLLARPGAVEKVLSSITGMKPKIVTLVEQESNHNGAVFMERFNEALHYYSTMFDSLESSALTLPNNQDDLVMSEVYLGRQICNVVACEGTERVERHETLTQWRVRMNSAGFEPVHLGSNAFKQASMLLALFAGGDGYKVEENDGCLM

SEQ ID NO: 14226 - protein, 548 aa, Carlquistia muirii
MKRSRERKKEAKTTSSVPDSGGMDELLEVLGYKVKSTDMADVAQKLEQLEMVMGEDGVLQLSDTVHYNPSDLSGWVQSMLLVLNDDNNNNNTADDSDHIFLPGNSLTTMIDFSNSTETVVHGKQRSKLHEDDPYDLRAIAGGAIYRSESESSIRGNGNPNGNGMKRMKTTAAGSEVVDVQPESPRPVVLVDSQEAGIRLVHTLMACAEAIQHNDLKLADALVKHVGILVASQAGAMAKVATYFAGALAQRIYNIYPQNAIETSCYEILQMHFYETCPYLKFAHFTANQAILEAFAGATRVHVIDFSLNQGMQWPALMQALALRSGGPPAFRLTGIGPPQPDNSDVLQQVGWKLAQLADTIGVEFEFRGFVANSIADIDVSMLDIRAPDTEVVAVNSVFEVHRLLARPGAVEKVLSSITGMKPKIVTLVEQESNHNGAVFMERFNEALHYYSTMFDSLESSALTLPNNQDDLVMSEVYLGRQICNVVACEGTERVERHETLTQWRVRMNLAGFEPVHLGSNAFKQASMLLALFAGGDGYKVEENDGCLM

SEQ ID NO: 14227 - protein, 540 aa, Calycadenia multiglandulosa
ERKKEAKASTSSSSSMAPAAKAKDLQNPPDSGGMDELLEVLGYKVKSTDMDDVAQKLEQLEMVMGEDGILQLSDTVHYNPSDLSGWVQSMLSELNNSGGDSDIGIGIPAGGESSTTMIDFSNNKEKQPEDPYDLRAIAGGAIYGEGSESSGNGIKRMKMKSTAEGSGAVDVPPESPPRPVVLVDSQEAGIRLVHTLMACAEAVQNNDMKLAEALVKHVGILVASQAGAMAKVATYFAGALAQRIYKIYPQDGGLETSCWEILQMHFYESCPYLKFAHFTANQAILEAFAGAARVHVIDFSLNQGMQWPALMQALALRPGGPPAFRLTGIGPPQPDNTDALQQVGWKLAQLADTIGVEFEFRGFVAASIADIDAAMLDIRLDEVVAVNSVFELHRLLARPGAVEKVLSSITSMKPKIVTLVEQESNHNGVVFMDRFNEALHYYSTMFDSLESSALTQPNSQQDLVMSEVYLGRQICNVVACEGPDRVERHETLTQWRTRMISAGFEPVHLGSNAFKQASMLLALFAGGDGYRVEENDGCLM

SEQ ID NO: 14228 - protein, 380 aa, Anisocarpus madioides
MKRSRERKKEASSVPDSGGMDELLEVLGYKVKSTDMADVAQKLEQLEMVMGEDGILQLSDTVHYNPSDLSGWVQSMLLVLNDNNTTTTADDSGHILLPGDSSTTMIDFSSETVVHGKPGSKIHQDDDLRAIAGGAIYRSESESSMPGNANPNGNGVKRMKTTAAGSEVVDVQPESPRPVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGAKRVHVIDFSLNQGMQWPALMQALALRSGGPPAFRLTGIGPPQPDNSDALQQVGWKLAQLADTIGVEFEFRGFVANSIADIDANMLDIRLPE

SEQ ID NO: 14229 - protein, 143 aa, Anisocarpus madioides
RPGAVEKVLSAITKMKPKIVTLVEQESNHNGALFMERFNEALHYYSTMFDSLESSALTLPNSPDDLVMSEVYLGRQICNVVACEGTDRVERHETLTQWRVRMNSAGFEPVHLGSNAFKQASMLLALFADGDGYRVEENDGCLM

SEQ ID NO: 14230 - protein, 542 aa, Argyroxiphium sandwicense subsp. macrocephalum
MKRSRERKKEAKTTSSVPDSGGMDELLEVLGYKVKSTDMADVAQKLEQLEMVMGEDGILQLSDTVHYNPSDLSGWVQSMLLVLNDNNNNTAHDSGHILLPGDSSTTMIDFSSEIVVHGKPGSKIHLDDDLRAIAGGAIYRSESESSMPGNGNPNENGVKRMKTTAAGSEVVDVQPESPRPVVLVDSQEAGIRLVHTLLACAEAIQHKDLKLADALVKHVGILVASQAGAMAKVATYFAGALAQRIYNIYPQNALETSCYEILQMHFYETCPYLKFAHFTANQAILEAFADATRVHVIDFSLNQGMQWPALMQALALRSGGPPAFRLTGIGPPQPDNSDALQQVGWKLAQLADTIGVEFEFRGFVANSIADINANILDIRAPETEVVAVNSVFEVHRLLARPGAVEKVLSSITGMKPKIVTLVEQESNHNGNVFMERFNEALHYYSTMFDSLESSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 14231 - protein, 541 aa, Argyroxiphium sandwicense subsp. macrocephalum
MKRSRERKKEAKTTSSVPDSGGMDELLEVLGYKVKSTDMADVAQKLEQLEMVMGEDGILQLSDTVHYNPSDLSGWVQSMLLVLNDNNNTAHDSGHILLPGDSSTTMIDFSSEIVVHGKPGSKIHLDDDLRAIAGGAIYRSESESSMPGNGNPNENGVKRMKTTAAGSEVVDVQPESPRPVVLVDSQEAGIRLVHTLLACAEAIQHKDLKLADALVKHVGILVASQAGAMAKVATYFAGALAQRIYNIYPQNALETSCYEILQMHFYETCPYLKFAHFTANQAILEAFADATRVHVIDFSLNQGMQWPALMQALALRSGGPPAFRLTGIGPPQPDNSDALQQVGWKLAQLADTIGVEFEFRGFVANSIADIDANILDIRAPETEVVAVNSVFEVHRLLARPGAAEKVLSSITGMKPKIVTLVEQESNHNGNVFMERFNEALHYYSTMFDSLESSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 14232 - protein, 542 aa, Argyroxiphium kauense
MKRSRERKKEAKTTSSVPDSGGMDELLEVLGYKVKSTDMADVAQKLEQLEMVMGEDGILQLSDTVHYNPSDLSGWVQSMLLVLNDNNNNTAHDSGHILLPGDSSTTMIDFSSEIVVHGKPGSKIHLDDDLRAIAGGAIYRSESESSMPGNGNPNENGVKRMKTTAAGSEVVDVQPESPRPVVLVDSQEAGIRLVHTLLACAEAIQHNDLKLADALVKHVGILVALQAGAMAKVATYFAGALAQRIYNIYPQNALETSCYEILQMHFYETCPYLKFAHFTANQAILEAFADATRVHVIDFSLNQGMQWPALMQALALRSGGPPAFRLTGIGPPQPDNSDALQQVGWKLAQLADTIGVEFEFRGFVANSIADIDANILDIRAPETEVVAVNSVFEVHRLLARPGAVEKVLSSITGMKPKIVTLVEQESNHNGNVFMERFNEALHYYSTMFDSLEGSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 14233 - protein, 544 aa, Argyroxiphium kauense
MKRSRERKKEAKTTSSVPDSGGMDELLEVLGYKVKSTDMADVAQKLEQLEMVMGEDGILQLSDTVHYNPSDLSGWVQSMLLVLNDNNNNNNTAHDSGHILLPGDSSTTMIDFSSEIVVHGKPGSKIHLDDDLRAIAGGAIYRSESESSMPGNGNPNENGVKRMKTTAAGSEVVDVQPESPRPVVLVDSQEAGIRLVHTLLACAEAIQHNDLKLADALVKHVGILVALQAGAMAKVATYFAGALAQRIYNIYPQNALETSCYEILQMHFYETCPYLKFAHFTANQAILEAFADATRVHVIDFSLNQGMQWPALMQALALRSGGPPAFRLTGIGPPQPDNSDALQQVGWKLAQLADTIGVEFEFRGFVANSIADIDANILDIRAPETEVVAVNSVFEVHRLLARPGAVEKVLSSITGMKPKIVTLVEQESNHNGNVFMERFNEALHYYSTMFDSLEGSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 14234 - protein, 534 aa, Dubautia arborea
ERKKEAKTTSSVPDSGGMDELLEVLGYKVKSTDMADVAQKLEQLEMVMGEDGILQLSDTVHYNPSDLSGWVQSMLLVLNDNNTNNTAHDSGHILLPGDSSTTMIDFSSEIVVHGKPGSKIHLDDDLRAIAGGAIYRSESESSMPGNGNGVKRMKTTVAGSEVVDVQPESPRPVVLVDSLEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLNQGIQWPALMQALALRSGGPAAFRLSGIGPPQPDNSDALQQVGWKLAQLADTIGVEFEFRGFVANSIADIDANILDIRAPETEVVAVNSVFEVHRLLARPGAVEKVLSSITGMKPKIVTLVEQESNHNGNVFMERFNEALHYYSTMFDSLESSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 14235 - protein, 537 aa, Dubautia knudsenii
ERKKEAKTTSSVPDSGGMDELLEVLGYKVKSTDMADVAQKLEQLEMVMGEDGILQLSDTVHYNPSDLSGWVQTMLLVLNDDNNNTADDSGHILLPGDSSTTMIDFSSEIVVHGKPGSKIHLDDDLRAIAGGAIYRSESESLMPGNGNPNGNGVKRMKTTVAGSEVVDVQPESPRPVVLVDSQEAGIRLVHTLMACAEAIQRNELKLADALVKHVGILVASQAGAMAKVATYFAGALAQRIYNIYPQNALETSCYEILQMHFYETCPYLKFAHFTANQAILEAFAGATRVHVIDFSLNQGMQWPAFMQALALRYGGPPAFRLTGIGPPQPDNSDALQQVGWKLAQLANTIGVEFEFRGFVANSIADIDANILDIRAPETEVLAVNSVFEVHRLLARPGAVEKVLSSITGMKPKIVTLVEQESNHNGNVFMERFNEALHYYSTMFDSLESSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 14236 - protein, 537 aa, Dubautia menziesii
ERKKEAKTTSSVPDSGGMDVLLEVLGYKVKSTDMADVAQKLEQLEMVMGEDGILQLSDTVHYNPSDLSGWVQSMLLVLNDNNNNTAHDSGHILLPGDSSTTMIDFSSEIVVHGKPGSKIHLDDDLRAIAGGAIYRSESESSMPGNGNPNGNGVKRMKTTVAGSEVVDVQPESPRPVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLNQGMQWPALMQALALRSGGPPAFRLTGIGPPQPDNSDALQQVGWKLAQLADTIGVEFEFRGFVANSIADIDANILDIRAPETEVVAVNSVFEVHRLPRRPGAVEKVLSSITGMKPKIVTLVEQESNHNGNVFKERFNEALHYYATMFDSLESSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 14237 - protein, 539 aa, Dubautia raillardioides
ERKKEAKTTSSVPDSGGMDELLEVLGYKVKSTDMADVAQKLEQLEMVMGEDGILQLSDTVHYNPSDLSGWVQTMLLVLNDDNNTTADDSGHILLPGDSSTTMIDFSNSSETVVHGKPGSKIHLDDDLRAIAGGAIYRSESESSMPGNGNPNGNGVKRMKTTVAGSEVVDVQPESPRPVVLVDSQEAGIRLVHTLMACAEAIQHNDLKLADALVKHVGILVASQAGAMAKVATYFAGALAQRIYNIYPQNALETSCYEILQMHFYETCPYLKFAHFTANQAILEAFAGATRVHVIDFSLNQGMQWPALMQALALRSGGPPAFRLTGIGPPQPDNSDALQQVGWKLAQLANTIGVEFEFRGFVANSIADIDANILDIRAPETEVVAVNSVFEVHRLLARPGAVEKVLSSITGMKPKIVTLVEQESNHNGNVFMERFNEALHYYSTMFDSLESSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 14238 - protein, 537 aa, Dubautia microcephala
ERKKEAKTTSSVPDSGGMDELLEVLGYKVKSTDMADVAQKLEQLEMVMGEDGILQLSDTVHYNPSDLSGWVQTMLLVLNDDNNNAADDSSHILLPGDSSTTMIDFSSEIVVHGKPGSKIHLDDDLRAIAGGAIYRSESESLMPGNGNPNGNGVKRMKTTVAGSEVVDVQPESPRPVVLVDSHEAGIRLVHTLMACAEAIQRNDLKLADALVKHVGILVASQAGAMAKVATYFAGALAQRIYNIYPQNALETSCYEILQMHFYETCPYLKFAHFTANQAILEAFAGATRVHVIDFSLNQGMQWPAFMQALALRSGGPPAFRLTGIGPPQPDNSDALQQVGWKLAQLANMIGVEFEFRGFVANSIADIDANILDIRAPETEVVAVNSVFEVHRLLARPGAVEKVLSSITGMKPKIVTLVEQESNHNGNVFMERFNEALHYYSTMFDSLESSALTLPNSQDDLVMSEVYLGRQICNVVACEGTDRVERHETLTQWRVRMNSAGFEPVHLGSNAFKQASMLLALFADGDGYRVEENDGCLM

SEQ ID NO: 14239 - protein, 354 aa, Cryphonectria parasitica
MCFGSRKKEEADAMRSRELDKIIKADEKRMAKEVKLLLLGAGESGKSTVLKQMKLIYATGFSKTEKLEWKPVVFNNIVQSFRMIYDAMKEFDIPFEKPQSEKDMEQVLVDYELSPNDQFPEQYLQPLKDLWLDEGVKKAIAKGNEYALHDNLDYFCDDLDRFWDRTYIPTDQDLLRSRLRTTGITETIFDLSQLTYRMFDVGGQRSERKKWIHCFENVNCLLFLVAISGYDQCLVEDKDGNQMNEALMLWESIANSHWFLKSALILFLNKMDLFKEKLKKSPITQHGFTDYHGEPDDWKQASKYFMDKFRALNRNPEKEIYGHFTNATDTNLLKITMGSVQDMIIQRNLKQLIL

SEQ ID NO: 14240 - protein, 444 aa, Arabidopsis thaliana
MATITVVKARQIFDSRGNPTVEVDIHTSNGIKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINDGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 14241 - protein, 491 aa, Arabidopsis thaliana
MAASYEEERDIQKNYWIEHSADLTVEAMMLDSRASDLDKEERPEVLSLLPPYEGKSVLELGAGIGRFTGELAQKAGELIALDFIDNVIKKNESINGHYKNVKFMCADVTSPDLKITDGSLDLIFSNWLLMYLSDKEVELLAERMVGWIKVGGYIFFRESCFHQSGDSKRKSNPTHYREPRFYSKVFQECQTRDAAGNSFELSMIGCKCIGAYVKNKKNQNQICWIWQKVSSENDRGFQRFLDNVQYKSSGILRYERVFGQGFVSTGGLETTKEFVEKMNLKPGQKVLDVGCGIGGGDFYMAEKFDVHVVGIDLSVNMISFALERAIGLSCSVGFEVADCTTKHYPDNSFDVIYSRDTILHIQDKPALFRTFFKWLKPGGKVLISDYCRSPKTPSAEFSEYIKQRGYDLHDVQAYGQMLKDAGFTDVIAEDRTDQFMQVLKRELDRVEKEKEKFISDFSKEDYDDIVGGWKSKLERCASDEQKWGLFIANKN

SEQ ID NO: 14242 - protein, 1709 aa, Dictyostelium discoideum
MQGSKTHIIENSNNGNNKGVVIEELGETYYTNSKPSTSADCKYFRDSFEFGSNNNNNNNNNNNNNNNNNNNNNNNNNNNNNNNNNNNNEEKSNNETEKTLESNGDTTTTTTTNNNNNNNNNNNNNNNNNNNNNNNNNNNNNNNNNNTNSSNDIYMNSPSSTLSSPGNAGNNLPIGCTKPNVPKSPYSPSPPHLYKSNSTSYLKSSFFSGNGSSSSSSSTTTTNINSNNSNTNTYSTSTNVKKNNSNTNSNTNNNTNGNTNTNSNSNKKNINSNSSDNIIINDTADIMNRRRDRFKSFSWTIGESNSNSKFSELSMISSKCKSIKSEFTPLFETLTVFDESDKIRHSLIQNHYKTLLIQNPASPNRTLLTNLLQRRGHNLTTCPIDINHVLQLLQKESFSLFIFDPNESIINNTSNSISSNEPISLSSSSSYYNNNNSNNNSVNNNNNNNSGNSTNNNSPSSHTPNSPMIFQPIVSNICSNSGGSGNNSPHHIDNNNNSNQQQQQQQQQQQQQQQHQHQQQQQQSSSTTATTNNSCTLYQQQQQQQQQQQQQQQQQQQQQQSQPTTPTQSTQSPTTSISFSKKKNLTINTSFKTSPMSSPKSFNKPSQSPQNIFNNFSNTYNPNNIEFCKILKSKLTEFETVIVWTESTDPSEFCQYIDAGATDYIPQPISPILLDLRLTTGQKVVNTNLHLKKGESLKDAPGKMVTCIENSPDCVEIWDPSGHIQYLNLAFSEMTGFARWELLGKEFSNLIDNTEIIPNMWATLTDKKTWNGFIRTRHNNNTLIYFEASISPVLDQFQQILYYNCTKRDVTQKRIDEESKTLEQNKIIEKSRLRLSMMSHDIRTPMSNIIGMADLLLDTSLSQHQHHYLEIIKNSSNTLLTIINDILDISKIEAGKLDIDYESFDFNATVSQVVESMAQRVQSKGLELLSYVDPKIPNILIGPSSRLNQILTNLLGNSLKFTDKGEISICCLLNDETDSEYEIKVDVRDTGIGIKKEALPLLFKAFTQAEGTITRQYGGSGLGLAICKELVHLAFNGEISVESQYGHGSTFTCILKFKKFLPSDSQNLLPASSPLQQQQQQQQHQQQTQFHQHQQQTQFHQHQQQQLQHQQHQQHQQLQQQQQQQQQLQQQLQQHQQHQLQQRQHHQQQLQQQQHHHHQQVHLQQQQQHEHDAQHNQHIQQQQQQQQQQQQQQQQHEHNNNGHHNSHGHNHHGSHHNHNHQHNNNNNNITINKLQHQEKKQKSNEQQLESITENSFSPIVEPMVISDPDTPEALNISQSPSPQSIHNGTTINQQPTSPLNTLGSKFDFSGAKMLFIERNDTSRGNLFKQLLAWNIQLELVEDGESGFRKWKQSIESNSPYSIIIMDLNTPGVDGASLPMRIKKELELMQQHLQQQQEQEQQQQQEQQQSELQKQPDVENKNSSQNNDNNNNNNKSNSSGGNQCIYRSPIIMLMPIQFLNSQLEDNLKDAGVCAILSKPIRMSQLADVFMMYLGPNSEHNNNNNYNNNNGNGYLNGGGGGGGSVNGTGNGTLQVGMSNDGGNGCGVVSFWNKQRRASAEEQEQDPSKLLGKVLVVDDNHINIQILSKMLQTVGCEVDSVLSGADALAKINQSSGDSYDAIFLDIQMPDMDGFQVSRKIREREKKFSLPRVAIIATTANVFKEDQLKCFDAGMDDFISKPIKRAEIKEIIKKYGKNGNHQSGSAYSLYKLS

SEQ ID NO: 14243 - protein, 272 aa, Arabidopsis thaliana
MKVKLDVKIIYSWGKNVDVIPRGAGKGEALEYLLKKLQAEGIFPVNTLACGDSEHDAELFSIPDVHGVMVSNSQEELLKWRSENALNNLKVIHSTERCADGIIQAIGHFNLGPDLSPRDVSEFLDRKMDNVNPGHEVVRFYLFYERLRRGEIKNYETYIASFKDSCLHAAVLFHPSGAEKSLRDTIDELKKCYGDKRGKKFWVWVDQVLVTDTIPGKWIVKFDKWEQCEDESQCCKTTVEFTSKGGDLVWEKVKQIWSEESKVKDDNSSWIL

SEQ ID NO: 14244 - protein, 365 aa, Populus tremula x Populus tremuloides
MSPPLLGVVEEEGQSNVTLLASPASAESACLNGLELKERNYMGLSDCSSVDSSAVSAASDERKASLNLKATELRLGLPGSQSPERNHELSLLSSALLDEKPFFPLHPSNDGHYSTQKNVVSGNKRVFSDAMDEFSESKFLSNSEVNAMLSPRPSPNMGLKPGMLENLGVQQAKVKEIVAPKAGQERPHAANETRPLRNSSANNSSAPAPKAQVVGWPPIKSFRKNSLATTSKNTEEVDGKAGPGALFIKVSMDGAPYLRKVDLRNYSAYQELSSALEKMFSCFTIGQYGSHGAPGREMLSESKLKDLLHGSEYVLTYEDKDGDWMLVGDVPWEMFIETCKRLRIMKSSDAIGLAPRAMEKCKNRN

SEQ ID NO: 14245 - protein, 277 aa, Populus tremula x Populus tremuloides
MATATVLGTERADLNYKATELCLGLPGAVGVKNEVETPNKATGKRGFAETVDLKLNLQAKEGVMDLNENINNIASEDKNHLPSATIKDPAKPPAKAQVVGWPPVRSYRKNVLAQKNASEEGFGAQVEGWPPVRSYRKNVLVQKNASEEGEKASTGGCSAAFVKVCMDGAPYLRKVDLKMYKSYQELSDALAKMFSSLTMGNYGAQGMIDFMNESKLMDLLNSSEYVPSYEDKDGDWMLVGDVPWEMFVDSCKRPRIMKGSEAVGLAPRAMEKCKSRT

SEQ ID NO: 14246 - protein, 229 aa, Populus tremula x Populus tremuloides
MEVEKGTKMRFEETELRLGLPGNGGGGTEGGEFARKRGFSETVDLKLNLSSKEGGIDPNHEKTRREKNLLATDPAKPPAKAQVVGWPPVRSFRKNMLAVQKSSTDQESTNKVPGGNATFVKVSMDGAPYLRKVDLNMYKTYHELSDALGKMFSSFTIGNCGSHGMKDFLNESKLIDLLNGTDYVPSYEDKDGDWMLVGDVPWDMFVESCKRLRIMKGTEATGLGNEYTA

SEQ ID NO: 14247 - protein, 479 aa, Caenorhabditis elegans
PRARHFFPESAVLIVLGLFAGFTIYELWTVDLFLHPDLFFLYLLPPIVLEAGYFMPNKAFISNITTISLFAVAGTVMNIFLTSCFIFAFQNFYDFNITIVDTLLFSTVISAVDPVAVLSVFEEIHVNKLLYITVFGESLLNDAVTVVLYHSFHSMVRIGQAHLIYQDYTMSMMNFFLVSGGGILVGVVFAVVAALGVKWSSNVSVLQPIICITVPYMAYLCSEIVHVSGILGIVVCGLCMKSYVTGSMEERADITVKYTLKTLSSCCEAIIFVFLGFSIFSKDHKWDFGFAIVTVITCFAARFLVVFTLTWVANKWRMQKISLRDQTIMAFGGLRGAICFGLVLTIDGEVVPAKPIMISTTLIVIVFTVFIQGTMIKPLVSFLNVKIDNAYDKSLFQSCIEHSFEDTMCGVEAIIGAHGQYYWKNKVDKWNAQFLEPALTRQDMNRGRRLLKKLTDMTTDEQREALLQEESAMLEEHQV
